United States Patent 8,781,750 (CELL-TYPE-SPECIFIC PATTERNS OF GENE EXPRESSION) - sequence listing, part 54

SEQ ID NO: 38439 - DNA, 757875 bp, Homo sapiens
atggagccgctgaaggtggaaaagttcgcaaccgccaagaggggaaacgggctgcgcgccgtgaccccgctgcgccccggagagctactcttccgctcggatcccttggcgtacacggtgtgcaaggggagtcgtggcgtcgtctgcgaccgctgccttctcgggtgcgtaaggagcgccctcgcctacctgagtcgcgagctgtgtggggtgctggggaggggggggcgtcgggcggccggcagccgcgggactcctgctggatggggctgcacaggcagcttggcggtgctgcccctgacgcgcgtgtgcccgggggcgggtcgctgctgacaggccccgcccggacacccccctaggttgccgcagcggggctgggagggggcccaggctcagccactgccccccaacctgggctgcggtggaaatgggaaagccattgggcagacttgagggggaagcgttgtgccggggataattttgctgggagacgaaaagtctgtgtgctggacagtcttccttggtgcggctgtggaaatcacacgtggcgggcgtggggctgggtgggagctgggatgagtataaatcaggctcccctgcagaggccccgccggtaaagcatcaggcttgcagcaggtggaagaatcttgatgtctacggtgcacctctgtggtctgggttgtgtgtggcctggggatacgaagaggaacgggacctcctcaaagagctgatcaagtgagagagagaattacagtgtaccagaagggctgaaatagaggggcaattaatgtgctgtgggagcatcagacacgggtcccccgtgtgctgtgccatttaatggctgtgcaggcatgtctaactcttaaccaccattctagatgcagggattcacgtgaaggtgttttggaagcctggacgcgctgtgccggtgtaaagtgctatgtgaaagcaatttatggaaatgtgtaacatacatgaataataggaactgcattcagtcaacaaatattattgagcttctgtgtgcgaggaagaagagttctattttgagatgagtgcgatgattttgtgcatggccgcttttcagacctgccagtctgagatttaggtgggtggaggtgggacggtaagtgcaaaactcgtatctgtaatttgaccattgttcttactttgttctcatttgattcataattcaggaatatgactttgcattttagagctaccaaataataattttgtctgttgctttctgaagtaatgataacagcgaaaacatctgttcgggagagagcagcatcttgaagtttttgtaaactgtgtggttgaaaacaattcgttcctttcaagatagttcttggaacagaaaagttttggaatgaataaatggtgacaaattggcaattgaatcattagagctgaagttgagtcttgtgacacacggaattgtgcatttccaaaataagctacacaaaccctttgtgggtgggatgcttgttgatttaccatactatttcattagtctcattcatttttcctgtttgcagtaactggggatttaagcaaaaaaggaatttaatgaaagagttttgggggagttctcagtgttgctttaaagtctgccaagacttgactgggcatcggctgaaccaagttaggattgcactgcaaaagtagctggggctgggatctggggtgtatatcacttctgtcgcctgataatattggattctgcagtaggtaccacgaacaccatagacactggaccctggtgctgctgctgctgctgctccttgggaaactcactgttgctggagagtgattctctcaaccattcttctttgtgatactggcttttattcaaagtcctcagtgagtgtcttggattggctaaacttaggtcactgcctgcacccctagcgcgagggaggttgagacggtatttagcctttttggcttttaagatagaaggcaggctcactctacttcccaccgatagttatccagtggggaaatcagcaaacataaacatagaaaaagggatataagtaaatgctaagcatctaaacaaaacaagctaaacagattcttcataatgactgacaaatacttactagtattttacacagacacaaaatatttgcacttactttggattgccaggatacacagttcacttgtgttgtggtagtagttgctctgtttgaacactcccattttagtggttatagtgttccaaagagcctggttgggaatcactgcaacctgaaaatagtgttagggaaatgttagcgcattgtttgatgcagttttctgccactgttgaatgcctgtccttgagggataagtttctgtattacttgtcatcttgtaagtaaaatttgtttctctttattcactgtccattgtgaagtctttaagaatagtgcatctttcagtttttgtagccccagtgtctaacacatagtaagcccttagttttagtatgaatgtctggcagaattttcctcctaactgcccctgtccttctgctgccttccatctgaattaagtatggaatgaaaatgttagtttgtagcaattaacagttacatgggaaaggaaaaatcaaaatagaattaaaaaaacagatattgatgataattacagtcatgcactgcataacgacattttggtcagcgaaagaccagatacatgacagtggccctgtatgattatatcattttttaactgtactttttctgtgtttaggtacatttagatacacaaatacttaccattgttttacagttacctacagtattcagtacagtaacacgcggtgcaggtttatagcctcagagcagtaggcagtacagacaatacctgctagcctaggtgtgtagcaggctgtatgtacagtctgggtttgtgtgaggatacaccatgatgttcctacaacaatgaaatcacctcatgatgtccttaagggatgcacatctctacttccttaggctccagaaacaatggttaccaagttttacatgatttcctttgctctagagctgttttgattagtagctttagttctgtatacttgtttttgttaatggagaaaggtgaacctgcttcatggcttatcttacctttttcctctcattaaggaatggcttctggtttttccgtgttgtgcctggaaaagaaaatgaagtatgtaagttgtagaaagagtaaatggcaatgaaattataacctgaaatcacttttttttttttttttttttttttaagatggagttttgctcttgttgcccaggctggagtgcaatggtgtgatcttggctcaccacaacctccgcctcccaggtgcaagcgattctcctgcctcagcctccttaatagcttggattacagaccacgcctggctaatttttgtatttttagtagagatggggtttcaccatgttagtcaggctggtctcaaactcctgacctcaggtgatctacccgcctcagcctccttaagtgctgggattacaggcgtgagccgctgtccccggcctgaaatcacttatattgtccttctgccgttgcatgcatttttaatttgatggaggtagaacaggttggttgacaattgggtatgagttatgtgtatttcccgtttgctttggtgagtgcagcacataaaattccattgttatgattgtatttgtaaaccttctcactccctagtgtagtgctctaagtctaatcttttttatatccccagggcctaccacatgggagatgttaatcattcaaggattaatattttggggaacttgaagtcgctgtatgtttgtctttggttttctcaagttccaagttgcctgcagcttccatatcaagagttacttctggcaaactctaatgatagtttcttctgtagggtaaagagaatagctcatctggcattaaggctgagaatgaggcttagtgcctcccaggaggaaggaggatgacttggaagtagacgtgtcatccctttcagtcctggtggattgtgggcagcggggggacagaggtagggaaaacagattgtgagaaatatgtgttctgatctttcttggctggctaaagttctagggttagggtggggatgttaaatgggttgaggggacggtcagcagtagaaggccttttgctctgctccttatgtggaatcttgagaggagatgttatgcaggttagtgataggccaacacgggcctatagcacagcagtggtagaaggaagtggctagatagttgagtttgtggtaccaggggattctgaaatgctctcataccactgtgaaggaggtggaggagcttattggcctggtggaacagctggcgtcatgacaaaagactgtgtgactatagactgaatgtcaggatcacagactccagggatgagagccagcatgacatcctaaaagatgagatgggaccagttcagccataggacctgattacctccttgcagcagagaccagtgaggatccagagaaacaacacagatccaaggtcttcttgccactatttcttctaggatgtccgataagaccttggagggaaatctacccgaaagcagccatttaaaccagcccgggtaaggagttaaacaaagtctgagtattaactggaagagattgagatattgtttgacaagttttaaatttcctggatatttattagagtagatattcatgaggaatattagattaattatagaaaaaatggcgcatattcaggagacagattagatgagttatagaagataaagcaggctgggcatggtggctcatgcctgtagtcccagcactttgggaggtcgaggcaggtggatcgcttgagcccataagttcaagatgagcctgtgcgacatggcaaaaccctgtctctactaaaaatacaaataattacctgggtgcatgcctgtagtcccagctactcagaaggctgaggtgggagaatcaattgagcccaggaggtggaggttgcagtgagtggtgatcacgccactgcactccagcctgggtgacagagtgagaccctgtctcaaaaaaaaagaaaaaaaaaaaggcagctgcatttgagttgcagtgtgagtaaatgtgaccaggcaataaagggtaataactcactgtgtttggtgagatgatggaatgtctcttggccaaggactgaacctggggtggagatggaagggaacatcttcatatatgagggtaagaagaagaggtgccagaaaaggcaacagcagtggtgattgaaaagtttaaggaccgctagggaagtggttgctaagtgactcagccttaggagagattggaaatagtcttctaggagagaagcataaattgcctcgtgaaatgtaggattgttgaaaagtgctgagggtctacttaaaacttgtgtttgtttatttaaagtgggaacagttagttgggtcatgtttcctttctctcccaattgccagctgcttggctatgagaactggatttacctaggattgctaggttagcatgatggacggagagaggggacgggaagttgaagttgtaggcaagggagggtgtaattgtggatcatggtttctcaggtagggaatgaggtcgtaaggaaggtgatggccagtgaaatgtggccgaatcaatggattagaggtcctcatgtggtcagagaaatggtgagtggtcagataatgggttgacttgatatgtacatgcttagaagtagtgtgtgtcttgatacaacaggtacggggtgtggcagaatgtggccaaggtagggagtaagaaaagatttttggtcaggaaacccaaaggctgaggttagttgaattatctaaataatgaagttactaagaatgttagacattggcatgaatagtttcagcaaaggcagaattctcacattggctaaaataacccaaggtttaagggtcagtagagtagaagaggctagtggagacaaggaagcacttacctctgtgaaaataatgtaaaaagacgttactgggtttacggctgattttgtaaaatatggttagcaccaggcgtaagtgaattgctgcagtgttacagactcttccttggaggccctgaaggtcaagcaactagcaaaatcatttcaaagagcagaaccttgaacgatggcttgaagtaggatttgcaacttcctgggcagtggctaatgggtctaggatttgaaataaggtggaagaattgataataatgtggtttgggaaaggactttatggatgtgactacatttttctttttaagtgggagtcataattcctgtttcttctactgcttccttttcttctgtaacgaggtttgggaaagggctttatggctgagccctggtgaaaacatttggtccatgtgaatgccacagcagagggcgttcttaatcagacaggatgacctgctttgtggatagcagtaagttgttcttcagacagcctggtgcttgctcaaaaggctcaagaacagagcaaccatggggacggggatagaggctggtgcctggaactcaacaatacagacttcccctcatgatagccatgtggcttctgctggtacagagtgcccagtttgctgccagtagtaactggtcctgattccccaaatggcaacacatcttcaggaccagccagccaccttgtgtcgggttattatggtagaactttttgtcatggaggagtcagttggaatatcaatttttttcctgtacttggatttgtcttccctgtgtgtaataccaccatctctaagatccactgagaatctttgatagagctgtgatattccccacaaggttgcctctgaccttcccagaaagaattagagcaatgggctaatgcttgtggttttgactgtttatgtttgccgatttcctcattggaagactattggtgggatgtagaccaagtctgccttctatcgaaaaagccaaaaaggctaaataccttctcaacctcccttgcagctagggtgcgggcagtgacctaagttcggtcaatctaagatgctctctgaggactttgaataaaagccagtatcacaaagaagaatggttgagagaatcactctccagcaacaaccagtttcccaaggagcagcagcagcagcagggcccagtgtctgtggtgatggtagtgcagaatccagcattatcaggcaacagaagcgatacagtccccagccccagcccctgctcttaacatactctggcatttaaggcagctggtgttatagaccagtggttctcagaccttttagtctcaggacccctttatccttttacaaattatcaaaatggatttgatagggatttaaaaaacgttattgagagtgctgatgatgttttgtttatgtgggttttatctatttatatttattgcataaaaattaaaactaagttttgaaaatacctatttaaacataaatttaaggcagggcgtggtggctcacacctgtaattccagcactttgggaggccgaggtgggcagatcacatgagcccaggagtttgagaccagcctggccaacgtagcgaaaccccgtctctactaaaaatacaaaaattagccagatgtggtggtgcatgcctgtaatcaagctactttggaggctgaggcaggagaatcgcttgcacctgggaggtggaggctgcagtgagctgagactgcgccactgcactccagcctgggtgacacagtgagaccctgcctccaaaaaatacccaacaacaacaaaacaacaataacaaaaatatatatatgtgtgtgtgtgtgtgtgtgtgtgtatatttgatggtttggttacttaaaaaattgttacatatatgtaaatttattatgttgtaacaattttttaaggaatcaaactatattttctttttttgagatagagtctcgctttgttgcccaggctggagtgcagtggtacaatctcggctcactgcaacctctgcctcctgggttcaagcgattgtcctgcctcagtcccccgaatagctgggactataggcccgtgtgtattttttaaaacaacgaaaatttaatgagaattgcattgctttacatttttttcatgtctctctaaagtctggcttaatcaagtggtggcttacacctgtaatcccagtgctttgttaggacgaggtgggaggatcatttgaggccaggagctcacaaccaccttgggcaacatagggaaacttcatcttgttaaaaaaaaaaacaaaaaattatctgggtgggatggtgtgcacccttgtaatcacagttacttgggaggctgaggtgggaggatcacttgagcctaggaggtcaaggctgcagtgagccatgatcgtgccactggactccagcctggggggtataagcattcagaccgtagcgtctggttcatcttatattttttctttttaagataagcaagtatatatgtgtgttcttttttttttttttttttgagacggagtcttgctctgttgcccaggctaaagtgcagtggtgcgatctcggctcactgccagctccgtctcccaggttcacactattctcctgcctcagcctcccgagtagctgggactacaggcacccgccatcacgcctggctaattttttgtatttttagtagagacagggtttcaccattagccaggatggtctcgatctcctgacctcgtgatccacccgcctcggcctcccaaagtgctgggattacaggcgtgagccactgtgcccggcctatatgtgtgttcttattttccattcttagttttgcacttgcttcattatctttgtgtctactggaaatcactctactatcagttcatggagatcttccttattcgttatagctccataatgctcaattttatgtatccactgtactttctaatttcctatgtgtggatatttaggcaatttccagtattttgcaattgtgcatattgctctaatgaataaccttgcatgtgtgtatttttatattgttgctggtgtatcttcagggtagattcctcaaaatgggatttctgggtcaaggtgtaaatacctatgtggggttgtaccattttgcattcccactaatgatgtatgtgagtacttgtttcccttagctttgcagcctgaacttttgaatttttgctaagcttatgggtgagaagtgggatcttagtatagttttaatttgcatttaaattgcattatgggtgaagttaaacatcttttcatgtgtttaaaggccatatttatatctttttgtgatttgtctgtatttatcttttgctcatttttcttgttttttccttttctttttttttttcctctagagactggggtctccctgtgttacccaggctgtaatgcagtggtttgatcataggtcactgcagccttgaattcctgggctcaagtgatcctccctcctcagcctccagaattttctgagcagctgagaccacaggcgtgcaacatcatacccagctaattaaaagaaaatttttttttagagatgagatctccctaggaggctgtcctcccactcactttgagattcttttgggggttctctgatttgattttacatttaactgtatatgctaccatctgtagcacctcgtagatcaagtttcagatgattttccatttctatctgggagttccccattatctcttaatcagatgtgatgctccctctggtggacaatggagtaaaaagcatacaaatatttttcagaaaggcaacttattttttagccactaaaacactgtctctgagtggtctccttcatgaaccccctttccaaactgttcttagcctctgacatttgccattaactcttattttgaattagaccaaaaaagggcaaacaagttaaattttgtcataaatatctatataaaactcactaatgaaatttacatggtatagtggcttattgatgatgaccatgtttttcacaataagagtcgaaacctatgtttgaaactagtagttttacttggagttggtatgatctggagggaaaattgtgcttgttgatctccttacagtttattactacaagaagattctgtgtaaatgagtttttcccctagtttttgacataataattacttgttagtatagaaaaaataaaggccacttgtgggataaccttgtgttttatatctcattctactatttgaaaagtgaaaatggacagagccattactagttgtttaaatatagtacaatcaagaatgtttcctttttaaagtttacttgttgccagtttactgttttatacacggcctattcatgtttagttttaaacatttaaaagcatttataacagtaggctaatattgatctttttgtttgtttgtttgagacagagtctcactctgtcacccaggctggagtgcagtggtgtgctcctggctcactgcagcctcaacctcctggctgaagtcatcctcctacctcagccttgagtagctgggaccacaggcatgcaccaccatgcccggctaatttttatattttttgtagagatggggtttcaccatgttgcccagcctggtcttgaactcctgggctcaagcaattcacctgcatcggcctcccaaagtgctgggactacaggcatgagctaccgcatctggccaatactgatttttaaaattcattacttgggttgagaattataatgtaagcaagtcctctttttgttgttcttatagcatttgcagcaaaaataaataagagcaaccacaaggggataagatagattgatagactgggcagatttgaatatataaaagttaaaaacatccttatgttaatgaaccatcttataatgaaaaaaatcaagaaactggccaggcgtggtggctcacgcctgtaatcccagcaccttgggaggctgagacgggcagatcacgaggtcaagagatagagaccatcctggccaacatggtgaaatcccatctctactaaaaatacaaaattagccgggcgtggtggtgtgcgcctgtaatcccaaccacttgggaggctgaggcaggagaatcgcttgaacccgggaggcagaggttacggggagttgagatcatgccactgcactccagcctggcgacagagtgagactccatatcaaaacaataacaacaacaacaacaaaaaatcaagaaactgacgaaaatatttcaacataaaaaggaatattattattattattattattttttgaggtgaagtctcactgtcacccaggctggagtacagtggcatgatctgagctcactgcagccttcgcctcccaggttcaagcaattctgccacctaagccgcctacctccgccctctgagtagctgggaccacagatgcgtgccaccacccctggctaattttttttttttatttggtatttttggtagagatggggttttgccatttactcaggctggtcttgatctcctgagctcaagtgatccccctgccttggcctcccaaagtgctgggattacaggtgtgagtcactcgcatggccaaaaagtgtatatttgtaatatgtaaaaattgttcataaactgataagagaaagcaacttacttctgaagtaactaactagttcttgggactttttccctctttgtgtttgtctttgaacagctctcatctttagatttcctttgagaaattcccttgtaactcgttggttctcgacattggctacacattgaaagcactcggggagatttaagaaatgctggtgcatgggtcctgccctcagagattctcatttaatttgtctggagtgtggctggagcatagaccttttttttttttttttttttttttgagacggagtcttgctctgtcacccaggctggagtgcagtggcatgatctcggctcacagcaagctccgcctcccgggttcatgccattctcctgcctcagcctcccgagtagctgggactacaggcgcccgccaccacgcctggctaattttttgtatttttagtagagatggggtttcaccgtgttagccaggatggtctcgatctcctgacctcgtgatccacccgccttggcctcccaaagtgctgggattacaggcgtgagccaccgcgcccggcagagcatagacatttttaatactccccagattattatagagcagtctgggttgacagctcctatctttcttttccatcttcactgactccctgcttctctgtgcctttatatccaagggctaaggtaaaattgccacagctgggattagtccaactgcttataatatctataaataattctgcatgttcagttttaaactggacattgacattagcatgttctgtttacatttaaataattgtcataggtaggacaaacaggaattatgttgaatttttaattggcatggttatgatagatgtttctcacaaatgaatttgagtatataaaaatttaatccttgttagcattttttagctgctgtgtttacgtcttgttagaaagtagatgttaattggaaagatttatgttgtaccaatgatcaagaaaccttgggtagtaggtaacagtttctctgggcagtttaatttttgagtttttgactctaatattggatgctcagttttagtggtgaaaacttaagcatcttacaaaaagacttacttaaaatctatgaatcattggtattttacacatttacctgtggaatttaaaaatatccagatgtctgagcaacatccttaagggtcccataattgtttaaagcttcacaggtaatgctaatgcatagccagagttgagaacctttgggaaaggaataaaaaaaaagtcatgataccagtgaaataagtggtagagataacaactatggaggaataactaattgggaaatgtgcatacattgtttagtagaccattatgactgcagcgaagtgctgtttgtatagatgatagattataagttgggatagcgtctgtgatacagaaggccttgctgaggttaagagattttgaactttattttctaggtacaactcttgaggagcccatagagatttttgggctgcagtatgaggtgcacatggaagatttgtgtaggagtcctgatttgggtgaattttgtgatgagggagagaagtggaaagactggagatgaggattccagttaggagaaaatgtgcgttattctagatgtgaagtgatgaaggcctgagctaggggactggtagagggcctggaaccaaacatgttgaggagttcacccacgttgttgaccgattaaagggcaaggaagcagtgaagggtgagtgctgggttttgagctagaactattggaatagtggtgacagtactgctctgtggtgaagggtgagtgctgggttttgagctggaactattggaatagtggtgacagtactgctctgtggtgaagggtgagtgctgggttttgagctggaactattggaatagtggtgacagtagtgctctgtggtgaagggtgagtgctgggttttgaactattggaatagtggtgatactactgctctgtgaagtcattggtgtgagtgtgatctcccagtagtaagttaggcagcaaaagatagcattgctgaggatcaagcttaagagaaaaagcttctcaggattgggagaccatagaagacctccataaatgggttaatagtgcccctttttggcctagtttttactgcctgggtaagtagggtaagtaagttaatctgagtctcagttttgcctttttgaaatgaaggtattgagtgatttctgacatcctttttaagttttctgcagttttagaaaccatttatgtatttgctacagctgcctcctcctactcctctttctttttatttatttattttttcagagagacaaggtctcactatgttgtccaggctggcctcaaactcctggcctcaagtgatcctcctacctcagcccccctctcctcccccccagtagctaggactacagaccaatgtgcctggccacctcctcctttttttgtaacagctttattgagatataactcatataccataccatttgcctatttaaagtgatataaagtaacattaactttacccttttatttatttaagtgtacccttcggtggcattaagtacatactaatatcaccataatcaactttagaaaattcttatcacccacaaaagaaacaatgtaccttaaggctgtcttccactgtaattaaacagaggaaaacataaggattaaacccttgaattgaggctttaccatgtacctgccttgtgaatttacagggccagttagaaatcccttccagttcaaaccggctccttgcagtgctgacccacgaggtggcagtgtgggaacactaggaaggaaaagggctggaggaatccacctctatatttagaaacaggctgtacacagttaacatctatttgtagtggtacatgtagttgttatccaggcatcctcagaggatcatagattgaaagtctcctagctgaagattttgctaatgcagagtagtggccttacttgttggtcatgtttcctagtcatctaaacctgtgttaaccttcttgcctggtttctatcgtttgttaaatagtgactctttcatcatttaaatgactcttgctgtgtctgggaatcgtctgtctagtctttcagccattttttgtttctcgcttacctttttgccccagtactttcttgggtccctttctaccctatccatcgtttgtcctttttcctcctagtcaggagccatcggcgttctctgagataccggttcttagctttagctgcacactggaatcacctggggagcttggaaaaatcctgatgcctaggctacactcagtactgatcgaatcagagcctttggaggtgggacgcaggcatcattattttttaatctctaattacctactaaatatttttctgtcatcatcttttattcagtctgaaaaacatggactaatttaactagattaaataaaaatatagattttaaatattatagattagatttataatatttcagttggatgctatccactcaagcgatgtatgagtctcaactttttctcttgaattgcctactaacagttttttttattcttacttggaaatgtcacttatattgctttctttcttctattcctactgccaccatcctagaacaggctctagctttagttcctgccgtccagccagggagcacatcggtagttgaacagagttgcgttcagacatgattacagagtggtcttgttttcgttttgatccatcacggtcacagagtggccttgtctgaggtccatgttctgtgaaattgtgtatgttcaacagaaggacaccagtgcctccctgtgagggcctggccagcttggagcaacacctgcctacctgatagtatcggtcagttcctgcagctcctctctagaggaccgatggtatcagccaggggcagctcctctctagagctgtgtcttagttgattatatctgtttgcagatcctccctactgcaatctgttctatgaagtgttgccatattagtagtcttccttaaatatgcctttaatgactgattcttatttctctctcttttttttttttttttatttgagacgaagtttcgctcttgttgccgaggctggagtgcaatggtgcgatctcggctcactgccacctccacctcctgggttcaagcgattctcctgcttcagcctccccgctagctggaattaccggtgtccgctaccatgcttagctaatttttttgtatttttagtacagacggagttttgccatgttggccaggctggtcttgaactcctgaccttaggtaatatgcctgcctcggcctcccagagtgctgggattacaggcgtgatccaccgcgcccggctgacagattcttatttcatcaagcataactagtggtcctttctaatctggcccaactctggccagctttatttcccagtgtatcctgtgttttagtctgactggtctcagtgccttgtgaaccggtcatacttactctcactttggtgctttcccttgtcttatcctctttatgagttatgtgagttggggcaaactacttaacagctctgaactttgttttcttaatcttgaaccctgcctcttcagattatcctcagaattaaaagagataaaacatgtggaagtattttgtgtataacaggtactcatacttaatacgtgttctttccttgctctacttagttctcattgattgatctttttaaaagaccatttatttatttaatttgagacagggtctcactctgttgcccaggctggggtgcagtggcatgatcatggctcactgcagccttgacttcccagactcaaacgatcctcccacctcagcctccagaatagctgggaacacaggtgcctgccactatacctggctaattttttaattgtttgtagaaacagagtctcactgtgttgcccagactgatctcctgggctcaagcagtcctctccccttggcctcccaaagtgctgggagtataggtgtgagccattgagtccagccctcagcgattggtcggtggaatttaggtattattatataatttaggtcttaatttggttattaggttttattagttatttgccctgtggtcttagccttcttgaggacggagaccttgtcttatttttctgtgaatcccaagaccctagttcattgctaagtacacaaggatgttcaataaatgtctcagtgactgaaatttgcaggattatcagagcactctgtctgcagataacatctgagacattttctgagtattttttgaaactgactccttctcttgattattattaccactcttagttggtactactgattatggaagctagtaagattagggtcactggctgaattattagtatcaaatctataattctgtgtagtcaccagaaatagtatgtcacagcgaatgtttataggtggttatttaattcatctatgaaaatgacttaagtcaggcacagtggctcacgcctatactgccagcactttgggaggtcaaggtgagatcacttgagcccagaagctccagaccagcttaggcaacacagcgggaccctgtcctgacaaaaaaaaaaaaaaaaaaaaaggaaaaaattagcaaggtgcggtggtcgtacttctagtcccaggtagttgggaggctgaggcaggaggatcacttgagcctggggggttgaggctgctatgagctgtgattttgtcactccactgggtgacagagcgagactctgtctcaaaaaaaataaagacttcaagctcaaataatgcaaattttaagcataaataacttcatacagtgtactttcagcctctaccttggcttacgtacagcctactacaaacagctgagttgcattttaaatatttaaacagttatttataactttcaatattggccttccacatctctctctctctctgaatgacacaagatattgaagctttctgatctattgatacttttgtttttaatgatgttttagaatgtcagcttctttatttagaatactttgaaatcgctgtcgaatagagcaaatttcctttctgtcctttttctttctccttagttgtttaaccttctgcctcttaaaccctgggcttctgttttctcattcataaaatagggaaatagctacctcgtgatcttcatgaggagtaaatgagacaacacacacaaaagtactaggatagtacctgaaatattgcattgcttctttttcttttattattttttttgagatggagtctcgctctgtcgcccaggctggagtgcagtggcatgatctcggctcactgcaacctcagcctccgcctcccgggttcacgccattctcctgcctcagcctcctgagtagctgggactacaggcgcccgccaccacgcccggctaattttttgtatttttagtagagacggggtgtcaccatgttagccaggatgatctcaatctcttgacctcgtgatccgcccgcctcggcctcccacagtgctgggattacaggtgtgaaccaccgcgcccggcctgcattgcttcttcagaagtgacctaccattcacctccctcagaatgactggggagtgggaggtggagagagagagagaggacttgttaaaaatctggctctcagtgcctctccggagaatatctagtgttttaaggcacagaatctacattcttgccaagctccctgggtgacgctggtactcataaaattttgatacctgtttacctacaggatggagacgcattccttttgcaatctgtcttctgtctactttattggtcttattggcactaaagtttgaggacactagggctaaatccatagtagttttatatgaatatttgcagcagttgtaaataacagcctgcttaaaatctctatttttattttttcttttgagacggagtctcactgtgtcacccaagctggagtgcagtggtgcgatctcggcacactgcaacctctgcctcctgggttcaagctattctcctgcctcagattccccagtacctgagactataggcatgcaccaccacacctggctaattttgtatttttagtggagacagggtttcaccaggttgtcagggctggtcttgaactccagacctcaggtgatctgcccgcctcggcctcccaaagtgggattacaggcatgagccaccacgcccagcctaaatctctgttatttttttctgtgcttagcttggactttttctgagcacccttcactttcttctgtttttgctttttgactgaatttcttgaacttgacctttctgtatcagagatctatagtaatacctttcttctgttagtttcagtcaagatgtacaagtcaagctggcagatgattctagaagtctattttaaaatgcccagacttctttttaatgaaattacctgtgtaataactacctttaatataataatttttcggtcacagatcaaatacatggatttaattgtagtttggagcccaacttttaatgagcaggatttaatgaatgaggcacttgtggaagatcagtttattacgaggtcacatgattcatgtggccaccatgcataggaaatgctaaaagggagggccaggcgtggtggctcacacctgtaatcccagcactttgggaggctgaggcatgcagatcacctgaggttgggagttcgagaccagcctgacaaacatggaggaaccctgtctctactaaaaatacaaaattagccgggcttggtggtgcatgcctgtaatcccagctactggggaggctgaagcaggagaatcacttgaacccaggaggcagaggttgtggtgagctgaggtcgcgtcattgcactccagcctgggcaacaagagtgaaactccatctcaaaaaaaaaaaaaaaagatctgagtggagcctaagttagacactgggcatggttttctgcagtagggtgaaattgcttgtaactatttttcttgtattttgagacttctgtttttttacattttctttctatagatgaacacattctttgattgtctcctggttgtttagggtggtgctcactctttcaggtactcagaacattgtatcttttatcacatttaccaccttgtattttaactttttttttttccagacagagtcttgctctgttgcccaggctggagtgcagtggtgcaatctcggctcactgcaacctccacctcctgggttcaagtgattctcttgccttagcctcctgagtagctgggacgagtagctgggattacaggtgcgcaccaccatgcctggctaatttttgtattttaagtagagatggggtttggctatattggccaggctggtttcaaactcctggcttcaagtgatccactcgcttggcctcccagagtgctgggattacaggcgtgagctaccatgcccaaccatatttcaactatttgaaccagtaattattaaatactttttttacctcctctggaagctcttggatgcaggtattgtgtcttgtaccgtcaatgtctacccattctgactgttcttatttaaacaaaattcttcagtatagttctagaccatattttctattagtataggtgggtaattttatttattttgttgtcttggagaccagtggatcttttgctttccttatatgtccatgggcctacctttttgaacagtgttatgctcctctaagtcttatctcctttctttaaatgttgtatattggagaactataccattgctttgatcatcaatgagaatgagtatgatgagtgaattagtttttttgggggtggtgagattactttttttgaagatcactttttaattagtattattcatctgtttgtctacatggtatactgaaaaataggactgtacttggagaagtaagtcttaggtttgagcgctgcttccatttgctagatttgtgaccttgggcaaatcacttaatctctttgattttcattttcttcatctacagaatgaatgaaatggggttataattcctatctgtgtcataggattttagtgaagagcaaatgacttaatccagagcattatataaatgtgaggtattataatcttcacacttatccctgaaataaatattttagagattaaatatcaattcaagaattggagtggggtttcaatttttcacttttggcctaaaaggtcagaagttcaggtagttattagatgaatatcacctatacttgggtatggaatcttctattattacccattctagaggaatttgaacctgttaatacttatgtcatatctgttaaggagctttgttgtcagatagattctggtccaggttctgatgatgccgtttactaatttcatgaacctgcaaactgactagctaaaccttagttttcccattggtaaaatggggttaacaacaataataaaaacaaccttataagattagttaaaagaacaaatgagataatctatgataaagtgttcagcatccagcgtaaagcctgggatattatatgtgactgataagtaagcagtaatgatacattttactcagtatagaggaggatgatggtcaacacttaaggaatacttgctttctgtcaggaatgagtccatgggctttagtgtgcattatctcatttagtcttgcaaaatcttctgaggtctctctttatattattcctgttttacagataagaaaagtgaagttcagagaagttatatcttgctcaaattatgtagctaattctgtctgcactcagagcccatgatctttattattatttttattattattttgagacagagtgttgctctgttgcccaggctggactgcagtggtgtgatcctagcccactacagctttggactcctgggctcaagcaatctttccacctcagcccaaatagctgggactacaggcacgaaccaccacccccagctatttaaaaaaaattttttttgtagagatgtgggggggggtctcactgtattgcccaggctgggcttgaacacctggcctcaagtgatcctcttgcatcagcctcccaaagtgttggaattataagtgtgagccgccgcatctggctagatctttattattaatgaagcttttcattcctgttggaaacttttcacatgtcaacagtaattatacattctgtgatgctgtgagttcataataaaatgatatttatcttggaaattggaaaaatgtacagacaggattttatctataaaactctggtagtgtgtaactagtgcaatagtttaggtattttggttgaagtgatatgttttcaggtgtaactagtgcagtagtttaggtattttggttgaagtgatgtgttttcaggtgtaactagtgcaatagtttaggtattttggttgaggtgatgtcttttcaggtgtaactagtgcaatagtttaggtattttggttgaagtcatgtgttttcaggtgtaactagtgcagtagtttaggtattttggttgaggcgatgtgttttcaggtgtaactagtgcagtagtttaggtattttggttgaggcgatgtgttttcaggtgtaactagtgcagtagtttaggtattttggttgaggcgatgtgttttcaggtgtaactagtgcagtagtttaggtattttggttgaggcgatgtgttttcaggtgtaactagtgcagtagtttaggtattttggttgaagtgatgtgttttcaggtgtaactagtgcagtagtttaggtattttggttgaagtgatgtgttttcaggtgtaactagtacaatggtttaggtattttggttgaagtgatgtgttttcaggtgtaactagtgcaatggtttaggtattttggttgaagtgatgtgtttttaggtgtaactagtgcaatggtttaggtattttggttgaagtgatgtgtttttaggtgtaactagtgcaatggtttaggtattttggttgaagtgatgtgttttcaggtgtaactagtgcaatggtttaggtattttggttgaagtgatgtgttttcaggtgtaactagtgcaatggtttaggtattttggttgaagtgatgtgttttcaggtgtaactagtgcaatggtttaggtattttggttgaagtgatgtgttttcaggtgtaactagtgcaatggtttaggtattttggttgaagtgatgtgttttcaggtgtaactagtgcagtggtttaggtattttggttgaagtgatgtgttttcaggtgtaactagtgcagtggtttaggtattttggttgaagtgatgtgtttttaggtgtaactagtgcagtggtttaggtattttggttgaagtgatgtgtttttaggtgtaactagtgcagtggtttaggtattttggttgaagtgatgtgtttttaggtgtaactagtgcaatggtttaggtattttggttgaagtgatgtgtttttaggtgtaactagtgcaatggtttaggtattttggttgaagtgatgtgtttttaggtgtaactagtacaatggtttaggtattttggttgaagtgatgtgtttttaggtgtaactagtgcaatggtttaggtattttggttgaagtgatgtgtttttaggtgtaactagtacaatagtttaggtattttggttgaagtgatatgtttttaggtttcacatctaaggagttgggagtggcatctgttacaattgtgaaaaagcaatggtagatttattaaaatatggaacattatttggaattaaccacaaaatgacttggattgtatttagatttgctctccttttattggaaaggtcccaaaaagcagagaggatgagagaggagaaagaatgtgaatgctcattgctggtcatttttttttcctgtgctatgccatcttaattgttcatagctcttctcttttaagaaagcttatgtgagagccacaattgtatcagagaacattattacataattatacagccttccctttcccttaaatggtcctttaaggctttacatctgcaatagagatagcttagtgaatattcttccaaataagtttttttagtttcatttttagattagccttttgtatttgcgtaaaacagtgcttttggtaaatgttgtgtatttaaggggaagaacaggatacttctgggggctgaggtaagtgttttgatgttagtctcaagacatgttttcatgctataaatgataactggagctaaactgatactctgggtgtcttaatggttgttcttttcattgccattttagtatgactcattatgtaatgctctttaatgttttgcttgaattaatgtgaatgttttatgagaatgcctgatttcaaggacttatcaacagcttaactcttaatgttcaggcacatcaattgaaatatacatatcatcgagggggaagtcatcctttacctttaacttggtcacttaaaaaggaacatttttagaggagatcgtctgggtacagtagaaaattagttttgttgttatgaacagtaaatcctttctaagtctgcagctgggctttgtttaggttcaagagaggggcaatgagctcaacctggtgctgtaaggacatatggtctaagtcagaagaaacctgaaatttgggttaactagtttcatccccttgagagatctgcatataactgtagactctggggaatcagaggctccttggtctgcccttgtctgtggagcagtgtttgcctctttctatccccaactgctggtttcccaggatcttgttggacgtttcccctactgagaagtatatggccttgatttccctgtatctgaaactggagcactttgtgttttttatcgtatcttatgtttataaaacatatggaacttgttaccttagttttattggccaaaattatatgtcttttagttcaggggctggcccttctttagaagaaagcacttgactgagattgcctagctgtttatcccgctgtatgtgcagggaggtgtactggcacctctgagtgagagctgtggagagcccaccatgactgctaatctgcagttagggagagggtttgaacttggccctgacgtaggccaggaaaggcgacagagtggctttcgtcaaccattgtaactgtggaaaaaaaaaatctggggtaataccactttgtgccacatgatgcttatgtatgtgatagatgtagacacatgataaatcaatttatatgggggtaagaagtaccaccatctgtaacattgaggatgtatctataacattgaggatcctatcactaaggagcactgctgtggctttctgcatgttgcccttaggtgataaccattagtgtaaagattatatgccctgggctgacccaccattttacctctcatggcaaactgaggatcactttgatgttagaagttacggaatttttttttgcttctgagacagggtctcgctctgttgcccaggctggtgtacagtggcatgatcatggctcactgcaggcttgacctcctgggcttaaatgaccctcctaccttagccttcccagtagctgggactacaggtgtacaccaccattcctggctaattttgtttatttttagtagagaaagggtctcattatgttgcccaggctggtcttgaactccaggactcgagtgatcctcctgctttggcctcccaaagtgctgggattgcaagtgtgagccattacacccagccagaagttatggaatttttttgaacccctgtattaaggttctccagagaaaccagtagagtattgatcgatcgatcgatctctctctctctatatatatatatcttctatggatacacataatcatatatgatcatatatatactcatatcagttcatatatatataatcatatatgatcatatatactcatatatgagtttatatatataattatatatatgatcatatatgaatatgtgtatgtatgtatgtatatatgtatgtgtatatatatatatatggagcctgagaagtcccatgatccgttctctgcaagttagagacccaggaaagtggagtccaatggcctgagaaccaggaggattgatggtttaggtctcagtccaagagcaagagaagactgatgtctcagctcaagtaatcagagagagagagagagaattcaccctttctccattcttttgttctaattgggccctcacaggttggatgatatctactaacatttaaaagggcaatctgctttcctcagttcaccaattcaaatgctatttttttttccagaaaaaccctcatagacacaccaaaaaataatgtttaaccacatatctgggcatcttgtggcccagtcatgtttacatgtgaaatcaaccattacagatctgcagaaggaagatggcatattgaaggtatttggaacagattaattacatctatagtctatgtgtattgctctttctctgttagttattatagaacttgagatctaaagagatcttttggatgggcacagtggctgtaatcccagcactttgggaagccaaggtggacggatcacttgaggccaggagtttgagatcagcctggccaatattgtgataccctgtctctactaaaaatacaaaaaattagctgggtgtggtggcacacgcctgtaatcccagctgcttgagaggctgaggcaggagaatcgcttgaacctgggaggctgaggttgcagtgagccgagattgcaccactgtactccattcagcctgggtgacagagcaagactctgtctcaaaaaagaaaaaaaaaagatcttttgaaaaaaggtaacttggataattgcattgagatttactttcattttgtcagaaggacccaaaatagcatagtggaagggaatgggggattgattactatgttttctatggatactcattgctggtaaaaattatttttgctgtacagtgacattttgtaagggagcagacgtaagagccaccgttgtgtcagataatgtagttatatcttttcccctttctctcggaataggaactagatgtgtctgaatagagaggtgtttgttaatctaaccttctaaggtatttgaaacattttaatatagtaaaaaaaagttgataattatggaaattggttgatgagtacatgagagtgcattatgctttacttctttgtatgttttagtgttttgttacagaaaatgttcaattaaaagtactttaaatacgtgtgacagaaactcacacatggagtctcaggagcccgacttctctttttaaaatgaaagagcctgggtgtgttggctcactcctgtaatcccaacgctttgggaggccaaggcaggaggatcacttgaggccaggatggtcaacatggtgtgagaccctgtctttaaaacaaggcagacacaactctgtgaatgtaaaatggttgcattgtacactttaagtgggttacttttattgtttgcaaattatagctctatgaagctgttataaaaactaaaaagaaattaaaaaaagatccttgaacttcttttagtgatacctaaaaatacacaggctgaatccaaacaagggtcgggggagtagtttctgacccacctgatgctaaacaattttttcagtatttgttgcgatatttaatgtgagactttacatgccactgttgttggtactgaagatacagcagatatttaatgtgagactttacgtgccagccactgttgttggtactgaagatacagcagagaaccacaacagacaaaaatccctgctctgggctgggtgccgtgactcaagcctgtaatcctagcattttgggaggctgaggtgggaggattgcttgagcccaggagttcacgaccagcctgggcaatatattgagaccttggctctacaaaaattttaaaaactagctgagtgtggtggcacacacctgtagttccagctacttgggaggctgaggtgggaggatcacttgagtctaggaggcagaggttgcaatgagctgagattgcgccactgcactccagcgtgggtggcagagcaagaccctgtctcaaaaaaaaaaaaaaaaaaaaaaatcccgctttttgacacatgccaaacacatcacgtgcattttaacacctaatccacaatgcctagcaggatgccagtggcaagatgtaatctcaacaaaagtgtattaaatgaacaacctcgtaaattaagtgctatttttatactcatttggcagttaaagtgactgaggcttaaagaggttacttgacccaggtcacacagctgtgagtgacagagctggatctggaaccaggtcttctagccctcattcctggagtatgaaccatgatcttgtaccagctccaggacagaggacaggtgtaactatatgagcacttaatgcactagctccgggacagaggacaggtttacatatatgagcacttgtgtaccagctccaggacagaggacaggtgtacatatatgagcacttatgtaccagctccaggacagaggacaggtgtgcatatatgagcacttatgtatcagctccaggacagaggacaggtgtacatatatgagcacttatgtatcagctccaggacagaggacaggtgtgcatatatgagcacttatgtaccagctccaggacggaggacaggtgtacatatacgagcacttatgtaccagctccaggacggaggacaggtgtgcatatatgagcacttatgtaccagctccaggacggaggacaggtgtgcatatatgagcacttatgtaccagctccaggacggaggacaggtgtacatatatgagcacttacgtaccagctccagatggaggacaggtgtgcatatatgagcacttacgtaccagctccaggacggaggacaggtgtgcatatatgagcacttacgtaccagctccaggacggaggacagatgtacatatatgagcacttacgtaccagctccaggacagaggacaggtgtgcatatatgagcacttatgtaccagctccaggacagaggacaggtgtgcatatatgagcacttatgtaccagctccaggacagaggacaggtgtgcatatatgagcacctatgtaccagctccaggacagaggacaggtgtgcatatatgagcacttatgtaccagctccaggacagaggacaggtgtgcatatatgagcacttatgtaccagctccaggacagaggacaggtgtgcatatatgagcacttatgtgtgcatagaccagtgctttctcacctcctgactctgttacacagagtatccttagtatttacttctacttttaggtgactgtccaaagatgcagtgaaatctcctatcatttaaagcatcagttgtagaaactcttattgtggtttaggttaggttagttaatttttttaaattgttttggtctttagtcttgatcgtgtcataatgttaggtaaaatgtaactgggtacctagccacatatgttctcagtaggtcctcaacagatgtttgttagtatgaagactgggaggaccttagaagcaaattctctcagtcatctttgcccttatctacatatgtattaatatttcttgggttagctgagactgacttttatgtttatttcctagctagttgatatttaatagttggttgtcttagtaccagtagtgtagacgcaggtggcttttgtgctgcagtagagttataggcttctttaaattacagattcattctgagagtgtgggaaatacttgttacctcagttaagcagtcagtaactccacaggccgtatatggctcacaggagaagccctgggcattggagtctgatagagctggactcaaattctgatttttccagttactaggtgattcaataagttgtgtaaattccatgagctttaattttcccttttataaaaatggttctataatatctattgctgtaactatgtaattgaatttactacatgtaaaacaaagaactatgacatagtaagtttagataaatctgcccgtaggtcacacagtcactaaaggtgaatgtaaacccaggtctgcctaattgcaaagcctgcacctactttcaggtaggtgtgctataaatgatatttcccttctaaacttgtctcaggtagtttctctaggttttcaaaaacagtgttagaatatagtcgtgttaagagatgattttagtatgtatgtgtgtttttttctgacatcatggtacccgttggagaaagctattatagtaattaggtatcagtaagactaaatgttaattttaaaacctaacaaattcattgattatatttatctaagtatcttataaggtgggaaaataggatgcatacacaaagaaaactctgaatagtccttaaaagggagtgtgcaagaaagtttttagaaatagcttgaatttgagaaagagaaatgaggtttaagtttaataggaattaaacattttaattttggtctagattgaaagaagaaaattggtttcaattcacatcagagatgtctttaaatgtcaggtctgaatcatgttgttttcaatagagaagcatgactagttggaacaatttctttctctaatccctcctttaaaaagttgctgagctagagtgttccagagacaagctgtcttttacaggtttttgtgacgtatttgataattgaatagtcaagagttttgtgtcttacttgatgtatttgtttttacatgtaatttttagtcaaatgccaactggaaaagcttgtctgcaaaaaagaaaaagttgttttcttctctgtgtttgtatggggacaggaagaaataggcttttgtccttagactagaaaaataaggacattgaacaaatcaagttctttttagttgggtcttgaattttattgtaaattgaaagtcttcatataggttgaaagcagccccttggttctgtatttgaattgcagatataattgcctctttgcttagattgttaggatctgagttaaatatcacccctttcttgatgcttagttgggtagcagggcaaagtggtttacagtcttgttacttaaaatacagtctgtggaccagcagcatcagtgtaactaaatgattttggaaatgtaaaatctcaggcccagtcttagaccaacttaactcagaatctacattttaacaagatctccaggtgatgtgcatgcctattaaagcccgagaggcatagaggcgtggattggactggcccgtggagccagtttaaatcctgaatctgagacttactaactttgtgacattgggcaagtaatttaacctctgcatctcagtttccttaactgtaaaacagtgacgatgatggtacgtttgcaatgtttagaggagttcgtaggaagtactccattagaattacctagatatttttaaaatatagagtacactgtatactttgatgtgtaattatagaataaaatgtccatattcattagaatgaacattacaatttgttggtaaagtgaaagaaaaatagctttaggatcatatactgtcattatctttctgaactgtatttctatattacctgtcatagaataacaaaatctagatagcttataacctttgctttgagtgtgaataaaatctattttagctattgcttcaaagtaaaaacttggctggacgtggtggctcacgcctgtaatactagcacttttggtggccagggtgggtgaattgcttgagctcaggagtttgagatcagcctgagctaatggtgaaaccctgtctctaccaaaaatatgaaaaattagcctggtgtgttggtgcatgcctgtagtctcagctactcgggaggctgaggcgggaggattgcttgagcctaggaggtggaggttgcagtgagccgagattgtgccactggtctccactctgggcaatacaatgagacagagtcttgctctgtcgctcaggctggagtgcagtggtgtgatctcgactcaatgcaacctctgcctccctggttcaagcgatcctcttgcctcagtttcccgagtagctgggactacaggcacgcgccatcatgcccggctatttttttttgtatttttagtagaggtggtgtttcaccatgttggccaggctggtctcgaattcccgacctcaaatgatccacctacctcagcctcccaaagtgctgtgattacaggtgtgagccatggctgccggccaaaaagtacaaacttttttttttttttttttctgagacagtctctcgctgtgttgcccaggctggaatgcagtggtgggctctcggctcactgcaacctcctcttccgggttcaagcagttctccctcagtctcccaagtagctgggattacaggcgcctgccaccatgcctggctaattttttgtgttttagtcgacaggggtttgatagggatggggttttgccatgttggtcagggtggtcacgaactcctggccacaggtgatccacctacctcagcatctcaaagtgctgggattacagatgtgagccaccgcgcccgaccaagtacaaactttttaatgcgccacaaatcactgtgaggttgtagttggggatttgaccatctttgccaaaagtaccagaggcgacaccctccttaatctgatagcacagataggaccaattttcttagttcttaccagtcctagctacaaggctcaaagccttccccttcctgctacttgacagaatttcctcatacagtagcaacttcttggaaagtgggagggaaggagaaagggagatactggaaagaaagccagagaatgacctgcagacaataccacgccctctgtctcctgtctccccttttccttccataaaccttggagttgctgacctctgcagtaattgttagagtcctattttatatatagtagagattaaaaactcaatccttatattttgtatttctatacatagaatttatttgatgttaataattgtttagtgtcagtttaaaaacaagtagtgaaacctcattactcctgcatttcttttttttttttttttttttttgagaggggagtcttgccctgttgtccaggttggagtgcagtggctcaatcttggcccactgcaacttctgcctcccgggttcaagcgattctcctgcctcagcctcctgagtagctgggactataggcacgtgccaccacgcccagctaattttttgtatttttggtagagacaggatttcaccgtgttagccaggatggtctcgatctcctgatctcatgatccacccgccttggccccgcaaagtgcttgcattaaaggcatgagccaccgcgcccggcccacttctaaatttctataagaactgtttaaaactgaatgcctgtcttatctgtgagggataagactacagacttcaaagtttaggtaaaagctgaaaacactccgatgtagaattagaacattttgaatcctgttccaattaatttatttagatgttaactattagtaagcatgttataggattagattaaaaataaattgttaataacttttggtaggtattatgtatggtgaatttaaatggcctagcagatttttttgttatcttttgaaaattacaatttcagctttattagtgatggagcatttgaaaagtggcttgggtagatggcaacaatcggctgctgcaaaatttggcaacaaagacaaacctcatttggtctcatgggaatgctggacaagtacacctgcaggctttcccctgaggggcagagcatacctctttaaaacttaagtcatggaggagtggtaccccctcgccccaaaaaacaaactctgaagggattgaggcatatgtgttccgcctcttctcttatactgtaataacagtaagtcataataataacaatatgtcataaatggcttttagatcaccagtgcatagctgggtagttgtctgtctgctatggtggtggggggcaattttagcacattaaaaagtgtttttgaaacccaacaaggcctattagaaaatcagtaatattcctagctagaagcaactgaccttataaaataatgtttttagaaaaatggttctgaaacaagcctagagtggtaatttacagagctagtccaaaaacactttcttctctgagatgagcagaatacttagcaaaagtaataaggaatcaaggcattttttttgaatttcaaaatatataacataaaatgaataataacataataaatcaggtttactctaaatatattctgaactcaaactgctgaagtgctatttatctccaagatgtagaaccagttaacttaatagtttctcgtattgccagaacctaagccatgtaaaaagataaactaaaacattaagatacctaccaaatgagggaatgaaaaagattcattaggccgggtgcagtgactcatgcctgtaatcccagcactttgggaggccgaggcaggtggatcacctgaggtcaggagttcaagactagcctggccaacatggtgaaacccagtctctactaaaaatacaaaaatcagctgggtgtggtggcatgtgcctgtaatcccagctacttgggaggctgagcaggagaatcacttgaacccgggaggcacaggttgcagtgagctgagattgctccactgcagtccagcttcagtgacagagtgagactctgtctcaaaaaaaaaaaaaaaaaaaaaagaaatttgagagtaactgcgggagactccctgaaatgaaatagttagatatgattgccttggggagcaggagaaggaagctttttgttttttctgtttgacttttttttggagacaggatcttgctctgtcacccaggctggagtgcagtagtgtgatcatggctcggggtagccttgacctcccgagattaagcgatcctcccctatcagcctccccagtagctgggactacaggcgcatgccagcatgcccagctaagtttttctgttttttgtagggacagggtctcactctgttgcctaggctggtctcaaactcctgtgcccaactgatctgcccgtcttggcctcccaaagtgctggggctacagtcatgagccactatgcccagcctatttgccattttaaccatatggtatatattgctttgattaaaaatttaaaaacaaaataaaattctaatctagcaggtatagcgaaaaacaatgacaacaaaaaacaacatagtaaaaggtgcttccagctattgtagaagcatattccactcattaaattgcaaaaagggctgcctgtcacttttctgttttcttttttttcttcttccacaagatcaaaagcctctgatgatcataattacctatggcacgttctgtatgggtgctaggcgggtggatttgtaggagtgtggtgtgtgtgtttttctgaggccccttgtggcttgtgctggagtgttgcctatttaacctttggttttcatttttccttttttttgttttttttcaacttaaagaacatctggaatcattgaaaaattaaaatcaaatattttggttgaatgcttacatgcttttaatggacttattcagagcataatacatcacaagtaacacctactttaggtttttgttccccaagattggactgattgtcttcactttctatatttgggttgtgcttcctgctaattagcttttaaaagccactgagattaggagccaaatttggtacctgcatagtttttagcctagttaacttaagaagtagtctttctacatttttatcaaacttctttctatgcaaatgtaatgatctatttatagataagatataaagtgttttaatcttactcaggggatccctgatgagcccaaaatgaaatccgagtggaacagtaagcagagcgccagtgcataattgctgtgctagttgaagttttaatcctctcataaaatgtttatctatgctttatatcacattaatttttagatcttcttcactggaaagtttattttgttaccttgcttatatggttgaaattaaagatgacaggttaatgcagtcttattttaaaatatggggccaggcatggtggctcacacctgtaatcccagcactttgggaggccaaggatggggaatcagttgaggccaggattttgagaccaggctgggcaacatggcaagaccctgtctctacaaaaaaacagaattaactgggagtagtggcatgtgcctgtagtccctgctacttaggaggcttaggcaggaggatcacttgagcccaggagttggaggctgcagtgagccatgatcatacagccgcacttcagcctgggggacagcaagaccccatctctaaaaaaataaataaaaattaaaaaaattaaaacatcttttaaaattggtcaaactgcttttaaaaagctttattttggaataattttaaaattacagaaaagttggaagaatagtacagacaacccttacatgccttttatctaagtaaacaaattttaacatttgctctattggctttatcatatttatttatttcctctctatacacaccaccccccacacacaacacacatacataaatattatttatttttcttaactatttgagggtaggctgcatacctaatgtctctttccttaccactttagtgtacatttcctaagaacaaggatattctcttatataaccattctacacttagtcaaatccaaaatacttaacattcacacagtacttttgatctctagttcatttttccaattttgtcgatgttgcaataatgtcctttgttgcatttttttcctttagtccaagatccagtgtaggattttttttgtgtgtatgtatatatatatgcacatacatatgcactatatatatacacacatatgcactgtatatatacacatacatacactatatatatagtgtgtatatatatagtgtgtgtatatatacacaatgtatagtgtgtgtgtatatatatagtgtgtatatatagtgtatgtatgtgtatatattatatatatatatatttttttttttaatttttttttatttttagacagattcttgctctgtctcctaggctggaatgcagtggtgtgatcttgggcactgcaacctccgccttccacgttcaagcgattctcctgcctcggcctcctgagtagctgggattacacgtgtgtgccactacacccagctaattattttttgtatttttagcagagacagggttttgccatgatgaccaggctagtctcgaactcctgacctcaggtgatcctcccgcctcgacctcccaaagtgctgggattacaggcatgagccactgtgtccagctggattatatattaatacatgtagttgtcatgtctctttagtctccattaatctggagtagttcctcagccttttctcatcttttatgatattaatatttttgaagaatgcaagtcagttattttatagaataaaaaaaccgaattagatttgtctgatgttttctcatgattagacttgaatttttcaaccccagccagagtattacataagacagtatttatgtagtgtatgtgtgatactgtgttgttctgaggatatcacaccaggaagcacacaatgtccatctgctcctagttggtgaagttttaatcacttggttaagatacagccttgggtgagtagttactgtttttccccttgtaactaatgagccagtctgtggggagacactttgagaccatgcaaatgtctattcctcgtcagttttttttcctccatagagttaacatctattattgattggttcttacctgaatcattatttatggttccctccacatttatgtctttattttcttctaaggaggagccttaccttctcctctatttatttatgtatctatttattattagtatggactcatgggttcctatttgttccattggttcctatttgttccattattgttcttatttattttgatgctgaaattgtcactgatttgactcatgggagccccttcaagctggcttctgtatttgatctacctccataatttttaggaacactttcttactctctggaatgacaaaatgttccagtccaacaaaatgttccaggcttatgttgtactttgccttctcagcctggtttcagccatttaaaaaatccctttagcttttgttgacatattaacaccatgccttgactgctaggtagtaagatttataataagtttgggcctttttcggccaaggggaattgtggaatggaagaagaccaagattgaagaagtcgttggtgagacctcctctgtttgggaggtgtgtcagatagatgagagtgattgtggaaagcaggtggctaacagcagagaggcctctccagtgagtggccaaggagactggccacatatggcaactctgagttcttcatggcatgtgcttgtcatgctggggatccagaagttctcttttgctctagtgatggaatgtggaggtactgaatgggccagtgggtaggcagtagcctgggtttagcgtgaaaaggctaccatgtacagaggcttaatgactgaaggcacagtcttgttggccaggctggagtacagtggtatgatcatagttcactgtagcctccaactccttggcttaggtgatcctcctgccttagcctcctaagtacctaggactccaggcatgtaccaccatgcccggctaatttttaaagtttttccagtggtaatgtcttgctttgttgtctagtctggtcttaaactcctgaccccaagcaacccttccacctcagcctcccaaaatgttgaattacagacatgagccaccacacccagccctgttaatttttatttgttattattattgttattaattttttttcctttttttggagacagagtctcactctgtcacccaggctggagtgcagtggtgtgatcttggcccactgcaacctctgcctcctgggttcaagtgattctcctgcctcagcctgtcaagtagctgggattacaggcatgtgccaccatacctggctaatttttgtatattttgtggagatggggtttcaccatgttgcccaggctggtcttgaactcctgagcccaagcgatttgcccgcctcaacctcccagagttctgggattacagatgtgagctaccatgtctgaactgtaaatgtttttaaaaaggcatattgaattttgtcaaatgcctttttctgcatctatagaaatgatcatatattttttgtttttcattctgttaatgtgatgtatcatgtttactgatttacttatgttaaaccatctttgcgtccctgggatgaatcccactccatcatggtgaattatcttttttttttttttttaagacagagtcttgttctgttgcccaggctggagtgcagtggtgagatcatggctcactgcaacttccacctcctgggcttaagtgatcctcccaacccagccttctgagtagttgggactacaggcatgtgccaccacgcccgcctaatttttgtaattttagtagaaacggggtttcgccatgttgcccaggctggtcgtgaactcctgggctcaagcgatctgcccaccttggcctctgcaagtactggtgagtgctctttttgatgtgctgctgaatttggtttacaaatattttgttgaggatttttgcctctatgttaatcagggatatttgtctgtaattttcttcttttattgtgtctgtctggttttgctgtcagaataatgctggcttttttgaatgagtttggaagtattccctcctcttccattttttggaatagtttgagaagaattagtactagttctttaattgctttttagagttcagcagtgaagctgtcaggtcctgggctttgctttgatgggagacttttatcttggattgtatgtgttaggaatttatctctttttttatgttattgagttggttgacctatagttgttcataatattacgatccttagtatttccattgtaatagctccttttccatctctgattttctttattcgagtcttccctctttttgtctagctaaaggtttgtcaattttgtgttttttaaaaaaccagctctttgtttcattgatcttttgtattgtttttctagcctccatttcatttatttctgctcttatatttttattatttcccttatatttatgttgggtagttcaagcaaaacaggtagcatcctaaagtatgtgaaatctaattctgtcaaatgatgtgtctctcctgtcctaagtaatagagtcacagcaacttgccattgttttattggtaagtgtattttatttttaaattttatttatttattttttttgagatggagtctcactctgtcgccaaggctggagtgcagtgatgtgatctcagcccactccaacctccacctcctgggctcaagtgattctcctacctcagcctcctaagtagctgcgattacaggcacacgcccccattcccggctaatttttttgtctttttagtagagatgaggttttgccatgatggccagactgattttgaactcctgacctcaagtgatccacctgccttggcctcccaaagtgctgggattacaggcgtgagccactgcgcccagcatttttaaaaaaaaaattttaaaaattattattctttttgagacagggcctcactctgttgcccaggctggagtgcagtggcatgatcatggctcactggagccttgatttcccgggctcaagtgatcctcccccatcagcctcctgagtagctggggctataggcatgtgccaccatgcccagctcatttttagttttaaaatttttattttaggttcagggatacgtgtgcaggttttttatataggtaaactcatgtgatgtgggtttgttgtatagattattttgtcatccacatattaagtctagtatccaacagttatatttcctgatcctctccctccttccaacctccaccctcaaggaggccccagtgtctgttgtccctctttatgtgtccatgtgttctcatcatttagctccccctttaagcaagaacctgcagtatttggttttcttttcctgtgttagtttgctaaggatgatggcctccagctccatccatgttcctgctgaggacatgattttgttctttttatggccgcatgcatagtattccatggtgtataggtacattttctttatgcattctaccattgatgggcatttcagcttttgctattgtgaatagtgctgcagtaaatatacatgtgcatgtgtctttaggttagaatgatttatattctcttgggcatataccaagtaatgggattgctggtcaaatgatagttctgtttttaggtctttgaggaatcaccacactgttttccacaatggttgaactaatttacattcccaccaacagtgtataagtggccaggagcagtggctcacgcctctaatcccagcactttgggaggccaaggcaggtggatcacacgaggccaggagtttgagaccaacctggctaaagtggcaaaaccccatctctactaaaaatacaaaaattagccaggtgttgtggtgcttgcctgtaatcccagctactcagtaggcaggcgcacgagaattgcttgaacccaggaggcaaggttgcagtgagctgagattgtgccactgcactccagcttgggcaacaaagtgagactctgtttcaaaaaaatgaaaaacaaaaaacaagtgtttaagtgttctcttttctccacagccttaccagcatctgttttttatttatttattttttaataatccagatgatttttaatttttttgtagacatatggtctcactatattccccaggctggtgctggtctggtactcctgggcacaagcaattcctgcctcagcctcccaaagtgttgggattacaggcatgagccaccgtgccccgccccgataggtgttcttttaatacttcttctgaacttttcaacttccttcattaatttatgttaattaccagcactgattccctgcatcatcgaggagttattagtggtgtatttggcactagttttagaagtagatgccgctatgttttattcatttacagagtgatggcagctcatagttagtcctacaagtgcattattactgatttgtgaattcgtttatttttcctgaaacaattcaagtctttagaaagagaatccgaattattttgtagaataccatctcctgccatatcccttgggtctgatgaaacagatttgacaagaaaacatcagttggtgtttaggcatttttctctcttttattaattaccatcttgaaggatagtagcatctggaaaacaaaaaaagaggtttagctgagatgcttttgtttgatttatattttatccctgcagtttgtattcctcattttcaaggaatttctttgtttctttttttcttgtcaagtaaagcagtgggagtggcgaaggaacaaagaaatccatagctggttgtgatcaattaattgtaaacacaaggaatttatttcttaaagcaagaagatatattaaatgacaatctcaagtttcccaagtcaagctaaaatcagattatatgacaaaaccctcttctttctttgctttaacacagagaacaaaggaagatgctagtactaataaataaacattaacagatccatgggggaaaaaaagactacacagaaccagttgtactttagtggctaacaatttattgataagtccagactaatcttaacacagtgagccagaaaactgagaatttagaggatgctgtgtggctccaagagtgtttcctcaaccactgtcctacagacacacaaacagtttacctagacaccatcgtggagaggaggggctaaacccttcacatgggtcctggatcccgtgtattttggccttcttggaaacttatgctattgaatattttctgtctttcttgtatacctttttttgagacagggtctgtctctgtcacccaggctggagtgcagtggagcagtcatggctcactgcaacctccgcctcctgggctgaagtgagcctcccacctcagcctcccgagtagctgggatcataggcacatgccaccactcctggctaagtttttaaatttttagtagagatggggttttgccatggtgcctaggttggtcttgaactcctgagctcaagtgatttgcccacctcggcctcccaaagtgctgggtctacaggagtgagccactgcaccaggccttttcttgtgtatctttaaacctttttctctctctactgacacattcccatcagctcttaaacatgctatattgtctttcctcaaaaagaaaacaaagagcaccctctccgtttgccttacacttcttaaggctactgtaccatctcttcttcataaccaaatttctcaaaacctttgttaataaacagagactccagcttcctttgcaggctcatcctcgcctggcatctaaagtgtagattttagacctgtttctgggccatcttttccgtccatatgcctcctctgttgtcttacagagttgcaattacttatataattgttattcttgaaattatatttcagtctaaacagacctttcttttaattccacactcttttttttttttttttttttttgagacggggtctcgccgtctcccaggctggagtgcagtggtgcgatctcggctcactgcaaactccgcctcctgggttcacgccattctcctgcctcagcttcccgagtagctgggactacaggcgcccgccacaacacccagctaatgtttttttttttttttttttttttgtatttttagtagagatggggtttcaccgtgttagccacgatggtctccatctcctgacctcgtgatccgcccgcctcggcctcccaaagtgttgggattacaggcgtgagccaccgtgcctggccccacactcttgtatttaactgtctagttgatatttcaacttagatatctcagaggagctggaaattccacatgtttaaaacagtattctcaatcttcattcttaaatttgcttctctcctaccttccttatttcagtaactagtaccccactgttttgtccttgtgacatcctctctccctctccctgacctgttagcctaataactgcaatcctgttgatttcagcagtagaatgtttctcaaatatacatatatccctgtatctctgctatcatcatcctagttgaaaccatcataccataacctcttgcctaaatttctatcttagtctcctgattcgtcacctggtattcattcttgttcccctcctaccctcctagctactgttctcggttcagggcttcagattgttagcatgcctatgtgtccctccctgcctcatcttgaaccactccttgactttttccttttctcaatctcattgcagtcattcagcaagttcatttcattttccttcctatatcaccaagtttttcttgcattctcctttccatgcctactacacagttcaggcccccagtttctcacctggatgtcatccctgccacagcctcttagatgtgattttgctgtcccctaccatttttttctttctttttttctactcaattaaaatgtattttgttgctttgtttaccagcaaattgtatagtatgtatctcatttcgacctaaaatgtttcttaattctcatttcttatttactaatctgttttttgttagctcatagagtgagctatctaagatttctctgaatcctgatttcttacaacataaaatccaaaatccttagtgtgtttgtgtagccctccagttctgacccttctctcagctccaggctgagtttgtttcagctataccagatggcctgatggtgattcttctgccctccgagcctcggggtcaagggatgcgcccagagatggggtgatctgacatgcagttttgtgggtggtggggtctgtgtgacccttccattgctcaggtgtacaattaccagtggacacagtggcacagtcgggggcctatgacttgaggccaggcccccatggagtcgtgggagaggcaggtccaaggatgggggtaccgctgatcactgtggagcacagttctccagacctctaggcatggggtcctgcagcatccacgggagaattcactatacccagcaggccccgcgagaggatgcactgtacccagcaggccccgcgggaggatgcactgtacccagcaggccccgcgggaggatgcactgtacccagcaggccccgcgggaggatgcactgtacccagcaggcgaattcttcttgccatgcccgtactcacaatgctaggctttccacacctccacacacgtaaaagtgttcagaaaccaaaccttcacctggatgcctcctatcctttgttttagatttcacctcttttgtggaagccttccttgccctccctaccacactagcctggattaggtactctactctgtgttgcactttgcaaattaaattacatttggtttatacgtttgttccttttctaaactgtgagtaccttcatctttatgtctctagaattaggcagacaatcaattaatttagaataaatgagaatgaatacgtgaacacaggtatgccaaaagtgtgtggctctgtgaaaaccagctaatagtggtacttttcctgtgtctgagaaaacaaagtttgcgaatacattttctcaattttaatttttttttttttttttttgagacagagtccagttctgttgcccaggctggagtgcagtggcgcaatcttggctcactgcaagctcagcctcccgggttcatgccattctcctgcctcagccccctcaattttaattttttttttacatattttttcttagcctttagttacctaattctctctagcaaaacaaatagataagtagcaagtatatgtttttgaaaacacatggaaatagattgctgtgctttatatgatttctatttttctatagaaacatgtttatgatgtgattatttttggcactaaaattgttctaagtttttactatggattttaacataataacatgtatataatttggaagtattttatgacttttccagaaatatgtagtgttctgcataatacctggagctacatgtactaggtatttaggaaatattcttgttgactaatttccactttttttcccactaatttccactaatttcagataatttccactatctgataaagatggacagcctttaaactagagaataaacatgcttgaattaattttccttgaaacaaaatcagattattaatacaagaaatcctacaagatgcccaacgcttatttgatgtattgctacattctctttaacttacatttttcagaagttaccttaaacaatttagagtcattttatgcctttaataatatttgagcacagctgtcttctgcctcatggtcttttcttcaggctaacttgtcatggcttgtagccttgtagctgatagatactcttatgatgattggggtttatttagcccagacagcattcattgtaagtgtggtaaaaatgtactaaatttgtacttagctaattaggagtttataataattctgacatgctgaattgaagtttctttgtaatgttcaaggcaaagagaaaaggatttgtttagctaattaaaactataaacaagacggaatgtttaatctacttgaggcaaaccaacaactgttttcaagtacttatgaaatcaacataaactaggaaaacaccaattgaaattattttttattaaaacactaaaggattttctaaggcacagcttttgactgacttcttccttggcatttgttcacattattaggaaataggggcctactggtatttttcaaatcctttgttcatgacccacagtgagatatacatactatattgctattcagtaaaaacacacatgtaactgaaacaaaagctgtagaaaataatatttaatttcttgtgatgcagtattttaattttcttatatttcaaatattaaaaagttcctctcaggacaagtaaattgattttacaaattgatcaagatccacagcttgaaaaaactggactagactgtgcttgagtgcagagaccatgacatattcatctttctgttactaagtgctagagcaggtgctcagtagatatttgaataaattggtaattgagaagaggagtaagaagtgaaatcagagttgtaaaaggaatagatgtttttgacaatgaagttcttggatataataaaggcagtcgaggtaaagcactgtggtacttatggttggtatgaaatttgtttgtttgcaggaaatagaaaccagtgttagctgaagcaaagaagaatatattaaaaggattcagggtatctcacagaaatcaagcgtaggggtgtgtcttgtgatttgggaagggaatgaaactagaaagtggaatgacttcaagagcctaagtgtgttatcttgtgttttttcatccctgcttctttctttgtggctttttttttttttttttttttgggtggcggaatggtttcctctgcagccaaatgacagaagaatcttcagttcacgtgacagtttatttccaaagctcctgattgttttacattttggttccaggctttaatactgtatgtgacttataggtggtagaataaattagtcttttgatatttactgtatgccatgagttagtagtttcaagtcactggtttcagataagatacctgtattagtctgttctcacactgctgtaaaaaactacctgagactgggtaatttatgaagaaaagcagtttaattgactcacagttccgcaggctgtacaggaagcatggctgggaggtctcaggaaactggaagcgaaggagaagggaaatcttaccatgacagagcaggagagagtgaagggggacgtgccacgcactttcaaataacaagatctcacgagaactcttattgcgagaatagcagaacaagagagtgaagggggacgtgccacaaactctcaagtaacaagatctcgcgagaactctgtcaggagaacagcagagcaggagagagtgaatggggacgtgctacacacttttaaataagatctcgcgagaactctatcatgagaacagcagagcaggagccactttcaaataacaagatctcttgaggactctatcacgagaacagcagagcaggagagagtgaagggggacgtgtcacacactttcaaataacaagatctcgcgagaactatcacgagaacagcagagcaggagagagtgaagggggacgtgctacacattttcaaacaacaatatcttgcgagaactctgtaaggagaacagcacggggaagtctgcccccatgattcagtcacccccccatcaggcccctccttcaacacacggggattacaattggatatgagatttgggtggggacacagagctgaaccatatcaacatcctattctacagttcagtatttccagtagctttgttttgcctactgggtcagatgaatacacatagaatatatgcgtgtatgttataatcattacttgcaaaagtgttaattcagcacattttcacatcacatgttcctggcactaggttaggctgcagaatagttacaaagatggatataatgtactgtatttagaatgacttttccggccgggcgcggtggctcacgcctgtaatcccagcactttgggaggctgaggcgggcggatcacgaggtcaggagatccagaccatcctggctaacataatgaaaccccgtctctactaaaaatacaaaaaaaaaaaaaaaaaaaaaaaaaatcagccaggcgcggtggtgggcgcctgtagtcccagctacttgggagactgaggcaggagaatggtgtgaacctgggaggcggaggttgcagtgagccgagatcgcaccactgcactccagcctgggcaacagagcgagactctgtctcaaaaaaaaaaaaaaaaaaaaaaaaaagaatgacttttctacttgaaggttatggccttgttccagcaaagtatatcaagtcatgcacagatgagctatgttgatgatatcacttcagaattagtcttcagtttttccaactctgcttgtcttgtttctcacttttaactctccttttctcatctgagatggaagacctgaatactttgccttttgacctttcttcactttcttggctcactatttatattctacatgtgggctcagtcattattttaatatctgtccttgtagcctgaccctcgggtgcccacagctgtgacctgccatcagggaagtctttattaggcacaacatggagtcctgagcccctcttggacccaagtcagaaaaacaggaaagttggaccagaaaataatgcttgttatcttcaggaaatgaacagacagatgcaggtgataaaatcacatacgttttaaatataacatcataactgtcataactcaagtttgaacaaaatactataggaaagtttatgctagtgactgtcacatagtagggcctccagaaaaacttttggaaagaatcagtagtgaatgaggatgtccatttattctggtgtagttataaatagccttactgaagaggtagcatttgagctatttctgcaggatctgtaaattttggatagtaggtaggcagtggattgggtacttctgctgtacgcacagcttgtataaaagcactaagttgtgaacagatggagaatattgattgtgaatgtagtattgattatgtgggagaatggttggaggtattggttacagccaagttgagaaaggctgtataggccatggtagagaatttggaccttcttttctttttctttttcttttcttttcttttcttttcttttcttttttttttttttttgaggcagagtctcgctctgttgctcaggctggagtgcagtggcacgatctcagctcactgcaccctccgcatcccaggtgcaagtgattctcctgcctcagcctcccgattagctgggattacaggtgcctgccatcatggctggctaattttttgtatttttaatagagacggggtttcaccatgttggccaggctggtctggaactcctgacctcatggaccttattttctaagagtcacctgagagtttccaatagaggagtgatgagggagaagatttattattttattttatgtttttattttttctctattcttacccttgaacattcacctctcgaaagatttattcttctgaaatataactctgtggtcagtgttagcctgaagtggccagagatgatcagtatggacatgaattaagatgctgttttaaaagtctatacaagaaaaggaaaaaaagtctactcaagagatggaaggctccatataaggctgtagaagtgaaagcacaaaggagaacttaaattcgatattctttggggaagtagactttacaggaccattttctttaacctagagccagatttggattagtctggtccattcggtgtactaggtggaatttaataaagctaagccctgggtacaccattcccatccccttgtgtcctccttcataactttgatcttgtgtctgcctgcttaatgataccttagccatgtctccagttttccaaccttgcaatgactccttagacctgattatagatatttgatttctctttggattttggctatcactcaccttctggtcccactcatttgtgggttcttcgcatattaaaacaaagcaggacaaagaaacagtcttatggggaaaatataagttataataaatggtgctaaatgcttcaacagaggcatagacagaatactgtggaagctaggtggaaggactgcctaatgctcctggggtcagttagggcagaggagaaaatgctttagcttggtgttggtggatgagtaggtatgttacatgggaaatttgaggtgcctgtgagatattcaggtggagctgaccagtccaggagatggctggagtgatggatctagaaaagcagtgggtctcgaccttgtgtgcctattagggaaactaaacaacaaattcatgccttggtcctattcgtagagatactgatttaatttatatgacacagggacacagtttggtatgtcttaaaatcgactgaggtaatgctaatgtgaagccagggttgacaatcggagcaactcaagagagagatattcctggagaaggtagagataggtgatagctgaaggcttagatatatatcagcttagaaacagggagaatgagaagaaaattgggccagagacaaattcctttgggattaccaacattgtggtaggtaccaaggaggtggccagcaaagaacctgcaaacataattcctactcttaattgtactgttttaatataggttattgatgtatttttgcatagtttttccctgctatgactcagagtggatatcagctatcaggatatactttaagtgcctgattcacgtatctgttgttgattgacagactgatgcaaccgataaacattaattcttttatcattgatgtagaaaatcatgacctttaattcatatcagcagcaaatacctatatctgcctccaagtttatttaaaggaatgcatgaaagtaataatttccaagaatccttttcagaattcaaagtcacctgtcatttttgccataaattctttgaggcatgaaatagcctgccagttgtctattgctctcaaagttaatgaatggttatcaatttatcatgggtaataacctagctgcaaattgtaaagaacgcattctatcactttctagcatttttgcctcaaggcagtatctggcttttctatagtatctggcttttctatagcatttggaggctcagtgtccctaaagcttttaatagaactcatttctttctaggaaacctcttaacatttggtaatagctcaatgaaatattagctggttatatcttgctttgtgtaatagattttgtgtaaataaaatttctcaatgtaggactggaaatacaatttcttgatgtacattcaatccagtatagcatgacggttttagagatatttcatttttatttccaattcatattccattcagttcttataagcaaatgtggtggttttccaattctctatcttcctggttaggtagttaatgattggaaaacaggactgtttcaaggaactttatttttaaaggaatactttttctctccctacaaagtgagaaattctctataacatgagctctttcagatcagggacttggacttgactgtgtctttatttaaaaaaacaaacaaaaaatgctgggtctatgtcttattaaatttagcatttcaggcactgagcacagcatcataactcagtaaatatttgctgaattaatgtgaattatcaccctacatcttcagttataaatttgttgtattgtagagtgggttatctaagggatgggaggacattgatttaacccaatatgtggcttttattacagtactataaatagaggtgactacagagctcaatgtgcctattttcagtcacaaacttgatttcagtcccagttttttcattgttaaacagctgcccttagagcttgcatccagtcctgttgctttatataagaaatctttgagtatttttatgtgtttccttttgactcattcagtaaaagcctagcacagtgacttgttaaattaactctggttactgaaattaattagtgaatatgttttaatgaaataggatgataaacattgctgacgtttgaggctttagtgtgtttttaataatccctcatcagttattactactgccgtggattatttgcctgtgtacattttatagtcctccaaatcttttcagcttctaaaagttggaagaaataaaattctattctgattgattgctccttagatttttattcctgtaatatatatgggaactcagagagaaattctcccattattagtttgccttatgtatttcttttcatgtattgctttgtattctcttcatgtttgtttctccaagcatataataaatatttctcttgatggaatcatacctcacattttattttgactgctgcagagttgtgcccatagtagcaactccataagtaatggttgcctggttgcttgactgactgactgattatggtgctaatggtgacggttaaagcatttttccccacctcaatgcatagcagtttctttatggatgcacacctatcccattaaactatttcctacagagaatcttggtttcccatgttaactcatttcatagttgaatgatccttactttttaggggacacttctctgaatgtttattcaggatttctcttttttgcattgtgaacaatttcttcacgtattacctaatctgatttgactgggcattaactgccaaccttaggccttaaagtggaataggagccgactagaagatccacttgttccatcagatcctcacccaacttcagtgctttattagtagttaaaatgtggactgttgtaaggtgtagtagagatttactaacagtttgcagaaaagtgtttctgtatcatgaccgtgctcttgggctggtaatagaaggtattaaatttgttaagggttggcctaaaagattgggcataattgggttagctgacaaagctcaagtgtattgcatacacctgatccaggtaggtggcgaaacggtgggcctttttaaggctggtttgctttcaaccctgtggcttttacttaggtgcctgaggagcattttaagtcagttcataccttttgaatacctcgcttttggtaaatttggagtttatgttcactgataaaccagcagggttgtaattttttattcaaataggaactatctacttatttttatttctagttattttaccttttttgtcagtagtgtaaatagcatctttttatagtatattttctaagtttttattgtttacatatagaagcatcgtagttttatgtgattttgtaatccaccactgtactaaattctcacttataacaatgtttcaacttttttctcccttgaattttgcaaatgtgtcatatcatctgcatatatggatacttccgcctccttcagtccgatatcgtgtttcatatagcatagtggtgagaagcaccggctctggaactatgactgcttgtgtgttaagcctgtttctactaacttgctagctatgtgactttgcgcaagctacttatgttctctgtgccttgctctctccctctgtaaaatgagataataatagtactgccttattattatgacgattatatgaattaaatgatttagtatttgtaaagtgttcagaacagtatctgacatatagtaagcactgtaaaaatgtgtggtaaataaataaaactcacataagattttttttcccttgcattggctagtatggtacttctagatgaatattaatctagaagcccaatggtgggctttctttattcctcccagacttcaacagaaatgcttgtgtgtgtcattgttttagtgtttcagtaatgtttccagtaaaacattagaaagttatagactgatatgaaatgtatttttccattatgttaaggaaatagtcatctattgctattttgctaagcgttaaaatcaggaacggtttaaaaatttcatcatgtctatttggcatctacttagatggtcatataacttttcttttttgacctacttatatggttgcttgtatgagtagagttcctaatagtgaactctcctggaatcactggagtaaacagttgtgcctatagcctatccttcatttagtgcatttatgagttctcattgctattacttttaaagtttttgcaccaatatttataaatgagtcttttttttccgtttcttttttgaaacggagtcttggtttgtggcccaggctggaggtgcgaactctgtccactgcaacttccacctcccaaacgagttcaaacgattctcgtgcctcagcctccccagtagctggtagtacaggtgcacaacaccacccataatttttgtatttttaggagagacaaggttctgccatgttggccaagctggtctcgaactcctagcctcaagtcatccacccatcttggcctcccaaagtgctagaattacaggtgtgagccaccgcccctggcccgcaagtgagatttgacagtaatttttaatgtgttcgttgtcaggttttggtgtcactgtgtgatgctgtaagtatttgacagtttccttcctttttctatattttagaaaagtttaggtttagtgatctattcttttaaaatttaaaagaatgttaaattagaataggaagtgagagatttagtcctgctgtcttaatttcacagatgaagaaacagtggcttctttacagccacttcatgtcagctacttggggtaagcagttgcggttgtgctacggaggtgaggaaataacatttattgagcatttatgtaggcatttaaaaaaacagtatatttttgatgtacttgttagatttgggttttgcttatttgatatctaaagttaaagtaaaaaaattttattgactaaaaaaaactactttttagagtagttttaactacatagcaaaattgagtgcgtagcacagagagttcgcatagaccctcttcctctacacatgcacagcctcccctacaatggacaccccccgccagaatggcacgtttgttgcaaccgatcaccttctactcatgacattatcacccaaagtgaatagtttacattagcgttcacccttggtgttgtaaatcctatgggttttgacatatgtgtaatgacatgtatccaccatcatcatatcatagagtaatttccctgccccctgaatcccctgtgccctacatattcatcccttccctccccagctcctggtcatcactgatccttttactgtctctatagttttgccttttcctaaatgtcatacagttggaatcgtatagtgtgtagccttttcacattggcttctttcgcttagtaatattcacttaagtttcctccgtgtcttttcagagcttgatagctcatttatttttagtgcagaataatatttcattgtttataaaatgctgttggttttgaatggctgaatgtctttcccgaagataacttagtcaccttttaatcccagaatcttgtcagtcagctaacagatatttattgaaggccagcaaagtgctttgccattctcctaaaccctgaggagacagcagtgatcaacacagacaagagctgtgtctgtccttctggagcctggcataatttccaggaccggcaggcacctgctgaatgtttgtggttgaagtatgttagtttgtgacccaccattgggagattctttgtctttagggaatttccaaatgtggtaatatgcatttatttacactaggtggtggtagagtcatgtacactgaacagttggcaccttaattaagtcactaattgtttgcttataaatatagttcacttcataatgattaaaatttaaatacgtttatattaattcactggaatgtaatcattaattaaaatgtgaacttgtagtacatctttcagaataaatcccaataagtagactttctcaaattcttcagtttgcttcctttgtttaataatcacgcatttactgagattcagttacatgctaggcattgtgccagcgtggaggattcagtgtcgaatatgattcctttttgtccttgagatgtcacagtttagtgagggagacagaaatgagactagatccattaagtgcagtggaatgcctatgtcttaagtataccattcgatgaattccgacaaatgcatacacctgtgtaacccaaatctttatgaaattatagatcactgccatcttggggtgggcatttttcagggccgtgtgcagctgagtaagcaaaagaagcaggttgagagaagaacaacggaggtgatcaaatcaagcatttcctgagagagcagcctgatttattgagttatttatcagttgaaactcagtctttgggagtctgggatgtccctatagttctgttgatgagttttttttttttgagatagagtttcgcttttgttgcccaggctggagtgcaatggtgcgatgtcggctcacctcaacctccgcctcccggaggcgttcaagccattctcctgcctcagcctcctgagtagctgggattacaggcatgtgccgccacgcccggctaattttgtatttttagcagagatggggttgctccatgttggtcaggctggtctcgaactcccgacctcaggtgatctgcccacctcggcctcccaaagtgctgggataataggtgtgagccaccatgcccggcctgttgatgagattttacatgaactagtttgggtcattttctgtcacagtagtcaaaacggtatgccgaagctgcaacactcatcttttagtttctaaagtgagggacttggctctatactcccaataacattacttaaaaacaaacaaaaaaaacctttccacacctaacgtcagcaggttcatactcacaggattaaaggtttcaaagctgaagaacatagcccagtcagagcacctgacttcattgacacttctctgtgtcaggcacggtgtccttttgtgtttattttctcttcttagggcagccctaagcagtgggtgcttattgttcccttcatggagaacatcagtgaggaaatgggcgttcaaagagattctagaacttgcatcaggtaatcgctggagaagtcagatttccaaacacaggtctcacgttcaaagagattatagaacttgcataaggtaatcgctggagaagtcagatttccaaacccaggtcttcctggctccaaagcaggtccctcctgccccatatcacactgtctcagaagaaggaattctaagttaaagagcaaaaacatcacaaaaataactaattgattttattctggttgtggaaataaatgaggtctacccaaatgagtacaatcaaaggctacttattcagagctttctttatatagtaagggaatccaccaccatctattcaatttggtggagattcaaggaagacagaggaatgggaaaacttttgtttattttattttttttctggagataggctcttgctctgttgaccacgtggagtgcaggggcgtgatcatggctcattgcagtctcgacctcccaggctcaagtgactctcccatctcagtcccccctgagtagctggaactacaggcatgtgctaccatgtccagctaatttatttttattttttgtagacactgggtctcactatgtttcccaggctcatcttgaagtcctgggctcaagtgatcttcctgccttgtcttcccaaagtgttgggattacaagtgtgagccactgtgcccagcagggtaaactttagagtggaaaaaagggaaggtttcaggtatgccctgtttgtaggctgttcctgtgggaagctgtaggtgagccaactaaaagcatagcaacctgtgtgattagttaagggtacatttttggctttctctggttggtcctacattggaagcaggagcaaaaattagggaagctgacagttactaatcatttcctggccattttgtccttttttttttttttttttttttttaaaaaaaagagatgagatcttgctgtgttccccaggcatgatcacagatagtgtggctttgtacaaattcttaagggcattgttgggcttcctgggctagttgctagacagtaaccagtctgacttcctagactggttattgtagataataggttggttgcctgggcttgtagctgcaggtcgtgggtcgtagttacctacgatctggcctttgaccatttgtttatttagtctctcagtagatatgttggggatgggtattccctgccaacaaattgattgtataacatattcaaagttctgttttcataggataatgacagttgacttttggaaagggaagagtagaggatgaggagaagagcatttattgaacagcagttttatcttagtctctgtgcgttggttctcaaagcgtggtctccagaatagtggcttcagcatcatgtattgtgatcatgtaagagattatgttattatttttttttgagacggagtctcgctctgtttccctagctggagtgcaatggcgcgatcttggctcaatgccgcctctgccttccgggttcaagcaattctcctgcctcagcctcccgagtagttggcattacaggcatgcgccaccacgcctggctaatttgattatgttattcttaataggaatcatatgccaaaggtcttagggatgagttaaaatgtatgcaacttattttcaaatggatgagcaaaagaacgtacagatacacatatgtagagaggaagcagacgtggaaagttgttaacaaatgttgaatctggggaagggtatattagtgcttgttgtattttgatctcctcacctcttctatttgaaaaaagtgggaggaaagcaattctcttaaaaagctggaagtgaaacagtagagctcagtaatccaagtgatgattacatggcaattaattccccagaggagatggggctgcttctaactgggagaaggtgtagaatgaagaactgactaagcatagagctgacctgcctactgtgatttatggtgtgtgtgtcctgctagctctccttatgtggatacttctgtagactataagactgaaaaagaaatattggaaagacaatcatttcttgtattgagataatcttttaagactggtgagacaacttcaggtgcgtggcctctgaatcagtcagtttctgtctcgtgtatttgtgagagaaacttctggaaattttgttttcaaatgtcaaatatatttcagtattttcatcttgtcataagtttggaattttcctctgaattttatagccaagaatttttctgtcttgaagaagttgattatttgtattacggtaataattttacaagtactcttttctcatagcacattttgttacacagtgttccgaaagttattgggaccagaaatgtaaagtgatacactctacttacttaattacctccccaattcctctgataaaggcaagacattatagatgatcctataattaaatctggtttccgaaggaaatgttataacaatacatttaacattttaatgcagtcttcatttataggatttgagattgctacttgaaagctatatagtttaaaatataaaacttgctctaagttatggtgtgattaaattagataggatgccattttttttttttttttttggagacggagtctggctctgtcaccgaggctggagtgcagtggcacgatctcggctcactgcaaccttcgcctcccgggttcaagcgattctcctgcctcagcctcctgactagctgggattacaggcatgtgctagcatgactggctaattttttgtatctttagtagagacggggtttcatcatgttagccaggatggtgtcgatctcccgaccttgtgatctgcccacctcagcctcccaaagtgctgggattacaggcgtgagccacagcgcccggcctaggatgccatttctaaattaccgtgttcctgcagtaatagacaactccttttaacagtgtcatcagatgcctcaagttacataggttcctaaaattcatccccatatggtacctatttaaatcgtagataagttttaattgaattttagaaatgaaacctgtcatggagatcctgttgcaagctcaaagagctacattaaatgggtttagaaaaacagcacctctaatatctctgatgtggaggttccatttattagagattagtaggttttctctccccggtcacagaatttattggataatatagtggtttcatttttgacattctttgaaagattatgtttttatatatagtaaatggtcatgccttttcttactagataaatagaattatttctagagttgtctttaggacaaatatgataatactttttttatggatatatcattgtgatgtctttgattctctgcttacttgttatttgctacatgtagtgatatattctgcttcacagtttggccagtagtaaaatgagccatgattttgggctctgcttcctcaaaagcactaggagacaatgcagtatcctcttcactatttcaatacttggtctttattttagaggcaattgatatgtttacatccagggtcttctgacttaccttagtagatgggaaagtaaagattaaaaaaacaaccaattctagtgaaggtttaaaagtatgaaatggaattaactgtgtgattttgcatgaacttggtgtgtgggaaattcattagttatgcattcatatggttttcagtcttatcagatgtacagtaatgccttgctttttatgagtttttaagttaattctcttattcccaggttttttttttgttttttttttcctttttggatgtccactcaaaggcaaagctccggtcccatttcagaagtgagagtgtttataagaattaagtctaagtcattcaggcacattaatttcttatctgtactaagctctctcagacaagtggctggaagtcccctccatacttgtacaaattaaattcctaatctcttggtttgcaaaagactgtcttaacagctgtaggggttttctaactcagccctcctaagttcgttttctttgttgttaactgtgttgtatgtttttagaccccgggcatcttaaatgcatttagaaattcagatacagatttgagagtatctataaaaaagcagaattttactagtgctgtttatcccttgggtcaatagtaagaaggacaaattcttatgttctaccttaaactatactctgattggggttacattcatggaaggcaattttagggacataggacaggcctgtagttgaaaatatgtctccattttgcctgagttggcttggtgttcctaaaaaccttcttttcactcatagtctaaactgctggcaaaaatgggcagtgatttacactcaggagagggttttatttgatttattaatttgacagtaaggacaggcttagcaattagattgtttggtggacatattttattaagtaaaactctccctcctaatgttgtgttagcatttattgaatgtttactacatgctacgttttgtgctaagtgccttgtgttatttcatttaatcctcacaacaattcagtgaagtacagatacttaaaacatcatcactgccatcatcaacatcaatagtgctcctgtcttaaagaggagggaacaaagccccaaggagataaagaaatttatttaaagtcacatggctagtaagtagtacaggtggaatccaaaccccagactttctgattccagaatccaagctctgcacccctatgtcaaatttgcgtatcctaaagcttttaccacattgccttgttatctttattctgcttctattcttagaacattatgactgacagcttttgcgttttgtgtgcctggcttccaatgttgagttaagcactctggagctgttttttagattagttgtctttaaagtgggtgtatatatacacttcgggattcatggagacttttcaggaattttgcatgcaaaaatagttttaatggtatttagatgctcaatgtctgcatttgataatttctaatatggttgcctgagagcacctgtggcagagtgagtcttccttcctacctctccattcacaaattgctttcctcccacttgacaaaggcagtcagtcatgcttctgacccagcacaaatcttacaatatttgattgcttcagggagtgtaaatcctctggttcacccactaaagggaccatttaagaattcttaggttctggggctgggcgcgatggctcatgcctgtaatcccagcactttgggaggccgaggcgggtggatcacaaggtcaggagtttgagaccagtctggccaacatggtgaaaccccgtctctaccaaaaatacaaaaattagccaggcgtggtggcacatgcctgtaatcccaactacttgggaggctgaggcagaaaattgcttgaacctgggaggcggaggtttcagtgagcggagatcaagcacctgcactctagcctgggtgacagaacgagactctgtctccaaaaaaaaaaaaaaaattcttaggttctgggtgtgaatttgaagatagcaaagtgatgactgctttggtcaaaatcatagatgtttcctccaggtaacaaacccatggcaggactccataccttatttctttcttttagaatcaagttgattgttgtctgtctgtggtggtgatgggtggtgagggagggtttatagggaaggcagattagcacttttatttgaaatgaaatatgaattttttgacagaaagtaagttttatttgatttattgatttgacagaacaggcttaacaattagattgtttggtggacatatttcattaagtaaaagagtgaaatctacagctgcagggttgcaacaataatatttaagatacgtatataccatactggaaactatatccatgccatcattaaattaacatgtcaacctaaaatgtcagaagagcacaaggtttttcaaaattcttttaggaaatgtacaagtgaaaaaattggtgttaggttcctgtgcccatcttccctgccactacaccagcccaaccctcccttgccccagactggctagcatctctatttgtatgggaaaggagttaggacttatttctttcaagtgttttaaaattagattgttatctacctgaataactttcattacattaatctcaattgctgaatcgcttttctgagaggctgcttcttaatggtgttacatgtatattgattctataggagactgttgccttttgaggagttacattgtagagcttcctaaataaattgagattcagctaatttatagtaatgtccaaccatgtatcaaattccattaggtaagttggtgaatgtaacgctgtacttgcagatggagaaatgtacagtttgaggatcaaactgaaagatattaaatagggtttaacacattagaatcttactccttggtgaaaccagtgttactgattggtaagaggaggttgaggaaaatttcttaggcatgtatatatgtgaaccaaaatgttacttaatgcaaatacataagagagtaaaacaaaacaaaaacaactggaaggaatatacaaaatccaaaataggaagagctaccatacatttttaaatttaaataagaagaatttaaatacagtagagcataaaatctgaagttgggagcctggtgcactgtaagggaagttgctaggcaagaattctggaagggagataagatgccctgaggtggagtgcacagtgtggaagaactaaccgtccttcccagggcacagattcttaccagagtctggctcccaagatcatctatccattccctttttgccttccttcatttcacaaaagctttgaggaagcagtaccagtgtttgcgttaatgggtctgcttcacttattcataaacctctggcctatttcaatactgtgttcaaaatatatatatatttttaaacttaacctccaactggtctccaatttcacatcagtatatttctttatcattagattctttcattttcttattttctgtgtaactacttttactttgttttctcttttcagtagtctttttttattattttatttttttttgagaaggggtttcgctcttatagcccagcctggagtgcagtggtgggatcttggctcattgcgacctctgcctcccaggttcaagcaatttcctgcctcagcctcccgagtagctgggattacaggtgtgcgtcaccacgcccagctgatttttgtatttttagtagaggcggggtttcaccgggttggccaggctggtcttgaactcgtgacctcagcctgcctcggcctcccaaagtgctgggattacaggcgtgagccaccatgcctggcctcaatagtcttttagtgaagacttttccataagggtttattgtttttgtgcctgtgccatacctctaatggattatcacatcattccttccttccctgaagaaaaggtacttcatggtatgactcaagtaacacctccatggtgctcccacagcgcttacacattgtagcacttattatatgatatagttcatggtggtgaataaattgggttcctcagctaagttataaaagccttgagagtgtgtctctattatgtgtgattcttcagtgccttccatagtgccttgcacatgataggcattttctgcttgttgactgaatgaatagatacatgaacatcaaagatagtaaagagaaagaaggtggggcgcgtaagttcacgcctgtagtcccagcaccctgggggcccgaggcgggaggatcacttgaggccaggagttgcagaccagcctggccagcatggtgaaacctcatctctactaaaaacataaaaattagctggacatgctggcatgtgcctgtggtctcggctacttgggaggcagaggcaggagaaccgtttgaacccaggaggtggaggttgtggtgagctgagatggcgccactgcactccaggctggacgacagagtgagactctatctcaagggggaaaaaacaaagaaagaaagaaatataggcattagcccctaaaatgtcagtgaggcattttttgtccttgtttcagtgcctttgttgagccactggaatgctttctgatctcttgaagatttgaaagctccagtgataatccgaaaaggagtgacctggcagtaacaggtaatatcagcttcctggttttaaatttgcctcctcaatatagtgaatggtggtactttcatttcagggttcttttcagtatgaaataagataacttggagtcagtgtaaccacaaattttgcagcgtagttacaaattatgcatttactccataggtgaaatgaccttgaaacaaagacattttggtactttagtaaggaaacgtacacaaatgacgaccaagaaagaactggctcagcgtgaattttacctaccactattactcattagagatcttcctgtaaactcctagtcggttctttcaaagtcttggataaaaagctcctcttcatgtgtctggaatgtgcgtgtacttacgaacggcagggtaagtggggacgcacaaaacagagattaagggtcacctataatttacttctacgtaatgtaaccagattggaggaccatgttgctccccactaacaggtgtgtgtaattcccagtggccttcaaccaagcagtaggcatatatagtcttacacacatggcactgaggttattgttccattcacagagggatttcttcctcttaggaaaatacaaaagacggggtatgccaggacattcagaaagatggtcacagatgcgaaagccccaatccatggagcttggtcattaggaaagggattttgtgaacttgtatctttctgtgaaagctcacagtgctgctgctggttgttttaattaccctttgctactcctatatcatagtaaaaaatgaggctttcctttttagtcacatcgaagatcttcaacatgtttctacatttattttaacgtagtttttatgcccccaaatattttttttcatagatatatacttctagatttggagagagagttcctacatcactagtttctgcctgaaaatacttttataaatttgacttcataattaaaaaaatatactgtcatgattatttagtttgtgatccaaaatatcattagatattgataggtagtttgcatatcagtgtagtgggtgtgacgatatcttcctcacaggctgtttgtgaggatgaaataacttctgcaaagtgctaatgtcgtgcttggcaaacggtaagtactcaatttgtgggaggtatcttttgctaatgttaatttttaatgatatttagtgacatggggcaaataatcacattaagtggtaaaaatagattccaaaatggcatctgaggtcttgaaaaataaaattttctctatctatatattttttgtgtatattggtttaatagtggttgtctttctaggtgatgggattattttcttctttttatttctcatgtagagtaagtcctcactcaacatcatcaatagattgttgtaaacttcaagcaaaatgacttctaacgaaaccgattttaccacaggctaatggatataaacaagagttaagttcctatgacatacttctgatcatagaaatatcatcaaacttataaagaactaaaacacttttttttgagacaaggtctcactctgttacccaggctggagtgcagtggtgcgatcatggctcactgcagccttgacctcccaagcttaagtgatcctcccatcccatcctccctggtagctgggactataggggcacgccaccactcccagctaatttttctgtttttttagtagagatgtggtctcgccacgttgcacgggctggtcttcaactcctgggctcaagtaatccgcccacccccgcctaccagagtacttagtacttctagcacatttattgtgcttctagtgtgagaatatacaactgtcttttttttcttaagagtcagtctcacccattttaagtgtagaattcagtgactgtgagaggagagaagctaaaggcacactaaggaaagaaacaggccccatgctaaaatactttgagggttaccaaaggtgataattgttggtgtgcctatgagcgtttgtctcaggagataaaatgtgctgcttctgttctaaaaaatgggccatgtcattggcctcctgggaagtattttttattgtttccaaggtgaagatacatgagaaggcttctaggcttttacataaagtccacggaaacttgaattgttggactatacagtgaatcctttgaatccatggttttcacatctgtggatgcagccaggcttggattcaaaatatttggactgggtgtggtggtgtttgcctgtagtctcatttcctagggaggctcaaatgggaggattgcttgagcccaggagtttggggccagcctgggcaacatagcaagaccttgtctcttaaaaaaataaaaataaaaaattgggaacccccccccccgaaaataacaatgtggcaataaaaatagtacaaataaaaccaatacagcataacaactatttacatagcatagtcaggggtccccagagcccgggccgaggaccggtaccactcccatggcctgtcaggaaccaggccgcacagtagggagtgagtggcgggtgaacgagcattattgcctgagccctgtctcctgtcagatcagcagcggcattagattctcacgggagcgtgaaccctattgtgaactgtgcatgtgagggatctaggttgcacactagatctcacagtatgagaatcaaagtaatgcctgatgatcggatgattggatgatctgatggtttcatcccaaaaccatccccactccgccccccgccccagcatctgtggaaaagttgtcttccacgaaactggtccctggtgctaaaacggttggggaccactgttatacgtattctagggatgatataaagtatacaagaggatatgcatagtttatatgcaaatactatgccattttatagaagggacttgagcatccatggattttggtatccgtgctgggggccagggagggggttggtgtcctggaatcaatccctggaggatacaagggagggaagagtaccaggaaagtagttcctctggtcctgagttgacttcgtttttcagtgtcttactccacttgtctcttatcattcacccctaagcctgtgctcttgatggttgaaaatttattttactatgtgtgttttatattagaaatctgatcatacgatatatttgcaggaagaaatatataaataagagactactgactagattttgttttcctattgttaacatcatttatattttggcaaaagggagttggatctcatatataaaaattccctctgaacgtttgccagaatcagtatgctgtcattcctagttaaaaagattttcttttttcaaacttaacatgcatctccttttttgcatagcagatgggaaagatcaatgagctgcagtagagaattacagggtttttcccccctctatttgatctttgatcttaaaacagcttttaaccctatagtaatctcccaagagatttgagaaaatattttgtaaaacaaaattatgaggactatgaatacgtaattggtattctcccagcattctgacaaactttaagcaaatgcttttaagaaatcattgtcagctgttatgtgttttttattaggttgaattctcagtataatttatgtccacatgcattattgcatttcagttttgaattttattgttatggaaataatgagagttttcttgatataacaacagctggaaaaaatgacagtgatcaacagtcaaaactctaagttttaagattaaaaattatattagaatattttggaatgctgcttttaagttgatttttcaataaactttaaatttgtttcatagcgttatcttttagcaaacaaattcacgcattaataaaaacaaaattgtgtacagaaaaagcatggcttctaatcttaaaagcaagactaaacacagaaacatctggacaatgacaagttcatgacttttgttttttaacccatcagattgctgaggttatagggcaatcggctagcttgacgtctaagaagagacagatgtagggaaagacatcagcacttgcttacctggggcacccacagctggacactggtaagcattcagctagaatagttaaccaaattgatggatgctgcatgtgggctggcaagaaagtgtgaagaccctgggaactgtggatgaggggagttcatacccacctgtaggctttttctccaaaaactctaccaggtgctcccaaaaagacaggtgagattcctgagaaagcattctttgtctctaggagaagagcagctgctgcagatacagtaagaaactctgaaatcccagcactgtgggaggctgaggtgagtggatcacccgaggtcaggagttcgagaccagcctgaccaacgtggtgaaaccttgtctctaataaatacaaaaaattagctgggtgtggtggcgggtgcctgtaatcccagctacttgggaagctgaggcaggagaatcgcttgaacccgggaggtggaggttgcagtgagccgagattgtgtcactgcacttcagtctgggcgagagtgaaaactctgtctcaaaaaaaaaaaaaaaaaagaaagaaactctggcaggacccttattccctatcgtccttttcccttctactgaatgaaagcagagaaaggacaaaacaatgaccattacctttggggctctggtgaaaaccctttacacctggggaaaatagaagtaatagaagtaaacctgcccttgggggcgggagcatgttgggtcacagattggaggagactaacgaagcaggacatctaaatacatctttaccttgtggaacagaaaaagaacatgatttaggcaagacacctgcctaaataactgatcattactcttcaaaagtatcaagtgtcaaagacaaggaaagacttaggaattatgacagatcggaggagactagggaggcaggaacctagatactttctatgtattactgtggtgatgtcaatgttaagggaagctgagtgaaggggtagatgggaatcctctgtgctattattgtgacttttatgtaagtgtaaaattattttaaaatcaaaggggaaaacattgtaggccccccttttaaactgctgcctgagatagtctataagaacaaagttcttgccttcaattattggagattgaaatttgtaacttttagttcactttaggaaaattaggttctttttttgtttaagtccatgtttccatgaaggaagattaggttctttttcaactttcttctattgttgtatagtttttttttttttcaaataagaaagaatggttcatagtttttctcccgacacatttcatagcctttatattttctctctcaagtgggtgaaggaaatttgaatatgtaactactacccactgaaagcttctggtttaataattttaaaaaaacttgccacctatttccaacccatgttttcattactgacccaggaaatgttgagtaacaactatgtgagaagtactgtgctggaacccgtgatacaaagactattaaggtcagtgtctgccctcgataaaccttcagggaaatgtagcaaaaactctaatagagggaaattcaaatgccacgtgggacattctaattaatgtagcttcatttagcgtgttttgtccagtttccttgtatcttctccttggaattcttggaattcttgtatcttctccttggaattcttggaattcttgtatcttctccttggaattcttggaattcttgtatcttctccttggaattcttctatcatttagagtctcaacgctattactcttcccttattcccccttcctcattcaagctattttggaattctcaggagttcctgatgttttcctaacttagagaaaagcagtggctttgtcctgactgttccttatctagtattacagttactcagaatacctctttgcgtaacacactacccttaccaaagaagcttcagagtctgaatataaagttttcacttaacattttgctgctttgttttgtttattccatggtctcttcatagaataaaacagttaacttatgaaatccgtgaaacctctttggaaaaaaatgtatatacattttgcaataatttcagataatcacaaacacattctttaaaaaaaaataatttcaacttttattttagattcaaggaatacatgtgcaagtttgtggcatgggtatattgtgtaatgctgagatttgaaatagggatgatcctgtcacccaggtagtgagcatagtacccaataatttttcaatccttgcctcctcctttcctcttctcctttaatagtcaccagtgtctattgttgccgtctttatgtccagcagtaccagtgattagctcccacttataagtgtgaactacatgttatttggttttattgttttgcattaatttgcttaggagaatagcctccagctgtttccatgttgccgcaaaggacatgattttgttctttttttatggctaagtattccatggggagcagaatactattccacacacaccccatgttttctttatctaaaccactattgatgtacacctaggttagttccgtgttttttgctattgtgagtagtgctgcaacaaacatatacgtacatgtgtctctttggtagaacaatttcttttcttttggatagatacctactaatggcattgctgggtcaaatggtagctctgtttcaagttctttgagaaatctccaaactgctttccacagtggccgaactaggttacattcccactaacagtggataaacgttcccttttctctgcagcctcgccagcatctgttctgttttgactttttaataaaagccattctgacaggtgtgagatggtatctcattgtggttttgatttgcatttctctgatgattagtgatgtggaacattttttcatgtttgtctgccgcttgtgtgtcttcatttgagaagtgtctattcatatatttgcccattttgtattggggtcatttgttttttgcttgttgaattaagttcattatagattttggatattagacctttgtcggatgacaaatagacaaattcacagtttgtgaatattttctcccattctatatgttgtctgtttactctgttgataatttcttttgctgtgcagatgctctttattttaattaggttccacttgtcaatttttgtttttgttgcaattgcttttgaggacttagtcacacattcttttctaaagctgatgtccagaatggtgtttcctaaaccaatcctttagaagaatggttttcttctaggattcttgtagaatgtggtcttatatttaaatcttatccatcttgacttaatttctgtacatgatgaaaggtagaggtccagttgtattcttctgcatataggtagcctatcccagcaccatttattgactagagggtcctttccccattgcttatttttggtgactttgttaaagatcagatgcctgtgggtgtgcagctttatttctgggttctctgtactccattggtctatgtgtttggttttgtaccagttctatgctgttttggttactgtttggccttatagtatactttgaagttgggtaatgtgatgcctctggctttgttccttttgcttagaatcgcttgggcaatcctttgggctctttttgagttctatattttagaataattttttctaattctgtgaaaaatgatgttggtagtttgataggcatagcgttgaatctgtagattgctttgggcagtatggctattttattttatttattttttcgagacggagccagccttgctgtgtcacccaggctggagtacagtggcacgatcttggcttactgccatctctgcctcctgaattcaagcaattctcccgcctcaacctcttgagtagctgggattacaggcgcgtgccagcatgcctggctaatttttgtatttttagtagagatggggttttaccatgttgtccaggctggtctcaaactcctgacctcaagtgatcctcccaccttggcctcccaaagtgctgggattacaggcgtgagccaccgcgagtgtggccattttagtgatattgattcttctaattcatgagcatggaatgtttttccacttgtttgtgacatctctgatttctttcagcagtgttttgtagttttccttgtagagatcttttacctctttgattagatgtattcctagatattggtgtgtgtgtctattgtaagtgagattgtgatcttaatttgaccctcagcttgaatgttataggggtatagaaatgctgatttttgtataccaattttgtatcctgaaactttactgaagtcatttatcagttccaggagtcttttggcagagtctttagggttttataggtatagaatcatattgtctgcaaagagagagagtttgacttcttttcctgtttggatgccttttatttcttcctcttgcctgattgctctggctaggacttccagaaatgcattcttaagcttatctattgatctaggatagatccattgaacctgctttggccaaaaattaagtatcaacttaaccttgattatttcttatcatattagtaattaatttgagggagtgatcatgataattcaaacactgaaaacttattaaaaaaagctttcggaatgttttgtaatgatgagtgtgactgtgaagtatacagcaagatcactgtaaaatagaaggctgcctttagagtaggaatatgctttagataatagtctgccatcagttaggcagtcaagaccaagcgagcgagtggagtcttacagtctgttacacagagaagtcttccagtatatttaaaactcaacctcacatcgtgaactgaagattttcttttaaagtgaacatgagtaaactcattaaagagaatctcctgctgtttcttgacactgtgcagattacatattttggatttttgataaactttatttcctggatgatctctctttctgggtgccctctaattaacttttataaagcaccaaacaccacctctccacctcctttaaaatctttttgtgagaacaagtggaatgattaactttctaattgatgtatggtggtgtagctatctaaaatactttcattaaagcaacttaattttttaaagatagccaagttaaatatgtaatcactctctagagtaattaaaatgaaagaatggatataattagaaattgtgtttgtctttttataggatgtcacataactgatagttctgctattatgcagtggaaaataaatggttctgatagtttccttggagaaagtgctagagaggtagtactttcacacatgtagtccaatctaagtttggcataattgttagattactcttgtttgtcttatctgcaattattcagtgagatttttaaaaaatacatgtctattgagttgccagactatatacttttttccagagtatagtcagatatgtcggattttaggaatggaatgattttcccaattcctaaaataaataaaagttagagttttttcatggctctttctattataaaatatggaatcctttttaagaaaagaattgagtcaaaatgaaatttgagattgaacttgttgcctagagttaaacagattgttgcagaaatggagagtaatttgtatagcagatatatgtaaagttgctccttttatttatttatttgttttttgagatgggatctcactgtgttgcccaggctggagtgcattggtggcatctcagctcactgcaacttctgcctcctgggttcaagcgattctgctgcctcagcctcccccgagtagctgggactgcaggcgcacaccagcatgcctggctgatttttgtatttttagtagagatagggtttcaccatgttggccaggctggtctcgaactcctggcttcaagccatccacccaccttggcctcccaaagtgctgggactacaggtgtgagccacctcacctggcctaaagttgctccttttagcaagaggtcatacaaaaggtgtggcttatttgcataccttttcatcaaattttgctgagctgtgtatttgctggatttttaattgggttctttttcttaaaaagttagcattgtaattaaagcaaaagatcaatttgtgtgaggtaacaaattagttatgcttgttgaatgtaaaaatcctatgtgtgcgtttattgtttttttcttttttttgattaagatacatatttttgtattggatccagcctattctttgtagatactatttttcttcccttacatttggtgatttttcctgtttatctggttaacttcttagctcaaaagcaatcttttctaagcatccttttctgacctccctgtgtggactaccccatccttgctagtccatgtgtactgctttcagccagctcatcaataatctaaatctcaggggttatgtttcagttcttattctatcttgctgtgaaactggtcagtattaacttctctcttttcttacatactcttttcccacgttcctggttttccttcctcttgttgtgtagtttctgctgctttttctacataagctccttctcttctgctcattccactaatgttgacgttcctcaggtaatttctctgggctcctttgtttttctggcatgtcagatcctcctaagaaaatgtcatttatttcataacttcagttatcatctagtcctgatgacccccagataaaaactcttagcttagatctttctgtggattccatacttatatctgggtggcttctgggcagtttcagtgaaaactccctagatgtcccacaagccccgtaagcccagtgtctgcaaacaactcgttagggattcttctccaacctctctgataatgtcatttctctgcccaagaatgttcagtgtctcttcttgcctaccaaatgtgctggctccaaactatatttctagctttttagtccactctgccacatacggccttcgctctagttcaactcaagtacttgatttctactactgtgatctgaaatacctccatgttatttactcttgcttcttgccttcctctcttaaatagatcctcatttcttacagatgcccaggcagctctgatgttatcttgatgctggaactgtctctgttccagttagtctatattaatctttcctttttctgagcccctgtattttattgatatccatttaacagcattacttcattccgtttcttgtatgattatttagtacttgccagtcatatccttgaggcaggagttaccatttctcgtatgattatttagtacttgccagtcatatccttgaggcaggagttaccgtttctcgtatgattatttagtacttgccagtcatatccttgaggcaggagttaccgtttctcgtatgattatttagtacttgccagtcatatccttgaggcaggagttaccgtttctcgtatgattatttagtacttgccagtcatatccttgaggcaggagttaccgtttctcgtatgattatttagtacttgccagtcatatccttgaggcaggagttaccgtttctcgtatgattatttagtacttgccagtcatatccttgaggcaggagttaccgtttctcgtatgattatttagtacttgccagtcatatccttgaggcaggagttaagacattttcccttgtaggacccagacactgtgcctggcatatggtggatattgcttgtctgacatggtgtttgattgaggggttgaggagtgaggcctctgacgactcttttagttaatatctttcatcttaagttctgggaacacagcagggttgattgctgtttcatttctcagcctgtgtatagagtcatagcctagacttatgtagatatatgtgggaaagcagttatggatttttacaactccagctgatggcacttcatatttttgttttattgtaagatggacgtttcctcctacatttttgacataactgaaattaggatgcgtcctacatttgaaggcctcttaagatgatacttggcagtgctatactgtttttaatggtatctttaataatggcatgtcttacaatccatagcatcttacatttgatgaattttagtaagttataccataaggttatatcttgattccctttcttagagttgtatcacccaagagtatcactggttgcagtggacagtgtggcttctactcaacattctttccaatccagctcattacatggcagttttgcaggtttggtggggtagacttcccttattactgtacctgtggtgggttcccattggcatagataactctgggcaaccttattccctgtctacggtggttggttctgtggtgggaacaatacctgatctgtcctattaaagtgagactcagagcttttgtttggtaggaaggaatgcttgtgctctccccttttatatgagtacagggtagttccaggacccattggcatctataatattcctgacggggagccagactgagctgcaagctagctctggaagagggcagagcagagggaactggagagaaaggagtcacagcctgagaagccatcacgaggcagcagagcatcggcggttaagagcatgggctgtggtgtagattgcatgggtttgaatcagcagttaagagcatgggctgtggtctagattgcgcgggtttgaatcagcagttaagagcatgggctgtggtctagattgcacgggtttgaatcagcagttaagagcatgggctctggtctagattgcacgggtttgaatgccagctctgctactcactaactgtggcatgctgggcaaatgtaatagatgctctctgtacctttagataatttccttatctgtaaaatgaggataacaactctcagaaagttgtggcaaggattaaatagattaatacacacaaaatggagagagcagtacctgacagatagtatttgctgttgttactgttgtcattattatttctaaccaactctgaaacctgcccactatctgggttttcttttctttttaatgcaaatctgtttttttgttatttgcaactgaaaaacaccctaactcttacactggttagttaactctgagactaatttgaattcaacttaaagataagtattaagtaactagtttgacttccttcccactgcatactttacacagtaggttaaaggaactctaaaaatgtgaaaattactattgcatagaccaattttttccaggattgaacaaatcaatccgagggtgtttacaagagctaactgaactaccttccttcccccttactttaacaaataagcactaataatggtactggctgtcaattcctacattgtcaagaggtctaaaatttttttatatttgaacatttcattgagtagataagcagatattttcagttactttcagtcatgtagatatcccccattttcatgtctgtatttggaattcctctgtaataagttaaggatttaagaatcttttaaccttttaagcatacctctaaattctaaattcttcttctgctttactttttttttctcttgagacaagatctcactgtatcacctacgctggagtgcagtgacacagtcatggctcatcgcagcctcaacctcctgggctcaagccatcctcccacctcagcttcctgagcagctgggactataggcatgcctggctgatttttaaaatttttgtagagatggagtctccctgtgttgcccaggctagtcttgaactcctgggctcaagtgatcctcccaccttggcctcccaaagtgttgcgaatacaggcatgagccacgacacctggcctgcttaatctttcttaaatgtatgtatgctcacatttatttttttttattttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactattttaatgtttaatattagaagtcctttaggtctttaagtttggtgatagttctgtgaccagaaatatgtcagaggaacttagaaaactcagtgtgttccaatatgacatttgctttctgtagctagcttctttccttctttgtttacatacctggatggctgaatgatctagtcgccttgcttcttgtctactaacttctctctccttggtagtagttaaaaacacacactttcaaaggagttcagtggtttctaaaattatttttatggtatagtaaataggctctcaaatttacatagagttttattgtttataaaatattttatatatattttctttttaggatttctgtaaagtagagagggcagacattattttatcctgttgtagatgaacaaataatggcttctagttaatgtaatatggtggtgacatatatagaaacatatgattttcctctcagagttaaagtatcaaataatcagcactttactttattaggaagacactaagaatattcccacaaaggttgggaccattgtactggcagtattaacaaaagcacttgacaggaggaaacagttggaggcattgtaattggaaaatgatttctatctgcagctcatatgacattttacttaaaaaaaccctagtaaatcaatgataaaaccttactcaatgaacctcagaaaacattatgctaagtgaaagaagccggacataaaagaccgcatgtcatatgattcgttatgtaaaatatccacaacaggcaaatctatatagacagaaagtagattagtggctgtgtagggctgggaggtcgagatggggtagggatagggagtaactcctaatgggcctaaaggtttctttttggggtgatgaaactgttctaaaattacattgtggtgatggctgtacagctctctaaatatacttcaacccattgaatagtacatttaaaatcagtgaattttatggcatgtaaatgatttctcaataaagtcgttaaaaaatcccaactcagtaaaataactcaatagggtaataggtatgataaaattaacatggaaaaatcaaaagccttcataaatgtaaacaataatgagttagaaggtataaggaaggctggtccaaaggtccaactgagttatctcaattgacttttcagtcagttatagattaaactccttgttctagtctttctccacttgttactactgcgcttgactagtcttaaaaaaaaagagatataatcgaagagaaaaccccatttacaatagcaagaaaaaaagataaaatactcagcaattaaactttaaaaatgtacaaaacttacaggaagaaaactttaaagcactcctgaaaggcccgaaagtagaactgaacaaaactaaaggcatcccttgttcttggacgaaatggcatcattctgaaggatggcattaaagtaatcaaggatttgagtgcaagtagtttattagggagatgatcccaggaagcacctgtaaagagctgagtaagtaagacagaatgaagccactacagggtatgctaatgaacaggccgcaactattggcaactgaagctcaatcccattgggtacttttgtgaagctacatggaatctacctcatagttatcttacctgagggcaaagaagcgggagtatttattcattcactcttgtccagctctggtttctggcctgtctcagcaagctcccagccagtgaacactctcaggcagagagtggctgtggcttactgtagaaagccttaggcatgtaagagaatggtgagtgctgagcttatgttacagtggcgttccaaggatctgtgctgtggagatgtagaagatactccagttacagaccaaactgaggagatggatgtactctgtggtctttgttatctaggttggtgttgtatctccggtaccaggagagctgtggtcgtttctgaatggaaccatatgtgggtgggggtaactttgcggtttctggtgtgtgttgaaaaagttttggggttcctctaccactcaccgcatgtgctttgcccatggtcactcagaagtctggactggcactttggaaagagatctgacctagtcttgctgtgaccagttttacattgagcctggggtttttgccgattaaatagaatcaagtaggataaatggcaacatcaataagataattatttatttttacaaagtaagcaatattattttgctccatttatctccgccaatatgaattctatcatagttagtacttgattactattatcgctatgtaaagtatataagaaattatataaagtataattacatttttgcaagtgggtatgttgatgtgacaactttttgcatgttgataaaaaagctgtagcatatataagataaacataatggttccatgaaccaaagatgataaaacgattttgcaaataactatttgacttaattttctttttacaaatcctcaactgctatttttatttggcgatgtctagtagttcaaaaacttatttgagtgagaagatattatcagtaaactagttggctaattaaagttaattttttaattttgaaaatcatacacagctattttatgacagatggaaaggaaagcaatgtagaatgaccatattacagtaaatcatctgtgaaaacttcaggcagacatttatatcaattagtaaagatgttggttttcagctttattcccaacagatgcactaacacagaccagcttaaatatgttgcttggtaggcatttttcttgccatgttttagtaagtttacttatttatttatttttttaatttatttttgttgtttttgtcctctctttttctgtcttcctttgagtatttattaatattccattttatctcttctgttgacttgttagctatacttgtttgtttgttgttgcttttggtttaaaacatctatctctaactcatcataatctactgtaaaataatataaatttaatatataatgtaagaaccttacaatagtttacttctattctcccctcctattttctgtgctattttatcatgcattttacttgtacgtgttataaaccccacggtacattgttacaacatttctagcactcttcatttctttgtattcatctgtttccagctggtatcctttctctttaacctgaagaacttccttaaaaatttctagctttaggtctgctggtacccaattcttcttgcatttgtctggaatttttgttttgcctttatttttaatgatttttctgctagatatagaattctggcttgactttttgttctgtctttcatcactttaaagatgttccattgtctcctggtttgcactgtttctgggggaaacttctgtggcaaagtttctacagtggtctataagattctacttgttctgaaacttagacttcaacctcattttcttctccctccctcttttaaacaggctgcttacctgctccctattttctcatttattgtctagtctttggggaccactcttctactggatttcttatagtgcaggctatctttttttttatttttttgagataaaatatattgcccagcttagttttaaactcctggcctcaagcaatcctcctgcctcaggctcctgggtagctggggctgcaggtgtgcgtctccacatctgactactttaaaacatttttttagaggtagggtcttgttatgcttcccaggcttgtcttgaactcctggactcaagtgatcccaccatctcatcccctctaggaggtgggattacaggcacaagccactgctcctggttcatgcagaccatcttatgagatggtagtctgtggctgctctctgtgtacttataataccttctgttctgcacttgttttccttctgactctatttttcttttctttttctttttttttttttgagttggagtctcactctattgcccaggctggagtgcagtggcgcgatctcggctcactgcaaccttcgtttcccgggttcaagtgattctcctgcctcagcctcctgagtagctgggattataggcatgcgccaccatgcccggctaatttttgtatttttagaagagacagggtttcaccatgttggtcagactggtctcgaactcctgacctcatgatccgcctgccttggcctcccaaagtgattggaattatatgcctgagccactgcgccgggtcatctcactccattttccttcctaacacttaccactgtgtgatgtatgtgtttgtttattgttttttttcttcttttgaattttagatctaaccagagaattaattttgttattatcctctagaacagtgcctggcacatagtaggggttcagtaaatatttgtggccagaaagaaagaaagacttcagttcattaaagaggtggttgtagaaattctgggagatagagctatcttaaaaaaaaatcataataaatataagagtacttatgagttcattgtttgaaaacattgtaaaccaggtgcagtggctcacgcctgtaatcccagcactttgggaggctcaggcgggtggatcacttgaggtcaggagttcgagaccagcctggctaacgtggcgaaaccccgtctctactaaaaatacaaaaattagctgggcgtggtgggctctggtagtcccagctgctcaggaggctgaggcaggagaatcccttgaacgcaggaggtggaagttgcagtgagctgagatcatgccactgcactccagcctgggtgacagaatgagactctgtctcaaaaaaataaattaaaaaaaaaggcaaacattgtagcctttgtcactaattttccagctgaccccgaggagattatactttctgagtctgataaatgaaggaatgggatcaggcaatatttaaagtcctatccaactataatatatatatttatctatttattctaaacaagatcctaacaaggcctcttccttagttgtctgtgcaaaaatccattttaatcaggttaaatatgtagtagagagattatgtcattttcctatgcaaaaatctttgccctagtattctttgatctgtggcttatcatcaaagggccttcacagtgtcatgctattctgtctccggtattccatgtcaccattccttacttgtgatggttaactgggctaagggatgtctagatagctggtataatattacttttggttgtatctgtgagagtggtccgggaagagatgagcacttgaatgtgcaaactggtaaagatcaccctcatcagtctattgagggcatgagtagaccaaaaaggcagaggaaaggtgaatttgctctctcccttttgagctggcacatccatcttctgctcttggcgctcttggttcaggggcttctgactcagattcagtcccccagctttcgagtgtgttctgttcctcacattgcacttgatgtttggggctttgagctcagcttccctctccctgagcagtagctcagctgtaggcctttctgagctgcttttagacttaatcatctcttctattttactgtttttaattgctttgtattattttcaaatacctctgaattattgtagatggtttttagtctttttctgttttttctttttttagtattttaagtcttataaatattgcctttaatatagacctgggggctctgtgacttacaataaaataatgaaatgacattagaactttcattttaaggtcatcttgtttttttgcttatttctttcatggatttgaaggtcaccttttctattttattttgttacattttactgcctttaatattttacaaaatacagtgggggtcttgagatctttttattaaaattcttttggtaacttttactggtttacagaattagtaatggcactttattttttttttaaaaggatcttgtcaagctatttattctttgttgtaaggtaaataaaagtggtacaactgctttagccttattggtagttttgtgtaatacaatgaaacataatataatgttagtagatattaaagaagcttcttccttaaacatctgttgtttcatcaatatgagacatgctaaatgtaattagtaatttcgattattccttgccagttaatgatgcaaacagtgttgacccttacctatcagataaaaatatacagtgtaaacattagagaagaatagctatttgaggagtttagagtttatttctttataggatattatacttttacaaggctatgtgttgacatatagtaactggactgcctagaaagatctgtcttataaaaatagtcatacttcagcacccagacaaagaaaaaggtaaagttcatcaattactgcattaatccctccaaactgggttggttatctttccagctaatgattttttgccctgctccacggcaatttctcttccctaacctatgctataattttagtgggcactacctttcttgttaacatttccattttaatacttttttgaagatttatcttgaaaggtttttattagtgggcatttgctatattagaacaagccaaagatcagatatttttgggcagttgaatctttcacctgcgtaggaaatcatgccaaatataagactatcttctctgtccattcataaactttctctagataaggtcatgaattcttggaaataaaactgttgttcttcacatattctctccaaactgttaaattatttacaaacgaaccttggatgatgatgatttcagcttgactgaattatcattgactgcagtgggctttaggaagtaggtgcttaatacatgtttattgcgtgctgtgaagtcactgtgcctttaattattttatttacttccaaccccaagctgtaggagcagtctcttgcatgatggagtcagttttctttttgctgtactttcagttcaacttcatcttctaaactcctcatcgagtggtttatgtattagcttcttattgatgctatatcaagtcatgacagactttttttttttttttgagacagtcttgctctgtcgcccaggctggggtgcagtggcacaatctcagctcactgcaacctccacctcctgggttcaagtgattcttctgcctcaccctcccgagtagctgggactacaggcatgtgcgaccacacctggctaatttttatatttttaatagagacggggtttcaccgtgttagccaggatggagaagtctcgatctcctgacctcgtgatccccctgcctcggcctcccgaaattctgggattacaggcatgagccacagctcaagtcgtgacagactttttagctgaaaacagtggtccccaacctttttggcaccagggactggttttgcggaagatagtttttccagggatatagagtgaggggggcggatggtttctagatgaaactattccaccttggatcatcaggtattagattctcataaggagcatgcaacttagatccctgccatgtgcagttcacaatagggttagtggtcctatgagaatccagtgccaccactgactgtgatacgggagtgctgggaagggaagagtgtggtccctttaaatgatgaggaagggggtaagggaagtgctgggtagaggagggcatggtccctggctagggcgctacccccatcgacctaggtgaggacaagcacttctgcctttgcgcccaaatgttgcattttccaagactaccctggtctaccacgcccccatcctgggcctataaaaacccaagaccctagcaaggcacagacagaagcagctggagggtgagaggaacacattggtggaagaagacaagtggccggacatcgggaggacgtggagggtgtcacacgtgtccatgtgaagagaccaccaaacaggctttgtgtgagcaataaagctttttaatcacctgggtgcaggcgggctaagtctgaaaagagagtcagcaaagggtggtgggattatcattagttcttataggtttatcttataggtttatccctataagaacttatctatagttcttatagagataggcggtggagttaggagcaatttttgctagtggggggtggatcttacaaagtacattctcaagtgtggggaggatattacaaaggatattacattctcaagggcggaggaatatcacaaagtccattatcgcaagggcggggagggggtattgtcacaaagtcaattgatcacttagggtggggagggaacaaatcacaatggtgcaatgtcatcggttaaggcaggaactggctattttcagttgttttgtagttcttcagttgcttcaggccatctggatgtatacgtgcaggtcacgggggatatgatggcttaccttgggctcagaggcctgacaaaggggagcacgcaggcagaagagcacagcaacagatgccagcacgctgggaggccgtcggccagcagaacgacgtggagtttggctgggacggttggaggagagcccaggtcaccgagcgcccgactccgggagaaaaccatttcccttctggctcccccatctgctgagagctactttactcaataaaaccttgcacttattctccaagcctacatgtgatctgattcttccagttcaccaaagcaagaaaccccaggatatagaaatccctttgtccttgtgataaggaagggggtctaattgagctgactaacacaagctgcctacagacggctagattaaaagagcaccttgtaacacatgcccactggggcttcaggagctgtaaacatacacctctagacactgccatggggtccgagccccacaacgtgcccatctgtatgctccccctagaggtttgagcagcagggcgctgaagaagcaagccactccctctgtggcagagggggacaagggaacctttactctactttctcttcatgtttcttataagtggaaccatataatatttgtcggtttatccgtcttgtagcatgtggcagaatgtctgttgctttttggtcttagagagtataggtgtgaagataatttttcctccccctctggctctgaaatttgaaagtgctgaaatgacctgacattagactgattaacaggggaagaggcatataaatgtattaatgtgcagaagcacaggggccacacagtatatgagactcagagaactgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcaggtaagaagaacctgttgggctgtaacagaaaggccagatagccacagcttaaatggcactctctttctagcagtcagggagatgggggaatataggcaattttgggggatagtgattttaggagagtttaatggatccaaggagcagacagtagtttgtaaatggttctctttggaaactgaatgggacccacaagttatgggaagttgagggaggaactgtagggtgaacagaggttgttgtattatgcagttgaagtctctcgggtaatgtctcaaagctgccctctgaagaacagacgaacagtctgtctggtcttggcaatgacttattatagattcttttcttctcaggttaatctttcctggtaatttaatgagatttctggggaggaggtttaagagaattgtatttcttaaggaaaaagtttccttagtctgataaggaaattccagagagagcccctctctgtgctttgggagttggagagatacaggagaaggttacagagtccttggttctgaggcagcttctaaggtcttctgtttttttaaaattcggaagtgcccagcatatgaaagcaccatacttcaggatatcattttctgagccccaataatagtcatagtaattttctgctgaaaacgtttgtatgattttcaatgcaaaaatgaattctttattttccccctttactttcattttatatgaccttagtaaaagttttttttttttttttttacttttcccagtggacactgttctaattgtgggcttgttgattcatgctgatgaatagtaatttcttgcaagttattctggcacatagggttcatttttcatgtgatctgcataaaaataatggtggtgaatactaatcaagtaagaatgcagatttgaatactaagcttcaaagaaaaaaacttaattagaacctttaagtcacagtagtggtccctctgcagggaaagtatgctttattagttctgtaatgtaaaacttttttcttgttccaacctataaattgattagtgacaccgcatgggtaagaaattgggagtgggttgggcagaactgctgtctcatatgatgttcttaaggattgtttattattaccagtagcatagtttaaactaaaactatttaccccaggataaaaatttatttgaacagttaaatcaagtttatttctcaaaaaatttatttgtgaatgcattgtactgtatgcaacataggagatattaattacttttaatggcaaaacccacagttccttttgcaccaacctaatacaaagaatataagttctctaagaacttccagtctagtgtacttacgtgtgggagtttctacgtacatgtatgcagttcaaggcataacatacggaaagttaactaacagaattaaacagtgcaaccagaacaccataaaaatgacatcagagtttgagtggcaatagataaataaactatatagactagtggtgctcaatgtttttattttaaatggtataaaaccttttttctctaaatgaaatcttaaactgaaccaaaagagtgaaaaaatggtgaaagccgggcatgatggtgtgtgcctgtagtcctggctacttgggaggctgaggcaggaggatcacttgagcccaatagtttgagtctagcctgggctgagcatagttcactggtctttaaaaaaataagtgagcaaagattatttatttatttatgtaatttttagtgctggaggccagggttctagatctagttctatgaactagctttatgacctgggactatttacctcaactctgggtcaatttccttgttagtacatggactaataatgggattgttgtgaggattaaaaataatggagtagttaaagcatttaaaaacagtctgggacgtggtaagtacgatatacattttatctattattattgctgttatattagaagtggggggtgagcccacaacacttgcctttccctttgcatctctgggtcctaagcctagagaaggtaaatgctgtaactgttcagagaagaaaagatcacttaagctgacatggcagtttttgtagaaaaattgttgacagtgtatctgtgttaacaattccaggggtttgttagttttattatcatgttttggctattatcttcattacagtaatatgaaacagacctagctggaatagctttaaattaaggcagtattttgtgatgggtgctgttctgctcaccaggatttacccaatgtggatgtcaaaaacctggctccagccgggcgcggtggctcacacctgtaatcccaggactttgggaggccgaggcaggtggatcacctgaggtcaggagttcgagactggcctggccaacatggtgaaacgtcgtctctactaaaaatacaaaaattagctgggcctggtggtgtgtgcctgtaattccagctactcagaggctgaggcaggagaatcacttgaactcaggaggcagaggttgctgtgagccgatagcatgccactgcactctggtctgggcgacagagcaagactctatctcaaaaaaaaaaaaaaaaaaccagcaaaaaaaccaaaactggcttcagtttcctggtatgatttacctgaatcagctgtacatttatttttacatatgtatttgtgtgtgtgtgtgcatttatgtgtatatgaatatatatattttacacatatagtatgcagttaaaatatatacgtaaaagccttaaaaataatgacagtgagagtgatttacatgacaccatgcattctaaatctcttgtttcttcctctaggaaactcaaaccttaaccttgtagagaagagacaggctttggttctatgtggaccctcctctgtgtcccatgtggctgatttgggatgtccaatgcttgcttcagggctttgctaacttaccaagataatgttcttagtttttcctttcatattttccaagaaaaatctttaacatttaaaaatgactcttttgatttcctctaatatgtctgtcccatctctcactgctggctttatttgtaaataacagtgggtgatatctcagccctggtggtctctctctaaagactgcattctgttttgcatttggtagctatgtctctctgactgctctaggggtaggaggagcctggattccaaagagaaaatgaattttcaaccaggcacatgtagggatacatttctgtgttgtgctgttatataccacccctctttccacccacagacagaaattttggggaattactttctaatcacttcatattcaatattacattagcccatcaaaagaagatatttaattcgtaaggttaatggttttgttttttcggagttttaatcacttgtggactaaacaaaaatcccactttgatttgctagtgcattgtattaggctgctgttgtgttgctataaagaagtacctgaggctgggcaatttataaagataagaggtttccttggctcacacttctgcagcctgtgtaggaagcatgtgtggcacctggcatctgcttggtttctgatgaggcctctgggagcttacaatcatggtagaaggcaaagcggagctggcccgtcacatggaggaagcaggagctagtgtgtgggggtggggcatcatacactttgaaatgagcgtatcttatcatgagcacagcactgggccacgagagatcctcccccatgacccagacacctccctgcaggccccacctccaaccctggggattacaattcagcgtgagatttggtggggacgtatattcaaactatatcatgcatcctcatgaacatagctattgttaaatcattctgttgggaatagcgctgttgtgatttcctcagtaatctttactgataaaaattagctatttactcattttttgcctggtggattttaattctatccgagagtgccgcctaatgattaagggcataggttctggagtcaggttcctggatttgaatataagctggactatttactgtgtgactttgggcaacctgactttctttctgtgcccaattttctcatttgtaaaatgaagctaaatttggtacctacgtcatagggttattataaagactaaatgagatacttagcacagttcttggtatgaagttagcactaattataattactgtagagtggtagcatgatgtaatagaattagacaaattgggttgtaatcctagcactggttgagggtgagggtggaggtgtctatacatgaccttgagcaaactgtttaacctctctgccttgatttcttcaacctataaattatgggtaaccttccttatcaggtaattaggaagatctggtacataccaacatttaaaaactgctactatattaatctcttctccctttcttcccacttctttttttttttttttttgagacggagtctcactcttgttgctgaggctggagtgcaatggtgcgatctcggctcacagcaacctccgcctcccgagttcaagccattctcctgcatcagcctcccaagtagctgggattacaggcaccggccaccacacccagctaattttttgtacttttagtagagatggagtttcacaatgttggccaggctggtcttgaactcctgacctcatgatccgcctgcctcggctgcccaaagtgtctctccacttcttacttcaatttaagaatgctgcaaattcaggaagctttttagtttactgaaaaaaaaaaatcaggtagtattctttttaacacattaaatagttgtcattcaatatgttttattggaatctatttttttcaatggctgaactatttttagctgaattacagaaacaaatagaaggcattgaaaagagatcaagtattaaagaatgttaaggttttctttctaaaggataattaggcaatgcagttttgtcttcattagaagccaagagggaagaaagtaaagatatgccagctagttcagagaaatgagagagacagcagtcctgtgttcagtcattgattagcatcggcaacaccaggaagagccattcaggctgggagagggctacaggaactactcaaggaattgtgagtttccttacttaactgagtaggtaaagatgctgagaggtttgagatgatttggtagtaacaagccaagatcatagaccttttctgtaggctcttggggatgtgtgagaaaggtagttaacgcaaagcaagttggctcagccagggagaggtgacaaggggaagagacaggatagtggctgctgtaccttaagttttttttttttttttttattatactttaagttttagggtacgtgtgcacaacgtgcaggtttgttacatatgtatacatgtgccatgttagtgtgctgcacccattaactcgtcatttagcattaggtatatatcctaatgctatccctcccccctcccccaaccccacaacagtccctggtgtgtgatgttccccttcctgtgtccatgcgttctcattgttcaattcccacctatgagcgagaacatgcggtgtttggttttttgtccttgggatagattgctgagaatgatggtttccagcttcatccatgtccctacaaagggcatgaactcatccttttttatggctgcatagtattccatggtgtatatgtgccacattttcttaatccagtctatcattgttggacatttggcttcgttccaagtctttgctattgtgaatagtgccacaataaacatatgtgtgcgtgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtacaagtgttcctacttctccacatcctctccagcacctgttgtttcctgactttttaatgattgccattctaactggtgtgagatggtatctcattgtggttttgatttgcatttctctgatggccagtgatgatgagcattttttcatgtgttttttgggtgcataaatgtcttcttttgagaagagcagaactgaaggaaatggagacacaaaaaacccttcaaaaaatcaatgaatccaggagctggttttttgaaaagatcaacaaaattgatagactgctagcaagactaataaagaagaaaagagagaagaatcaaatagatgcaataaaaaataaaggggatatcaccaccgatcccacagaaatacaaactaccatcagagaatactataaacacctctacgcagataaactagaaaatctagaagaaatggataaattgctcgacacatacactctcccaagactaaaccaggaagaagttgaatctctgaatagaccaataacaggctctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcattttatgaggccatcatcatcgtgataccaaagcctggcagagacacaacaaaaaaagagaattttacccaatatccttgatgaacatcgatgcaaaaatcctcaataaaatactggcaaactgaatccagcaatacatcaaaaagcttatctaccatgatcaagtgggcttcatccctgggatgcaaggctggttcaacatacgaaaatcaataaatgtagtccagcatataaacagaaccaaagacaaaaaccacatgattatctcaatagatgcagaaaaggcctttgacaaaattcagcaacacttcatgctaaaaactctcaataaattaggtattgatgggacgtatctcaaaacaataagagctatctatgacaaacccacagccaatatcatactgaatggacaaaaactggaagcattccttttgaaaatgggcaaaagagagggatgccctctctcaccactcctattcaatatagtgttggaaattctggccagggcagtcaggcaggagaagggaataaagggcattcaattaggaaaagaggaagtcaaattgtccctgtttgcagatgacatgattgtatatctagaaaacccgatcatctcagcccaaaatctccttaagctgataagcaacttcagcagtctcaggatacaaaatcaacatgcaaaaatcacaagcatatataccaataacagacaaacagagagccaaatcatgagtgaactcccattcacaattgcttcaaagagaataaaatacctaggaatccaacttacaagggacgtgaaggacctcttcaaggagaactataaaccactgctcaatgaaataaaagaggatacaaagaaatggaagaacattccatgctcatgggtaggaagaatcaatatcatgaaaaaagctatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcaggctacctgacttcaaactatactacaaggctacagtaaccaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacaccttatacaaaaattaattcaagatggattaaagacttacatgtcagacctaaaaccataaaaaccctagaagaaaacctaggcaataccattcaggacataggcatgggcaagacttcatgtctaaaacaccaaaaacaatggcaacaaaagccaaaattgacaaatgggatctaattgaactaaagagcttctgcatagcaaaagaaaccaccatcagaatgaacaggcaacctacagaatgggagaaaatttttgcaacctactcatctgacaaagggctaatatccagaatctacaatgaactcaaacaaatttacaagaaaaaaaaacccatcaaaaagtgggtgaaggatatgaaccttaaggttttatactttaaagacttggctgggtgcggtggctcacgcctgtaatcccaacactttgggagaccgaagcgggcagatcatttgaggtcaggagtttgagaccaacctggccaacatggtgaaaccctgtctctactaaaaatacaaaaattagccaggtgtggtggcaggcacctgtaattccagctactcaggaggctgagacaggagaattgcatgaacctgggaggcagagtttgcagtgaactgagatagcaccactacattccagcctgggtgagagagctagactccatctcaaaaaaaaaaaaaaaaaaaaaaaagacttgcttctgagatagggattaggatggggagaggccagaacttgatggagaactcataaatttcatttttctctctgtttatcagtaattctcattacttatcagtaattccctcaccagaaagctggtgttaaggacatgtagctctgattttcctgtatagtaaaatattgataggaaacagcaacagcttattctgtagaccagttctttcccagagatgccgagcagaggacatcacccctattaagcacaaaacccctttttataaacatgtattttgaaacacacatgcacatgcacgcacacacacacaaatgctatcctgaagggagagtcttagataatatataactatttatatagacagtttcaaaatagcaatataatgacccaatgaaaatataaagaagaaataaatggaaaattatttatcaaatggtgtctattacctgttgtggtcagagtgtttgtgtccttccaaaatttatatgctgtgtgatcttaacccctaaggtgataatattaagaggtggtgcttcggggaggtaattagctcaggaaggcagagtcctcatgaatgggattagcgccctcataaaagaggcccaagggagctgacttccccttctgccaagtgaggacacacagcaacaccatctgtaaatgaagaaacctgccctcaggtttcttcatttacactgaatgagcagtgagctctcagacgctgaatatgcagacgttttgatttttggatttcccagcctcctcaagagtgaatatatatatataatttatttatttatttatttatttattttgagacggagtcttgctgttgcccaggctggagtgcagtggcgtgatctcggctcactgcaacctctgcctcccaggttcaagtgattttcctgcctcagcctcctgagtagctgggattacaggcgcttgccaccactcctggctaatttttgtatttgtagtagagacgaggtttcaccatgttggccaggctggtcttgaactcctgacctcaggtgatccacccgcctctgcttcccaaagtgctgggattacgggcacgagccaccatgtctggccgaaaaatagatttttgttgcatataagccacccaatgtgtggtattctgttatagcagcctcagctgcctaggacattgttttatataaatgttttggcactaggagagcggtcatggcgcagccttactgtgaatgtgcggctctaattggagactgatacagctgtgttgtctttgggattcaaatagcatgaccttatagtctcagatgatgaacaactcctgctaaggttttgaagacaaaagtaccagtttctttcattttacctggtggttgcaatcttagaactatattaaatacactagaacaatatgagaattgctccttatacataatcagcagttacaatctagacctaaattgtctaaagtggacatttgaaaattgtatgtgattgtgacagataatgtgggatataagcacctttgtctccttcagagtgatggtaccccccaattattgtgaaaaccaaactatcctcataaatttccagacctcccagggggcaatgccaacccttctgaatagcagagttttattccatccacatcccccaggggatttagtcagaagacaggacaatgagagctgctgtcatatccaaatcccaagagacttctccttgcctgtcctgccaatctaattaaataaactataataatattaccaggtcgatagcttgggaaaggtgttgtttgtttgttttgaagggaggactgctgcatatcgaagcaattttgcacgatggctgtgatggagcagagattcttcatccatactgcctgcttttggagccagtgacactgtcacttactagctatgtgatcctgcactagttacctaacctctaagtgtctccgttttttcacttgaaaataaataggcacattgagtatctaccttgtaggattgttgtgagaatttattaagctggtacatgtcatgtgctttgaatagtgcctaacacgtagcactatggacacggtgcactgaagagagacttacaagaagagcgaaaaggcaaggacaagctttttaaaggtgagaaaggaaattattaaactacaaggctgaagatgaaacagatcatatgtgttgattttctctcatagtgcatctttaccagagctccgatattttttaatgggcaaaattcaaaaattcagcctcatgcttttcttctccttccttttggcaaggataataatagttaatagctaacaattatagagctcttactctatgccaagcatggtactaatagatttacaaacattgtgtcatttaatttttaaacaaatctatgaggtagatactattagtatccccattttggctgggcgcggtggctcacacctgtagtcccagcgctttgggaagctgaggcaggcagattgcttgagcctgggagttcaagctcctgggcaacatggcaaaacgctgtctctatttaaaaaaaaaaaatcccattttaacctacaggagaatgagagagtttgaataattaacagactgttgcagcgatttaacctacaggagaatgagagagtttgaataattaacagactgttgcagcgattcaggctcaaaccgtctaattctagagtccattcttttttctttctttctttcttttttttttttttttgagacagagtcttgctctgtcgcccaggctggagtgcagtggcgccatctgggctcactgcaagctctgcctcctgggttcacgccattctcctgcctcagcctcccgggtagctgggactacaggcgcccgccaccacgcccggctaattttttttgtatttttagtagagacggggtttcatcgtattagccaggatggtctcgatctcctgacctcgtgatccgcccgcctcggcctcccaaagtgctgggattacagacgtgaaccactgcacctggcctcagagtccattcttttaatcgctgtgcgacagtaaacaatgaaataaaataaagacaccacttaagagaagcctcaaccctggaagcctgtggaccatctcagattaattgtgctgggtgactaatccttgacattttctggctagctctgggattttgatgttcagcatgctggtggcggttttggttttgttttaaaagtggattagtgtctattaaccacaacgtattgtatattttccagtagctagaaaggcagattttgagtgttaccaacacaaataaatgataaatgtttgaggtggtggatatgctactttactctgatttgatcattacacattgtgtatacgtgtaaaaatatcatactgtatggccaggcatggtggctcatccctgtaatcccagaactttgggaggctgaaatgagcagatcacttgagtccaggagtttgagaccagcctgggcaacatgttgaaaccccatctctgcaaaaaatataaaaattagccaggtgtggtcgtgcacacctgtagtcccagctacttgggaggctgaggtgggaggatgacttgagtctgggaggttgaggttgtagtgagccgtgattgcactattgcacttcagcctgagtgacaaagtaagatcccgtctaaaaaaagaatcatgctgtacctcataaatgtttacaattattatgagtcaatataataagagtaaaaaagtggattagtgtctaagtcaggactgcccaaagcactttctgtaatgaaagaaaggttttatacttgctctgtccaatatggtaatcagccagtagtcacatgtggttattgatcacttgaaatgtggctaatgtgaccgaggaagttgattttcaattttattgaattttcattaactagccaaatgtggccagtattggagagcacaagtctagatcacgtaaagagggcacagagatcaagtaaagaggacgcagagatcaagtgcttgcaggggctttctaaatgctgcagttttgttgacttagttctgtctctttaacttgcaaactcctcactgtactttttagcagaagcaggagtctgcaagcagatatagacataatacatatagatgatgggacttctgtctttttggatatggaggcctcgtggccatgtcttcatgtctgtctttgtctagcaggtgggtgccgtatgtgaagtcttctagtgtgctcacaggttatcagtctcagcatcctgggttcagctgaactgactcaaggaagctctaattattgcggcatatgtttcagttttcaggctggaggaaatgtgttcccttcagtctgaagtcagcacagatgggatcttgagccaaggcctcaacacacaaaaacaaaactgctaacctttcacagctgccgtggtgctgctgacctcagcagcggtggccaccagggtatgtgtaaagcttttataacgaaaagcaaaaaatttccacttacagctatcattgtgattcgaatttaagataggtcaatgaagggtgatatgctggctggctttatttattttaaaggttagcggccttagagcaacactaggttggttgtgttgggtgtgtcctatgtagagcagcatacatgccaagtcaggtgtgcatccaaacctgaataaatttccatgagacccttgactttgaatcagggtatctgagacgtttcacatgctttgtatatgttttctatgcttgtcacaaatgtatgtgtgcttgaacacggatatatatttcttgttttttgagccctataaatggtatcattgctgaatatagtcttatgaaatttaaaaatgctcagcattacattttcagcatgtatgtgttattgcacatagcattagttattaattttcaccactttgtgatattctgtggtatagcatagaccacactttatcagtttttctgtcagtggacctctgggttatttcctagttaaatgttcttaccactgattataccttctcttatactactgttagaaggcagcaaggatagggaataaattatccatatctcatagaaggagagaccagaggagatgaactaggaagataggatatatgtttaaaacagggagtaaagaaggaaactgggatatatttttcttggtatgtgcaaccatcactaatgccatctgatttaactcctgggctcaagcaatcctcttgcctcaacttcccgagtacttggggctacaggcatgtgccatcatttctggctaattaaattttttttttttttaagacacagggccttactatgttgcccaggctggtctcaaactcctggcctaaagcagtcctcctaccaaggcctcccaaatttctgggataacaggctgaaccactgcacctggccaactgtaatttatgcaactagttctgtgtagtccttactcttctagtaattttccattagtcagggaggaactaaaaaagccatgtagtccaggatcacccttaatcagccacaaatagagtaaattggtttatcagaagtttgccatatgagttttgtttgtttttaatggtgactcttaatggacagttcgggtagaatggggtgccagcctagcaaatgagtgagcttcatttttattcagtctgtgacatttttgactaccaccagtgcataatagaacttaagtatagattgaaaatttattttcatgattttaaattattgactgctattgctaggccagagatcatgtagcccaagtgattgtgcagctgaatagagaaaaatctctttatagtaaatggaggctggaaaatggcattgctcgttgcaggtggctattgtacttgctcatgttttatttaggtgtttagcagtgccatttgagcttctaattaaagttgtgattacacttcagttgtttaggaagcctcacatagacttaatcatcagatcagcttgatgaggatttgcaaaggtaagctttattacttcacacagtggcttctagcctctatcttgactgtgaagggagcattgattcataagaacataacaaatagttcaatgatgtttgaagtatattgagtggagaatgaaatgcagaagtctgttacagacactctgtctcgattaacctctctaacccttctatttagtttgatggatagagggatttgtgccctgaaatcacagaggtatcacgtgctcagatatgggatcatctttaagatggcgttgttaatcattttagctgatcgagactcattttaactggtttgaacagttttgcctcacattttattatggtcttttataaatttggaaaatagttggcaagtttaataataaatttgttcatcaggatgaagaaacatctgtattttgatatttgctgaaatgtgtgatatgctaatcctatatatgttgaattgatgtttctgtgattacagtaaaaatatcacaactctgtcttttgccattatattggaaaaagagaggatgaaggtaataggtactgtttagagaggttattcttctttcagactacaatgtattatggatgaacaatcttaaaatagtatttgaggccaggcacggcggcccacgcctgtaatcccagcactttgggaggctgggatgggcggatcacctgaggtcgggagttcgagaccagcctgaccaacatggagaaaccccatctctactaaaaatacaaaattagccgggcgtggtggcacatgcctgtaatcccagctactcgggaggctgaggcaggtgaatcgcttggacctgggaggtggaggttgtggtgagccaagatcgtgccattgcactccagtctgggcaacaagagtgaaactggctcaaaaaaaaaaaaaagcacctgaattactgggatttaagaacattgctactggatgttttagaactttatatgattattacatactctattttttatttttaaaaatttaaggctgggcatggtggctcatgcctgtatcctagcactttgggaggctgaggtgggcagatcacctgaggtcaggagttcaagactagcctcgccaacatggtgaaaccctatctctactaaaaatacaaaaattagccaggtgtggtggcacatgcttgtaatccagctacttggtaggctgaggcaggaggatatcttaaatctgaggggcagagtttgcagtgagccgagattgcaccactgcactccagcctgggccacagagcaagactgtgtctcaaaaaaaaaaaagtttaaatagagatggggtcttgctgtgttgcccaggctggtcttgaactcatgggctcaagagatactcctgccttggcctcccaaagtgctgagatttagaggtgtgagccaccatgcctgggccttattttttagagtttaatatcatcagcttttttccatttgaaagactctccttggttacctagaaattttattttagctttcataaaaagctttgctttgaaagtgatcactgaattaatctaaggaaatatgagtcttaagatactgtgatgatgttcagctgcctcgaatactttttaaaaagttagtatagtgttcatgatgtatgaacagtttcttttgatttatgagcttcagattttgtgaattttatgaattttgagtgtgtctgaaaaagacagtggtaggaataaagtaatttctttccacatgaatctgtttttcagtgttttccgaagaaaacatatttgtatactgtataattcatagtggttttttttttatttgcctaggataatgaaataaagtacattgggtattttattacatggctgatattgtttctcttggctgctttgtttgttttgttttctcttagaaaaatatctcaagtcttgtatctcaactacagtagcctgaaaggggcaaggaattttctattggaaatggccaggaaactatactgcatcaaaagattgaagtcataaaatagcacaattaatgaccgataccaatcataatattgtttcttaaagttgtcttaacactgaaataattttaaaaaaatggttttggatccagacacagtggcatgtgccggtaatcccagttacttgggaggctcgggcgggaggactgcttgagcccaggagtttgagaccagcctgggcaacctaacaagacaccatttcaaaaaaaataaacaaacaaataaataatggctttgaaataaaatgttgaaatgcaagtagtagctggtatagctgcgaagaatatttgtaaaaggcacttaatatactgtttcagtgtcttaagttactatcctgctagactaagctttgtgaaggcaggcactgtttctgttctgtgcttattcctcactgcctatcacagtatgtgggtaaataaatgttagatgaataaatgaacgagtgacctgttaaactgatggcagtgtcttaaaattagtcacctagcaatggagcattttttaggattatatatctgaaatatataacttttgatctttacctttttttttcttttgggaaaacagagaaagatgaaacagagaaagatgaaaattttagcatacaactttagtataaaattaatgtaatcttagtggtcttgtttaatggcttgctaatgtcagagttttgaggacgtggatacagtgagaatataacaaattcataattgtaatttgctgatttttagatcagactcaatttctatgcttgaattttatgtttgctaatacaaataatttgaaagccaatgttaatacatctcatagcctcagtaataaagttgacaggatgacatgttgctacaaatccataaatggtatggcttactttatagtttggtaggacataagttccttaaggataggcatgtgtctttttcatttttgtttctttttcacagtactttttaaaatagtatctattaaaaatgagaggctgggcatggtagctcacgcctgtagtcccagcactattggaaagctgacccgggcagatcagttgagcccaggagttcgagaccggcttgggcaatgtggaaaaacccaaaagtacaaagaagtaaaaaaaatacaaaaattagccaggtatggtggcacacatctgtagtcccagctacttgggaggctgaggcgggagaattgcttgaacctgggaggtggagtctgcagtgagcagtgatcatgccactgcactccagcccaggtgacagaatgaggttgtgcctcaaaaataaataaataaaaataaaatatggggctgggcaaggtggctcacacctgtaatcccagcactttgggaggccgaggcaggtggatcatttgaggccatgagttcaagaccagcctggccaacatggtgaaaccctgtctctactaaaaatacaaaaaaactagctgggcgtggtggcacatgcctgtagtcccagctacttgtgaggctgaggcaggagaatcgcttgaacctgggaggcggaggttgcagtgagccaggatcatgccactgcactgcagcctgggagacagagcaagactctgtctcaaaacaaataaataagataaaataaaaataaaatatatgaaaaatttgtgtacagttgaaatctcaagagaaaatctacaactatctactcctttatggtatgactaattacgctgggcaatcagtctttttattaatagtagaaagagggctgggtgttggatgttgtttgatactgtctattttatatagctcttgtcagactcatcactagttcttgaattctgtttctttgggttctgtgaatgctctcacctgtttatcttcctccattgtgcatacctcattctcagtttttctcttccagtctcctcctccttttggctcctgctgatctgactaacctgagccccagtgtctccctctttgtgctctgtgcttcagtcactctatactatttacagtcccctgaatgtactgtttaccattgtacatgcttttccttgtcagcctggtttaacccttgccctttaagaaccactctaagtatttcatttgtgaagctattcccaagtagaggtcatcaccactgcatgttgtacatctctctatggtagcttttaccataccttattatagattctcatctatgaaaccagctttgcaatgattatgacagagaagtccagcatggctgactccgccttctaagctcacaggcgggctgtccttgcccatttctgggcgtgggccaaactaaccacgggaagaattgagtgtgtcgtttaaccttggagcaaggatgaaaacagtccctccctcaaattaactcccttcttgctcagggactgaagctgcctttgtaaaattaatgaaagccgatgagattaggatgatgggaagagcctgaaattctgctgagatgtagggatagttagaccataaccagccattgttccggagatcacaagatttgtaacttctccaattgctcctacagatgacgtctctattgtagagcctaagattggtcttttgagatgtttttcagactttagcattctagtgattgacggattccacccagacccacgacccaggactcaaccagtcttgttgttgttgttgttgttctttctcccctcccctcccctctcctcttttcttttcttgctttttttttttttatgactcaaccagtcttgtgcccccaccccagaggccgactcaacacacaaggcctgttttctacacccctatgatttcatcccaaaccagtcagcattccccattccctgtccccctgcctgctgaattatccttgaaaagccctggtccccgagcttgtggggaggctgatttgagtaataaactcctgttcttttgcttggctggctctgtgtttgtaacctctttctccactgctgtcatttatactgttgtctctgaatcagctctatctgtgcagcaggcaagaagaacccatcaggtgactacatctgtctaggtatatttttcctactagaccattcacttcttgagggcctggcaataataaacatttgtttttttccatgatggataagtaaggaatttaggatagctgtgttaaaatagctcctatcttcggagatggtttttcaaccgagagcacaaaaggtatcatctgaaatagttaagaaggtcacagagctaatatatgatgtaccagcagtcccaacctttttggcaccagggactggtttcttggaagatcatttttccacagactggaggacaggggatggctttgggatgattcaagcacattacatttattattagattctcataaggagtgtgcagcctagatccctcgcacacacagttcatagcagggtttatgctactatgagaatctaatgctgccgctgatctgacaggaggtggagctcaggtggtaatgcctgcttgcccgctactcacctcctgtcgtgcagccaggtttctaacaggcaacagactgacagtggtccatgaacaggcaaagagatggtacagttttccgaagagcatacccatcctaaggattcctaatctctagaaattctacatcacagtgacacactcctttagtatcttcagccatgcttggtaaataaatattgttgctgtggttaagccgtagtttttgtacttgttgagtgtattagttctcacactgctataaagacacatgggagactgggtaatttataaagaaaagagctttcatcagctaatgattctgtaggccatacagtcttctgcttccttgggaaacatacaatcatagtgaaagacaaagcggaagcaagcacatctcaccatggctggcaggagaacaaccaggtctcgtgagaacgtactgtcacaagaacagcaagggggaatgtgccccatgattcagtcgtgccccaccaggccctccttcaacactggggattataattcagcttgaaatttgggtgtggacacagagccaaaccatatcattgagtatatgaaagcactggttatcttaagtatcaaaataaaccgatgttgcataatagtttgttctttggtcttaggaaagttatcctgaattagtccagtgtgcgttgatgatgtatatccagttctgatccagaagctgtctgatggtccagataggatgctaaggagggagcagaaacttcgagagctttgtggtttgatatataattagtaagtgagccgttgggaacaaaaaagctttgataatgaataatcagctagctgagaagctaacactaaaatttccaaacagtataggatcaagaaaaatggagacatgtaccagtaggatattgatgtacgtatacctataaagcccaatttgcaaaagctaatttatttctgtcatttatatatgagcaactcatacttccatcctaaagtaaatagtatttttctagactgtccgataatttggggtgtgttcctaaggccccttacatgatgagatatagtgaccctcactctcataaaggctcttgaccaagttcttcctctaaacatttttctttttcctggtaaactacctcagatatttagctaaccttgtaatcttaaaatcaggttttaaaagccaccctatcatcttaggtgtctatcataggtgtcttgacgtctgcaggctcttgccatgtgattttcttgttcttattcactaggtggtggcagagcatagaggcagcgatcgggctcctctcccctgacagtggtgggttcgtcttccctgtccagccgtggtgggttcctcttccctgtctgaccatggtgggttcctcttccctgtctgactgtggtgggttcgtcttccctgtctgactggtgtgttcgtcttccctgtccagccatggtgggttcgtcttccctgtctgactgtggtgggttcgtcttccctgtctgactgtggtgtgttcgtcttccctgtccagccatggtgggttcctcttccctgtctgaccgtgggggtccactcgcagtagtagtgcacattgtccacttgtgaaaaaggtggaacttgtgagaggcacgtaacagccagtggttttgccttgtctattttaagagaacccgtgaggatgattgaaatgactctttgaaaagaatcaatttgtctcaggctgaaggaaaatagaagaaacggaacatttccacttggactgcatgagagatgttggtattgaggttgctattcagacagcattgaaacatttcattgaaacatttgaaggatggagcaaaatgttaagatatatttctacacttggactttggcatttagagctttcctcgttccaaaagatccatgctatttggttctggtttggttgcttggggatagtggtaaaaatagagccttctgttttaaaatggagggagcaggaattgctttcttgctgttgactgcttgtcccaggaggttctacccaacaagtgaccgaattgcctctcttatatcataaagcatagctaggttcaggagcctctcttatatcataaagtgtagctgagttcaggagcctctcttatatcataaagcatagctaagtttgggagcctcatatcataaagtatagctgagttcgggagcctttcatataataaagtgtagctaagttcgggagcctctcatatcataaagcatagctacgtttgggggtctgtcttatataagaaagcatagctgagttcaggagcctctcatataataaagagtagctgagttcgggaggctctcttatctcataaagcatagctgaattcaggagcctctcaaatatcataaagcttagctaagtttgggagcctctcacataataaggcatagctaggttcgggagcctctcttatatcataaagcatagctgagttcgggaggctctcatataataaagcatagctaagtttgggagttgattgctgctatgttcattgttcagtctttacaacaataggacttaagagcctgatattggtgatttcttgttttcgaatattctgatttctctgtcaaaagcctgtgttccagtgaaatccaaagcagaattccaaaggttggtggaaatgattaaggttcggcctctgccataggttcctgctgtatgtttacattgtacgcccctcagtattggtgttctgacatcaggatcttgtgtgtgcagtgaggtttgtgtactgtggggttaaacttcctttcgttatggcaaggaggtacacaggagttctctcacagtgtatattggtgagaaacagctgtttggattctattcttaaaggaaatgaatacttacattccaatgtgttagagatcttgggttttgtcagttatacatactacatagctgtgctatatatgagttagtttgcctaatattttaggtacttattgataagagtaatcagaaaacatacatgattgtcctactagtatcatttctttcttgaaggacataaggataacagttatttattaggatgtgacaccagagaggagtaatttaactgattaggttttctttattttctgtttctgtgaaataaaagcaaagctaagaaagatggaattcatgtggaaaaatcctttgcttctttctagctgttaatgctagttttcaattttcaccatagatgtcaccaaagcatagaaagtagttcagagttagaaataagacaattgtttttagatttttttataaagacagggtcttgctctcttgcacaggccggagtgcagtggcgcgatcttggcacacggcagcctcacttcccagggtcaagcagtcctcctacctcagcctcccaagtagctgggataacaggtgcctgccagcatgcctggctaattaaatttttttttttttttttttttttttttagagatgggggtcacgctatgttgctcaggctggtcccaaactcctgggttcaaacagtcctcctactttggcctcccaaagtgccaagattataggtatgagccactaggcaattctatgcctagcctgtaattttatctaatattataaatttctcatgctgtttaactttttgagaaatattacatcagtacacaaagtgcttatgttagaatgtattgctttggttgagagaaatagatgaagtcctttttgaaaatgagctaattgtgatgcttctcttagtgattttgtgatgtatgtaggaatcctgaacacgggatcaggcagcctctggttctgtcactgagtaactggattataatggtcaagcttaaacattttttaagttagttttttaaaaaaagaacttcattgagatataattcacatctcatatacttcactcatttaaattgtatagttctgtgtattttttttaacatagtctcagagttgtttagccattacctattttagaacattttccttctttctaaaataaaacttgtactcattatatggattgtataattactcagtatttaacgatttgtgggactaccaggttgtttcctaagtgataaaccattttactttcccaccagtaagtatgagggatctttcttctcatttttgtcaacacctgtattctctgttttttaaactacagccttctagtgtgtttgaagtcgcctgtctttgtggttttgatttctatttccataatgattgatgatgttgaacatgtttctatatgcttattgactatttgtgtatcttcttttagtgaaatgtttctttattctaattgagttttttttttttctttttctttttcttttttttttgctgttgaaccatctctaaaaactagtaccttcaaggccaggcatggtgggctcacacctataatcccagcacttttgaaggtggaggtgggaggatgacttgaggcctggagttcaaggccagcctgggcaacagagtgagaccacatctctacaaaaaatttaataattagctggatgtggtggtgtgttcttgtagtcccagctattcgggaggtgaacctgggaggatcgcttgagcacaggagattgagactgcagtgagccacactgcactccagcctgggcaagacagtgagatcttgtgtctaaaaaccccctcaaaagtagtccttcataatggagttattatgaggattgaaataattgatatatgtgaaatacttagcacagtacctgacacatagtgagtgctcctctcatgttggttattattgttattattgcctaaagtaattctttcatgcgtttcatgtttcctggtcattctattttaattcctctgatatgagttgtgaaaaaaatcttcaactcccattttcaccaaccttggtccttcctacatgtgttcaattgttcatttgttcgtttatccttcatttagcaagcatttaccgaatgcctattatgtgtcatgttttgtgatagaacctgatgctgcaaactggaaaaaaaaaggatgaaagtctggagggaaattcaaatgatagttggagagcaatgagagctttattgtaggtatttgcaagcttcggtgaagtattcagagaagggtttggtgataagctgaaactggagggatgagtgggagtttctgatgcaaatattgaggtcagtgttatggatagtgcaagggtatgttcaaaggcataggaatttgaagacattgaatgttcggggtaagatgagatttataggatgctgccatgggttgtgctgataggagttgggaatgtgatatgaacagctggagacgggagtaccaaataggaaagcacctctcttgcttctggatctttaatgctcagaaaattcttccctctctcctttttacatatttagcttttcattatgaaatgtgttacttttcattatcaaatgttcctccttgtctctagtaatatgtgtgtcttaaagtgtattttgtttgatattaatatagtcactgcagcattcttatgattactggtttgttttcttttgaacttgtttgtatctttgaatctagtatatatctcctatagacagaatatggtcgagtcttgcatttttggttctcttttcctttcccctcctctctccttctctccctctctccccctctcctttttccctctctccttctctctctctctctctctctttttctctctctttctctctctctctttctctctctctctctcaataaggtctcgctttgtttctcaggctggagtgcagtggtggaatcaaagctcaccgtagcctttatctcctgggctcaagcagttctcctacttaagcctcccatgtatctaggaatataggtgcatgccactgtgccttttttttttttttttcagatatagagtctcgcttagttgcccaggctgatcttgaactcctggcctcgagtgatcctctcactttgacctcccaaagtgttgaaattatagacatgagccatcgcacccagctgaagcttgcttttaaaactccagcctgatggtctcttccttttgatgtgaatgtttggtacattcatgcttaatgtaattttggatatggttggatttatgtctgccattttgatttttgttttctataggtttgatgtcttttttgtcttcctctgttcttctattacatttgcgttaaatatttttggagtgtaccgttttaattcatctgttgatttttttaaaagtcatctgttgttgttgttgttgttgctctagtgctgtactgcccactgcagtagccactagctacatgtggctgttgtgcacttgaaatgtggctagtctgaatttatgtgtgctaaagtgaaatacaaatcagatttcaatgacttaatagggaatgtaaaatattcataatttttgtattgattatatgttgtcataatactttggatatgttggattaaataaaatatgttgttaaagtttcatgttttaaaaacctttaaaatattactagaaaattaaaaattatatatgtgacttatatttatggttctcatatttctgttggatagcattgctttaaggattacaggatgaatcttgaacatagcataatctgaaagttttatagttacttaatctagtgaagtatggtaactttgttcccatacagcttcatccctccccattctgcattgtgctatttttgtcatgtactgtccatctatatatgttatccactgaataatggtttttaccttaagccaatcttaggatttgtaaagaaattaaaaatacagtatataatatacaggcttttatatttacctacatatcaacaatttccagtattccttcttatggagtttgcttttttttttttttttttttttttttttggagacagaatcttgctctgtcacccaggctggagtgcagtggcatgatcatagctcactgtagccgtgaactcctgggctcaagggatcctcctaccacttgccccaacttggactatagcgttagggaacaaaggtaaggtttttccctttttgtctcccaccacatttgctactttagctgataaagacctggagttttgccccccatcccgcagcagatctgccccttctggtagcaaagatactggcttttgcagacagccccaagtttgtcaaagttttcaccacggcagctgagtgtagggtagaagcagcctgaggcaaggaggtcctctagaaactgacttcaacctcgaggtgattttcaagaatgaatgctttctacaaggaggtccccagaaactgacttcaacctcgaggtgattttcaagaatgaatgctttctacaaggaggtcctctagaaactgacttcaacctcgaggtgattttcaagaatgaatgctttctacaaggaggtccccagaaactgacttcaaccttgaggtgattttcaagaatgaatgctttctacaaggaggtcctctagaaactgacttcaacctcgaggtgattttcaagaatgaatgctttctacaaggaggtcctctagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtcccctagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgatttttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtcccctagaaactgacttcaacctcgaggtgattttcaagaatgaatgctttctacaaggaggtcccctagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtccccagaaactgacttcaacctcgaggtgattttcaagaatgaatgctttctacaaggaggtcccctagaaactgacttcaacctcgaggtgattttcaagaatgaatgctttctacaaggaggtccccagaaactgacttcaacctcgaggtgattttcaagaatgaatgctttctacaaggaggtccccagaaactgacttcaaccttgaggtgattttcaagaatgaatgctttctacaaggaggtcctctagaaactgacttcaacctcgaggtgattttcaagaatgaatgctttctacaaggaggtcccctagaaactgacttcaacctcgaggtgattttcaagaatgaatgttttctacaaggaggtcccctagaaactgacttcaacctcgaggtgattttcaagaatgaatgctttctacaaggatgtccccagaaactgacttcaacctcgaggtgattttccagaatgaatgctttctacaaggaggtccccagaaactgacttcaacctcgaggtgattttcaagaatgaatgctttttcatttgttctctgctttggtctattttcagtgctctgaaatgttatttttaatataattttttccaaattttatagttgttttatatagtaacaaattactgacttctccacatagctgtaactagaagtccttcagaactcttacttttccttcaggttttcttcctccgaggagacttccctgcctcacactgctgctttgcttcaggtctctctgctctgtgttctggtaatatcctgtgctttctattgtcagattaattgtccttatgctagactgtaaactccaggaagccaggtacttttaaaatattacatttctttctaaacacaatgtctggcacatggtaacaaatatctgtgggatgaataaatgttaaactggcattttgaatctggtttggtaccatgttcactttaaatgccgttgagggccaactgtgaggtacttaatacattaaatgttttgcatattttatttactccttaaaacaaagttaacagtgttgcctccatgttatagataagaagtctgaagctagaaaagttaactaagttgtcctctaaatattataaatattaagtgtgaagccaagattctcagtccatgtctaaagctcataccgtataccatatgctaagtacgttgcctcatgcggtggttagaagggatatttatccacagttattttcatttaaaggaagcttctaaatggtaatattatttcttaatagtatttctgagcactgccctttaccgtgtgcaaagcagtctgcttgctgtattctctatctgcttttcttgtgcgtttttcatgagagtcatataacataggtagttccccaaaggatattaatgtactggcctatacctcgaagactctcgcttattgtgtagtccctttttcatattctgtgcacaaaaaggttttttttttttatatcagaaagtataacattgtataacataggattgtataacaatcttataatgtataacaggattcacatcatacacggcgggaggggtaaactatgtaataagtggtcaatttctcccaccctttctctcattgtcatattgtctatagagaccaagaggtaaaacatagtttgttgttcttgggtcagtctcagttcttatatggtctcctcagtaacatgagtgactgacaatttttttttttttttaacaattaaaagataacagaggtgaaatctcactattggccaggatggtctggaacatctggcctcaagcaatcttcctgccacagcctcccaaaagtgctgggattacaggcatgagccactgcacctggctgacaattgcttttttatcaactttagcgcctctttgttcctcctgctccctggataaaaattattaaaatgtttagtctaccagtaatctttggttcctgacaacactgaattcacaacagacttctgttttctttaccttctcccatatcacccagtagaaaacacaatctctatagcaagttcattttaactcccctttgcagaaatgcccagtttcctagagtacgcattctccttttactgtagcaagccgataaacctaactggtggtcttctggcactgggctttcgcacctccagataacatgtatgtattttaggccagacgcggtggctcatgcctgtaatctcagtactttggaaggttgaggcggatggatcacgaggtcaggagatcgagaccatcctggctagcacggtgaaaccctgtctctactaaaaatacaaaaaattagctgggcgtggtggcaggtgcctgtagtcccagctacttgggaggctgaggcaggagaatggtgtgaacccaagaggtggagcttgcagtgagccgagatcgtgccactgcactccagcctgggcgaaagagtggcggaaaaaaaaaaaggtgtatgtgttctactgccttcctactcaaagtatggtccgtggacaggaggcatcagcatcacctggaagcttgttacaagtgcagaaaagccccactttcagacctactgagttagaatctgcatttttagtgattgtgtttgttttaaaaaagtgatttgtttgaaaagcaccgctctacacagttcccgcttttgatggtccatgtccatttcatttcttgttcatagacaatataatgcacagtttggagggcagtactatttatacggggttctttactgaattctttcactcagataattctttttatttcctttactggaaacatttctagtgttaattttaagttacagaaggtgggtcctttctctcctaggaatatgacttaatgcagtatacacagatttgaggtgggagcagaaatgcagtaaggcttaatatttataacattttaatatttttaaaatatttatatttataaaatactttaaaagcccgtagtgccatgtgaattttaagtattaagaataaattgaaatacttaggaaatgggtatatcctaagtatacttaggaaatgggcatatccgaagtatttcaatttattcctagtacttaaaattcgcatgtagttctctgtctcaaatgttacatgctcatgattcactcagatcaattttcaagtaagtattgtgttatgcacatagtttaaataatttaccaattaaattcagtttgaaagacatgctggagacaaaagataaattttcaatatttgagcacataggaaaaacctagtcttgtaagattttattcagtaaaattcttaggcagaaaatacctaagctttatcctgcatgattttgatttgtttcattttttttaaatgtatgaatgaaagatttctttattataaatttggtcaggtatttatcactgcgtaagtcctagagaatattatgtaatgtcccatgggtgaaatatttctgaggtatgaagaaaatcagctcaattcagctactacaaataatgtcttttgacagatagtaaataggagaatcagttaactaccttagttgtcttttactgagctgtcacagtatgtttcccattataatttttcttccaaacctaggctttttaaggacagtaattgtgatacttttattgatatatatacacacataaaatttctatttttagaccaggtgcagtggctcacgcctgtaatctcagcactttgggaggccgaggcgggcagatcacttgaggtgaggagtttgacaacagcctggccaacatggtgaaaccttgtctctactaagaatacaaaaaattagccgggcgtggtggcgggcacctgtaatcccagcttcttgggaggctgaggcaggagaattgcttgaatccgggtggcggaggttgcagtgagccgagatggcaccactgcactctagcttgggcgacagagtgagactctgtctcaaaaaaaaaaaattctgtttctaaatataatctaattttgttcaatggttacattttctttttgtgtgtgtgtccatctctgtttagaacattatgggacctgatttttctaaatttagtctcaacctatacatgaaatggaaactctgaaggtttatgagacctgattttagggaaagatgaagaaacacattatttagcctgacagaaaaagatatctgaaggataattatctctcagcttccatattataatattgctccaaaatagttgcattttattttctagtttacccagaagaaaatacttcatatgagatacatatatagtaaaagtgagtcattccattttccatcctccttttttttaatggttgttttgtctaagacaccaggtgtctgctccctgactaatcagactcaccattccagatcttttaattttatttaatgcctttgtgtttcccttgactataaatgtttctgtttatcttgcacttcctcttcatgtattgaagatatcaataacagagtgaaagctagcaagcttgtaatatatttaacatggcaggagaaacaaacatgttggcatttattctggcctaagaaaaaggagcagggttttgctgaaaggagttatttgttaactttggtagaactcttgacctcaagtgatcaacccacctcggcctcccaaagtgctgggattacaggcatgagccaccatgcctgaccccatcttgatattttgatcatcttccaaaaagcatcataacagcttttatttcatgtgatgtattacctcttgctgcctgcagtttaaaggataatgcatttttaaaccaaagaggcttcatatccaaaataattgtctgtaattccatttcagatatggctttttgttgttgttgttgtatattagaccagtgcttttctacctttagtgcaatatgaatcacctagacatttgattaagatgtagattctgattcattggtctggggtggagtcagtctctcaaatgaagtcaggctttgtgtttcagtagttgtggccttctgcccttttgggaggagaacgttctcagaaagattctttttactgaatattgagatctctgatctacccatccccaacactcattcaaatgcattcccagctggtagatcctgctgtgtaaacagaggccaagttgatgattcctttggtgtctttcatgcctgtaaggtaatttgccttctttccgcctcctgagggaaggagggctacctcaagttcttgggcaggctagccttgtgcctgggtcaataggtgggcaggcctgggacctgggtccatgggggtgggtctggagcctgggcccactgggacaggtctggatcttgggtttgaaggactagaccccgggtccatgggggaaacctggtggtgaggtccactgggtgagtctgttgactgagctcatgggtgcgagcctggagcatgtgtctgtaggggctggcctgaagtctggccagcctggccctggagtgggccttgagcctgagtctgtgggggccagcctggcactaggattgtctgggtgcctgggtccatgtggatgggccttgagtttgagtccatgggggttagcctggtgctggggtgagcctggagcttgagtatgcagaaagagacctggttcttgggcctgtggggacctgtctggatcttgggtccacaggggcaatcctagagcctggatctgtggggcaacctggcactagggttgaccagggtggacttggaccctgggtctgctggaatgagcttggatcctgggtctattagagtctggggtcacagggaccagcctagagcctgggattggcctggtgctggggtgagcctgggtccacggggcttggtctggagcctgggttcacaggtgctagcctggtgcctaaggctgtggatgctgagtttactgaggcaggcctggactctgagtctatagagtgggcatgggtcctgggtttgctggagcgtgggtccatgggtgctggcctggagtctagggctgtgaggactgacctggcattctagtgagcctggaacctagagttgtagcggctgacatggggctggactgggcccggaggctgagtctttgggtttcagtctgaatcctggggctacaggagctggcctggagcctgcgttgggcctggaggctggatcccataggtgtcagctggaggggtttggggctataggaactggcccggagcctgcggttggcctggaggctggatcccataggtgtcagctggaggggtctggggctacaggagctggcctggagcccacggttggcctggaggctggatcccataggtgtcagctggagggatttggggctacaggaactgacctggagcccgcggttggcctggaggctggatcccataggtgtcagctggagggatctggggctacaggaactgacctggagcccgcggtgggcctggaggctggatcccataggtgtcagctggaggggtctggggctacaggagctggcctggagcctgcggttggcctggaggctggatcccataggtgacagctggaggagtctgaggctgcaggggctgctttgattttcttctaaaagtgtcaacagttattggtgttgaaggcctggttgaaaatacttccatatgtaaacacatttgtttctttagcaaacatttattcactgtataaaatatgcagggcactgcgggagacatggatggcgatataaagaggtactggatgtactcactcctctaaggaagtccttgttgcctccagtacattgaccagtctgagttcattggtcttccttcatggtatgagaacatcttcaagtcttctgttttgacttgattgcggtttgtgtatgcaactttacacaaaagcatcgataaacttggtctctgttcgcctctgtttctcaccaggtagtgtctttaatcactttaatgccatcccaagtttatcatttatacctgttaaaataatttcaggtatcataataggttttgtttttatttttttatggaaaaactgctggttatctaccagatattcgctgggcacttctttaataaaagaacttcagttttattcgaggtggcagtaagcccagctaaagaatgaaatgttccgactttctagacatggccatgtgactgagttctggccagtgagagtaagtcctttaagactagaggcctagagagtcagagagtgtcagttttgctcctcttcatccatttacaccatttttcctcttcctcaaaattgccagctcctctgaagcatttgccattctactccccattacctcaccttccagttattccttaacattcatggctcactttttctttctttatcattactggcaacatcattcttagcgaattgagcatccatctgacacctgggctgtttgtccccacttccaattctctttgcctttaccttaccctagctacctcttcccatggccatagcctaggacagtagcccatggctatacccatggccacaccccagcacagtaactattacttcagatatctcaatttcaagattcctacttttcaacaactgcatgttacaggtatctagcacagaacctgacatcacataataggcgcttggtgagcattattgctgttcctgctattctgcctctgtcgtagcatcaacagtccttgaaaataggaactgtcttattgatccttatatatccagaacctaccagagccatggtacaaaaagactcttagtgtatttatgggaccagtaatgaaagaacagcaacaataggaaggatatggcattcagaagaaggtctttaaaagataattaacattttccatttaaaatatcacatagtttttaaaaagcattcaagtaatgacatttcaaaagttgttttctttctcattttctctggggggaaatagatgttatagtttattgccattgggaatctttttgcttagtcaaggttgatcaattacgaatttccatttctgaggattattataaatgagctataaacagggagattgctttttagtgaaatgggttagtttacctgaaaagagttaattatcttttttctcctgtattgaaaactattcgtattagcctagtgtgtataggagaggatgaaggtgatgcattaagattttctcagccttccttattatctaggtagaaaaataaaagtatttaatgtactgtattatctctgaatatttttctgagatatgagaaaaatgtgtagaagttttccatctatttgggtatggacgttgacttttcagaacttttttttttctttctttctttctttttttttttgagacagagtgttgctctgatcctcaggctggagtgcagtggtgtgatctcgacctccctgggaggtgcaacctccacctcccaggttcaagtgattctcctgcctcagcctcttgagtagctgggattacaggtgtgtgtcaccatgcctgactaatttttgtattttcagtggagatgaggtttcaccgtgttgtccaggctggtcttgaacacctggccttaagtgatccatccgccttggcctcccaaagtgctgggattacaggcgtgagccaccatacccggccttttcaaaacttttaaaagtcagttggattaatgatttttccagaaacattaggttcattgttattgtattcatatttggttgctttcaggctaagaagtagttactgtttagctatacctatggttacttctgcgaataacttcaactgttacgttaattcagtaatttttcattgttagatatgtgaaggacctgaaaataaccaggaaaaacatcccaagagttataaacattcaaagctttataaaattctgattttctagaaaggctaagctgtttaatatattagtattgtttaatctattagttctaagatatttcaaataatatctagaaacagcttttgaaagtttgcaatttaaaaatcttaataataaaaccgtgatgataatgagtaatagttactgagcactcctgtgagccaagaatgatattaagtttttaaaagttttattcttattacacccatgtaatgttattattattatttattatcattttagttcagtggtttcaagagattaaattgcttagtattacacagttgctaaatggttgtattagttagggttctccagagggacagaagtaatggaatatatgtgtgtgtgtgtgtgtgtgtgtgtgtgtgtgtatgtatgtgtgtgtaagtatatatatacttaataatatatatataaaatattgttttctttctcattttctctggggggaaatagatgttatagtttattgccattgggaatcttcttgtttagtcaaggttgatcaattacaaatttccatttctgaggattgttataaatgagctataaacagggagattgctttatatatataatatatttatatatactatataaatatattatatataattatatatactatataaatatattatatataatatataaaaataatatattaaatatattaaattatatataatatattaaatatattatatataattatatataatatataatatattatattatatatataaaggggagtttattaagtatatatatgtgtatatatatatgtgtgtgtgtatatatatatatatgaaggggagattattaagtattaactcacacaatcacaaggtctcacaataggccatctgcaggctgaggaacaaggagagccagtccgagtttcaaaactgaagaacttggagtctgatgttcaagggcaggaagcattgcatgggagaaagatgtaggctgggagactaggccagtctctctttttacatttttctgcctgcttttattctagctgtgctggcagctgattagatggtgcccacccagattaagggtgggtctgcctttcccagtccactgactcaaatgttcatctcctttggcaacaccctcacagacacacccaggatcaatccttcaatccaatcaagtttacactcagtatcaaccatcacagtggtcaactaaattttaattccaggccacgtggcactagtgtaagctatttaattacagtattatattctttcatagtgcctagttgtgaaatacagacacagtctgtgagaaatgagtttgtaaaacaggcactcaacaaatgattaaattcactaagaaaactcagtagaaaatatgcaaatgctatgaacaggcagttgataaaagggaaattatgcatggtgaatagacatgaaaagatgctcaaaccctgaccatttgtcaagggaaagcacattgagataacattttcacccatcagaccggcagaatgtgaaatgacggtatcaagaggtgatgagatacagatttaggggaactctcattatatggctgtgagagtgtaaattcctccagctgccttggagacctgtttgtcaatatgcaaaattgttcaagttgtgctttcttgcaactcagcagttttacttctaggaatacatactttaaagaaatggaatgagagtggagtccggaggcctctgggagtacccatgggactttcagggatttaagtgaaaactattttcatgataataattcagaattatggttgggcatggtggcttacgcctgtaatcgcagcactttgggaggctgaggcaggtagatcacctgaggttgggagttcaagactagcctgaccaacatggagaaaccctatctctactaaaaatacaaaattagccaggtgtggtggcaggtacctgtactcccagctactcgggaggctgaggcaggagaatcgcttgaacccgggaggcggagtttgtggtgagctgagatggcgtcattgcactccagcctgggcaacaagagtgaaactccgtctcaaaaaaaaaaaaaaaaagaattatttgccttttttattcttattatctcatgagtatactgtgggtcttccagaagctacattgcagtagattgaatgaagaaacataaaaaaaattagctgctttctattaagccagacattaaaaggattatcaaaaaagtaaaacattaccactttcctcactaacttatttttgttttgaaaaatttagttattttttattaaaatatgttgacatgtaataggattcttacttttgaatgaattaatacgttattattattattttgagacaaagcctctgtcgcccaggctggagtacaatggtgtgatctcggtttactgcaacctctgcctctcgggttcaagtgattctcctgcctcaacctcctgagtagctgggattacagttgtgcgccaccatgcccagataatttttgtatttttagtagagatggggtttcaccatgttgcccagtctggtcttgaactcctgacctcaggtgatccgcccacctcagcctcccaaagtgctggtattacaggcgtgagacaccactcccggccaatacgttatttttttaacgtcttaattttaatctgtaatacattaaatatcagtagagaagtcgacctaagtaaagcctctttaagatccttcagtaatttttaagtcaggactgagaccagaaagttttggaaagaattgtataagtgcacagttcaagtatgtgttcattgtaatgttgtttatactggtttatttatgtttagtttttttttttttttttttttagatggagtgtcgcactgttgcccaggctggagtgcagtggcgtgatcttggctcactgcaacctttgcctcctgggttcacaccattctcctgcctcagcctcccaagtagctgggattacaggcacctgccaccacgcctggctaatttttgtatttttagtagagatggggtttcaccatgttggccaggctggtcttgaactcctgacctcaggtgatccgctcacctcggcctcccaaagtgctaggatttgggctcccaaagctactgtgccctgcttgtttataatagcttaaaacattgttatcaacactaatgtccatcaatatgaacataagatcggttctatcaatatgaaatagcaagacacgtagagagctgtgtgtgtatatatatgtaatactgtaatatttataccatcatatttatatcttaatcagaccatatctgttttccagacattcctttatcacgtgtcaaaatagtttttttgagaagctaggcatatttctaagtaataataaagtccaaaactttattaagaattggattttaaggccaagtgtggtggctgatgcctgtaatcccagcactttgggaggctgaggctggtggaccacttaaggtcaggagcttgagaccagcctggccaacatggtgaaaccccgtctctactaaaaatacaaaaatgagccaggcgtggtggtgcacacctgtaatcccagctacttgggaggctgaggcaggattgttgcttcaacccagggggcggaggttgcagtgagccgagatcatgccactgcactccagcctgagtgacagagcaagactctgtctcaaaacaaaaacaaaaacaacaacaataaaaaaattagattttagccagttcacattattgccgatcttttgaccttaattttgaagggcagaaatataagtattaacacgtgctgctctatttgactagaaaataagcagcatatgtaagacttggtatgctagaatgtagaacatcttcgctgtgttctttcaggaccactgtactgtttactgacaaggaggaagcaccattttgttacatctttgtgaatacacttccactgtagtggcttaaacaaatagttaacttatttttctcatccaaaaattggaagttggctatttgatgtaacagagtggtggcatttactctcatgttgtgtcttgtgctgagaaggttgaaaattggtaaaaaaaaaaaaaaaaaaaaaaaaaaaaaaagtctctcattagaaatgtagttcatttttattatttccagtaggtatgttttataaagttactgtgaaaactgaattagccaatactgagccattcattcctcctagtagatatacaggattaggttcctgaaagcctctagtcacaacatatttgtcacctgatcagtacataaccttgttttattatgtgtttctttttaaagacaccttattttattttttttaatttttgctacggagtcttactctgttgcccaggctggagtgcaacagcgcgatctcggctcactgcaacctccacctcccaagttcaagcaattcttctgcctcagcctcccgagtagctggaattacaggcatgagccaccatgccctgctgatttttgtatttttagtagagatgaggtttcaccatgttggccaggctggtgttgaactcctgacctcaggtgatccgcctgcctcggccccccaaactgctgggataacagacgtgagccacggcgcctggccagtagagatggggttttgccatgttggccaggctggtcttgaactcctgacctcaagtgatccaccaacctcggcctcacactcctgctgggattacaggcatgagccactatgcccggccaccttatttaatatatattgttgattcattaacattgaactcagggtcagcagcaccataacttatgcctcagtgaagcttatctaaaacatgcattttctctgtgaggcatatattacaactttcttgtgcttagggacacgagacagcactgtggtactgtgcttaggggccatattatacagtcaaatcgagaaaaatgagaaaaacagagcaccaagtggtctgcaaaaaggacgcttacactgtgagagctgagaaggcagtgtcttcttgtttgacttcagctgggaacatacatattgggcgacacacatttttggcctttcctcttctgtccacaactgactgcagacatgctgtgactgttgattttggagttacagataaatataagtgaataagtgaatttgcaaatatggaatatatgaataatgagaagtgagtgtacctgtttacaggtcattagccaaaaccgggccacatggcttgttcttagagtggccagtgcccatgagggatacattttttttttaagtttagattaatcatgatttattccccggctctggcaatctcctctccctgaaatcaagagttctgtgtttgctacatcagcaaatcacagtatttcttcatgctaggaaagagtggggtggtttttgggtaaacaatggacagtgcccactgtgtttctaattaagtgcttggcatttggaagggggtcagtatatttttgttgaaagaatgaatcagtgaatgaatggcagggttgttttgtggaatagcctttaatttctgtcatatcttgcttgttaaagatttctccatgtctatattttcaaacaagtaatgttttgattgactaactccaaatcaaataaaagttaatataaaagaataaagttttactttatctgggtgaccttcaagttcatataagtcaaagaaaatgataaaatatgaaccatcagatgaagttgagacatcttttcagaaaaaggctgagcaacccaagttccatatggcaaaagcttttcttctttttaataacggtttcttttctgaaatgattgctttttatattgtggaagatattaaatccagaactattagatttttgtatttagcatatgatactgattttattattgtaagttgtcagcttctcatgttatcaaaaactaagaaatatttcatttgataacatcctttgtagctaatgccagttagaaataaattcaattaataaagaatatttaatttaaattatgtttgaataaagtatatatttgtgtttactattctaaacattggaataaattgtaattaaagctgacatacctatctgtctgtctgtccttctctctatgccctgcgttagactagacacaatttaaggctgttaaataatacatatttccttttcattaatgtttatgtttatttgatcatggaagtaaaataatcttgttatataaaactgaaaaatggaaaaaataaaaggagggggaaatcaccccaattcgtatcatttaaagaaaaaaatcaatattttggtctatttcttttcagtcttttttttaatacattgaaaaaacttaattttacaatgtatatgtgatatgaaaattccttttgacattctaggtagcttttattattatgattagaatacctttaggggtggatacatttattcattgcctgtagatggagagcagtaaatgaagcagccaggcttaaagtacagttctcttcagttctcttagaatttttcctcctccttgtactttctgtatttcatacttgagagcatgttgggcctgactccaaactttatggaaaatgaaatgttcttatacattctaactccctttttgttatactgcattttctcctctctcctgacctcaggtgacccgcctgcctcggccccacaaagtccttggattacgggcgtgagccactgcagctggccagtagagatggggtttcgccatgttggccaggctagtctctaacccctgccctcaagagatccacccacttccgccacccaaagtgctgggattacaggcttctttctaggctttttaaatgttcagcactgttatctcctctttctgtacctactctatgcaaaatctctattcctaaaatctcagctaagtggaaaaaggaagtaagattatctgaataaattaattcatactaagtgcaaatgacttgtagtcatagccttttagagggatgtctatacttcatctcaaggtattcttaaactctctggctgctacagacatgtgctaaaaaaatagaataaaaagatatgctcaaactcagatgggtgtttgataagaaaaatatctgagtggtattttagggccatggagagccttctcttgggcatacaacatgctcactagaggagggtcagcaggcatcaaagtgcttgcaccaacccccgttaactgtcgttccatggctatcagcagatgattgacctcttaataaaaatcgatgagaatttgtaattaattatagtgcacttgcagctgtaacatttaattccatgtctcttaaggcctcttctttgaaggtttctttacttaggaactaggcagcatgctagtctttctttataaacttaaagtgtcattttattttccaaaagagagaatgaattaattgagattttgtcattgcttagttccaaggagacttgaggcaatttacagttaaaagttaaacaaagtattatacataattgtaaaacagaagagcaaatatttaaagcaggcagaaggagaagatggcttcaggcctcttaaatgaacaaacgactccaattagtgaatttagcttttgattttcccacccccgaagctgaagtggaagcatggtgctgatgtgttgttttctaattggaggaagtaagagagagaatttttctagagtgacaaaatattttctggaactgaactcaaggtgggcatctgttgccattttgaaggcttacgtcatagtatgttatgaaaatattgatcaaatattgttataccttatttgaaattttacccatggtactttttaaaaatgtatttactgtgatatttgtactagcaatagttatacacctaaagggtgtttgatttcaatctttgggaaaaatcagatttttttcttcttcctcattttttaaaaattattttagatttcaagaagacttagggaaattgaacacatctcttagatgatcagagttgtgttactagactagactgaagaggttgcttatttagggacgggtgttgttactagaaaaaacttccttttctgcagttcatcttggtcacagctttctccagtctactcactgtgctccacctgaaaaacaagccagtgtattttaataccgattcttaattcacttatttccaatgattagctgtccgagtgacttacaacaggcagtgtataatcttttaaatactgttagtatgatgaggagagtttagaaccgtgttgttataaaacataaggaccctggcgttttaatttgctccttagcttgttacagacattaccttgcctaaagcaaacagaatgttaggagttgtaattgccttttaatattattgaatatttaatagtcttttcaaatttcatttctacaaatgcaaccttcaaaaagcatttttacaactttaaagttggagcttcttgaattagaccactttgaagtcagttattctgatcacattaaaacttatgacttcagtgaatgtagattgaggtatcaaatacttaggatactagtcaaaatttgaaattagagccaagtagtctggctacatgtgggtttcaaaaagtggtattaataaatggtctgtgtacctgtgtggagatgacgacatttgtgacacacgtagatgtagcttttttccgtttttagtaaccatggaagtgatatagaagaaacttttctgatagagatggacaaaactatcctgaacaatttgagaatacacccagcagcctcagttttaactctgcactaaatactttgcttggtgctgtgttagcaggcgctccatatagattatctcatagtttgccttgcagtcccgtgagtaagtcacttattcccactttgcagaggaggaaattgaggctacaagatgttacaagggtacgcccctagtaagtattgcaggttttgaaccctaaactactaaaaccttttatttccttgtcccccaaaatagtcctaccattctctgccactcactctttattcatcagaaagtgacatttccttcacctgaactggggtcctgtatagtctgtgtcacttctcaaaaaatggttttgtattatggttcattctgcaagtgatgtgtgttggtctgcctttcttgattgccatctccaagaagcagtgactgcattaccctctccactgtcatccacccgggacgttatgcgatgatgcccatggtggccggttgctgagcacttgttgaattcacacctggggtttgtgtttatcagatggcacaggctccacaaggatattagctttagtttagagggttgcagacagtggaaggggagtactcaagcagctggtctgcctctcggattctaactgggtccacatattttgctgtgcttttcccaaagtgctggatttaaggtgcttgtgtttctcctaggaaggtatggtgccagtgaagtatagattaattttcctcgaaatactaaccattacatttttttttttgttttatactttgtgttagaaatgtgaaataagatgaaatggaatgtagaaaaaggaatcccaggctgggtgcagtggctctaatctaatcacgcctctaatcttagcactttgggaggctgaggtgggaggattgcttgagtccagaagtttgagactagcctgggcaacatagggagaccctgtctctacaaataatttaaaaaattagccaagtgtagtggcatgcacctgtggtcccaggtacttgggaggctgaggtaggagaatcacctgagcctgggaggtagaggcttcagtgagctgtgtttgtgccattgtgctccagcctgggtaacagagcgagaccctgtctcaaaaataaaaaagaaagaaaaatgaatccaaatcaattctattttcctatgagtctgtacaattttgaccacatctactggtgtgtgttaatagccatttgataggtggatggtgggtgtaatcacttcaatttttaaaaattctgaaattttcccaaaaataactaggaaaaatattctaaggattataaacattcaaaggtttataaaattctgaatttgtgtacagtggctaaactagttaatatattagtattgtttaatctgttagtactaagatatttcagatgatatctagaaacatcttgaaagtttgcaatttaaaaatcttaaaataatagtaaaactgtgatgataatgagtaatagttaccgagcacttctgtgaaccaagcatgatattaagtttttaagtttcatttaaatctcagggcccatgtaatgttattattattatttatgctcattttagttcagtggttttgagaggttaaactgcttagtattacacagctgctaagtggttgtattagtcagatttctctagaaggacagaactaatggaatatctatctatctttctatctgtatatatgagtttattaagaattaactcacatgattacaaggtcccaatataggtcatctgcaggcggaggagcaaggaagccagtctgagtcccaaaactgaagaacttggagcctgatgtttgagggcaggaagcatccagcatgggagaaaggtgtaggtcgggagactaagccagtctagccttttcacgatctcctgcctgctttgattctagctgtgctggcagctgattagatggtgcccacccaggttgagggggggtctgcctttcccagtccactgactcaaatgtttatctcctttggccacaacctcatagacatacccaggaacaatatgttgcatccttcaatccaatcaagttgacactcagtattaaccatcacagagacttttaggtaattaagacatgttactaggaaggagctctgaataatgagttgattatataggaatgtgttgtagatgaatttttttctctataggaagtttaaagtggattctgtgggtcccagggctggggggaatttgggagtcactaggatttttttgttttctatatccattccaggaaacttccttcctactgtctggtaactggttttatggttttagcacagagtttctaaacatggacatactctttccctctgacacccaagaaggatagagagatggtccctaagatagtacccccatagttgagatttgagtgactcaattaatttcacgccccacttcttaaaaatttcttagagatggttgttcctgctatacccatatctaagtttttaatttgtatactggaagactgaagaacaattaattttgcccagtttttattttctttttacatttcagtagcttaggctgttggagaaactaattatggcccagcctatacccagaagagaggacttaacttgtgctccatgaaccactgtgtctgggacactgagtaacctaagaattttctttgatatgacactccgttctctagagtcaggtttgtatgaacaagtgataggggattcctttttgctttttttgaagagggtgggttgctaacgatcccatttattttggtaaaaaataatatcaatatcttctcttatttggtggtacaatgctaatattcatctttgaaatgaagggaaaaaaggtaaaaatcacttttctctgactgatacattcctcacttatttttttaagattattttttggctgggcatggtggctcacgcctgtaatctcagcactttgggaggctgaggtgggcggatcacttgaggccaggagttcgagagcagcctggccaacacagtgaaaccccatctctactaaaatacaaagattagctgggcgtgtttgtgcacgcctgtaatcccagctactcaggaggttgaggcataagaattgcttcaacccgggaggcagaggttgcggtttttcattcagaaactccagttctggatcgactttttagacaaacactctgcaaacagcatgttctctacctttctgagaccaccatactttgccttaaaatatgcacaatttctgtcatcttcaaatttagtttatatttattggttgcacaagagaaacaaaaccaaataattttggagttggaagaaaacttatctaactccttctcttttgcaatactggaaattctcttacctcatgtctagcaaatatacttactactagattctccttaaacatgtcaagtcactgggaaccctacgcttctcaaggcattgcattagacttctgaacagttgctgtcaccagaaaaatcgttacaatttaggtaaaatctgccctcctctaacttccattcactatttcttgttttagcctctgaagctacctaaaataagtggtcctttttctataaactgctaattaattatgtttttgatttgacatagacatttctctttttttccccaaaaaatacggctttgttgttcaatttgaaatgacatgtggtgattttttttttttttttttttttgagatggagtctcgctctgtcgcccaggctggagtgcaatgacatgatcttggctcactgcaacctccacctcccaggttcaagcgattctcttgccccagcctcctgagtagctgggattacaggcacacaccaccatgcctggctaatttttgtatatttagtagagacagggtttcaccatggtcaggctggtctcaaactcctgacctcgtgatccgcccacctcaaagtgctgggattacaggcgtgagctaccgtgcctggccaattttgtttttgagatgattctatgctccccaagcgtgtcactgaggttgaaattacagatgtggccctcttgcttttttttttttttaagagaaaaagaaggttttctcgtactgtctggtggctgtgtttctgctgacctcctgttccctctcactgctgcccaagtattttctctgcaggggagcctgccagggggctgctgctctgaaccatgccccaaagagaaaagcagtaacatatcaaagtttcagtagttggtttaatcaagcacacatcacttttttcttggactcaacttgccttttttttgaaagtaagaatttagatttatttatttagtcatttaatatgtaaaaacaatcccaaacatttaaataactcatgttaaggaattgccatcacaccttaaatgacacataaattattcaagtactctgaattatcttgttagttagtttaccaaacttctgtgtcaacatttattatagcgtttttttggtagctatgggagggaggaggaaatgaaggattgatatttgctaggtgttcatcacctgagcttcttaggtatcttgattctgctcgttattttttaaaatcaagaacaaacattttgtatgtacttgtggatctttatttttagccaacagacatagcctctgattaacttagacaagagagagggaagtgagaaaatctgaggagccaggtctagggaaggcagggttcagagcagccctggggaattcatcttaaagaggtttgctaaagaaagaaccctctcccagttttggctgcggttctcagattggcttggcattctatgctggacagcttttggcgatttggggcctccttgtttacaggtctgttggaagttaagttgccttgtttcctacaataaagatactgatttaattctgctctcagaaccactcatagttttttccacccagtcatattttgaggtttgttattgatgttttccagggtggggagtggtgattaggttttactgtcctactttttttttatggggagagtcgaggagattaaaaaattacatcactgccatcatttccccagaattcccttgtttttaacccgactgaatcttgagtaatattcttatattcctaattttttttttttttttttttttttagacagggtctcactctgttgctcaggctggagtgcagtggtgtgatcacagctcactgtagcctcagtctctcgggctcaagccatcctcccacctcagcctcccaagtagctgggaccacaggcttgtgacaccatgcctggctaattttttaattttttttttttttgtagaaatgagggctcactatgttgcccagactggtcttattcttatcttctttatctacttattctttatcttctagatctatgaatttctgaaagagaatttataatgtctaactcttatatggtacctgctgtattccaggccctgctttaacttattgtatatgggtcattttttccttagagatctgtgatgtatactttatagattttgagactgggtatattggttactttgtatgtaacagttggtgatggaagtcttttgtcactgtgtattggctttatctctattaatgcttttaaccttcaagtctctttttttcagaaacttatgtagttacacaggctttttttgagttcatatttgtctgaactatccttttcattccaccattgcatgtccttttgtttgaagtgtgtctcatgaacagctaagtgttgacttgattgtatccagtttcactgaagaatggtagtgtggtgtgtggttacaatcaagaactctagggcccgattgtttgggtttggcttgttgctggagtattgatacctagaagctagagttctgcacttgggggtggatggaattttttgatgttgctttatttagacttttaaccactccccatgttttacgtcccataactcacttctgttctttcaggggtgaggtacctgatgtattcaagttctgattctctataggattccgtttttatcctttcagtatcacctgccactttcactttatggtgtgatgccttagcagtgtgtactactccatctactttttatcttttgaaaacgtattgaaatatctctaaagtcggcataataagactgcttaccttatacagaactgtttcaaatttagtgtgagttaatagatgtaaagagcttcgtactgtgcctgtcatatcagaagtgcttagaaagagctgttctgttttgtcattgatgttagtattataggttgacttttagagcccttgaccaccttgaaactatacacagtcccgtctgatccttgtcactgtgaattttaccatcagatttattgtttttattttacaattcaggtttttttttttttttttggcttacaaccacacgcatttattaccttacagtcctggagctcacaaatctgagatgagtcttatgggactaaaatccagatgttggcttcctctgggaagctccagggaaaatctgtgtccttgccttttccagcttgtcctgcatcccttggttcagtgtcttcctccatcttcaaagccagcaactgaccatcttccaggttctttttctcagatcccagcaccacattgacttctctgactctaagcctcctgcctctctctctttttttctttttcctttttatttatttatttttttattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcacagcccttaatccattcaaccctgagtggacacagcacatgtttcagagagcacagggttggggggtaaggtcacagatcaacaggatcccaaggcagaagagtttttcttagtacagaacaaaatgaaaagtctcccatgtctacttctttctacacagacacggcaaccatccgatttctcagttttttccccacctttcccccttttctattccacaaaaccgccattgtcatcatggcccgttctcaatgaactgttgggtacacctcccagacggggtggtggccgggcagaggggctcctcacttcccagtaggggcggccgggcagaggcgcccctcacctcccggatggggcggctggccgggcggggggctgacccccccacctccctcccggacggggcggctggcctggcgggggctaacccccacctccctcccggacggggtggctgccgggcggagacgctcctcacttcccagacggggtggctgccgggcggaggggctcctcacttctcagacggggcggctgccgggcggaggggctcctcacttctcagacggggcggccaggcagagacgctcctcacctcccagaaggggcggtggggcagaggcgctccccacatctcagacgatgggcggccgggcagagacgctcctcacttcctagatgggatggcggctgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgaccactgagtgaacgagactccgtctgcaatccctgcacctccgggaggccgaggctggcggatcactcgcggttaggagctggagaccagcccggccaacacagcgaaaccccgtctccaccaaaaaaatacgaaaaccagtcaggcgtggcggtgcgcgcctgcaatcgcaggcacttggcaggctgaggcgggagaatcaggcagggaggttgcagtgagccgagatggcagcagtacagtccagcttcggctcggcatcagagggagaccgtggaaagagagggagagggagaccgtggagagggagagggagagggagaccgtgggaaagggagagggagagggagagggagagctataattcaggtttttaaaaatatctgcttttttgtcacccaggtgatttgggggagatagttaaagcatctcaactcagcatgtctaaagtagtaattgaattaaatggaattttaaaaccatttctcaggaggagtatattcataattaaactatatgataatttaagacaaaatttgtatatttgaagggtataaaatacttttaaccagtttatggactggatttgaatttgatatggagagatcagtatctatgaagtgaagtagggcacttaaaatggttaaaatagtgaattttatgttacgtatattctaccaaagtttttaaaaaggacatttttttgtgggggcggtgctgggggtgcgtaccacagcattctcctgtagtacatggagatctatgggtccagggccatgcgttattatttttttctctgagattctttttcttttttaatttcaataggtttttggggagcaggtggtgtttggttgcatgaataagctctttagtggggatttctgagattttggtgtatccatctcctgagcagtgtacactgtacccaatgtgtagtcttttatccctcaccccttcccaacgtttctcctgagtccccgatgtccagtgtatcattcctatgcctttgcatcctcatagcttagctcccacatatgagtgagaacatacgatgtttggttttccattcctgagttactttacttagattaatggtctccaattccatctaggtggctgcgaatgccattattttgttcctttttatggttgagtgttattccatggtgtatatatataccacattttctttatccatttgttgactgatgggcatttgggctggttccatatttttgcaattgcaaattgtgctgctataaatgtgtatgcaggtatcttttttgtataatgacttcttttccttttggtagaatacccagtagtgggactgctgaatcaaatggtagatttacttttagttctttaggaatctccactgttttccatagtggttgtactggtttacattcccaccaacagtgtaaaagtgttcccttttcactgcatctgtgcctacgtcgattatttttttgattttttgattatggccattcttgcaggagtgaggtggtattacattgtggttttgatttgcatttccctgataattagtgatgttgagcatttttccatatgcttgttggccatttgtatatcttcttttgagaattgtctgtccatgtctttagcccactttttgatggaactgttttgttcttgctgatttgtttgagttctttgtagattctggatatgagtcctttgtcggatgtatagattgtgaagattttctcccactctgtggtttgtctgttaactctgctgattatttcttttgctgtgcagaaactttttggtttaattaagtcccatctatttatgtttgcttttgttgcgtttgcttttgggttctttgttatgaagtctttgcctaagccaatgtctagaaaggtttttccgatgttatcttctagaatttttatggtttcaggtcttagatttaagtctttgattcatcttgagttgatttttgtgtaaggtgagagatgaggatccagtttcattcttctataggtggcttgccaattgtcccagcactatttgttgaatagggtgtcctttccctactttatgtttttgtttgctttgttgaagatcagttagctgtcagtatttgggtttgtttctgggttgtctattctgtttcattgtgcctatttttataacagtactatgctgttttggtgactgtggccttgtagtatagtttggagttggataatgtgatgcctccagatttgttctttttgcttagtcttgctttggctatgtggtctcttttttggttccgtatgaattttaggattttttttttctagttttgtgaagaatgatagtggtgtttagatgggaattgtattgaatttgtagattgcttttggcaatatggccattttcacaatattgattctacccatccatgagcatgggacatgtttccatttgtttgtgtcatctgtgttttgtagttttccttatagaggtcttcacctccttagttaggtgtattcctaagtattttattttattttatttttttgcagctattgtaaaagggattgagttcttgatttgattctcagcttggttgctgttgctgtatagcagagctactgatttgtgtacatcaattttgtatcctgaaactttgctgaattcatgtactagttcgaggagcttttggatgagtctttggggctttctaggtatacaatcatatcatcagcaaacaaacagcagcagtttgacttcctctactaatttggatacctttgatttctttctcttgtctgattgctctggctaggacttccagtactatgttgagtagaagtggtaaaagtgggcatccttgtctgatttcatttctcagggggaatgatttcaacttttccctgttcagtgtaatgttggctgtgggtttgtcttagatagctttcattaccttaaggtgtatcccttctatgccgattttgctgagggttttaatcataaaggaatgctgaattttgtcaaatgctttttctgcatctattgagatgatcatgtgattcttgtttttaattctgtttatgtggcatatcacatttgagttatggatgttaagccatccgtgcatccctggtatgaaacccgcttgatcatgatgaattatctttttgatgtgctgctggattcagttagcttgtattttgttgaggaattttgcatctgtgtcatcaggaatattggtctgtagttttaattttttgttaactccttccctggtttttgtactagggtgatactggcttcagagaatgatttaaggaggattccctttttctctatcctctggaatagtgtcaataggattgatactggttcctctttgaatgtctgacagaattcagctgtgaatccttatggtcctagacttttcttgttggcaatttttaaagaattactatttcagtcttgctgcttgttattggtctgttcagagtttctatatcttcctggtttaattttggagggttgtatatttccaggaatttatccatcccctctaggttttctagtttaggcacataaaggtgttcatagtagccttgaataaacttttgtatttctgtggtatcagtaatatttcccatttcatttccagttgagcttatttggatcttctctcttcttttcttggttaatcttgctaatggtctatcagttttatttatcttttcaaaaccagccttttgtttcatttatcttttgcattttttttgtttgtttcaatttcatttagttcttctctgatctttgttatttcttttcttctgctgcatttgggtttggattgttcttgtttctccagttttgtgaggtgtagccttagattgtctatttgtgctccttcaggcttttcgatgtaggcatttaatgctccgaactttctgcttagcaccgcttttgctgtattccagaggttttgataagttgtgtcactgttattgttcagttcaaagactttttaaatttccatcttgatttcattgttgacccaacaatcatccaggagcaggttatttaatttccatatatttgcatggttttgagggttccttttggagttaatttccaattttattccactgtggtctgagagagtacttgatataatttcgattttcttaaatttactgagacttgttttgtgccctatcatatgttctatcttggagaattttccatgtgctgatgaatagaatgtacattctgcagttgttgagtagaatgttctgtaaatatctgttaagtccatttgttctagggtatagtttaagtccattgtttctttgttgactttctgtcttgatgacctatctagtgctgacagtggaataataaaatcccccactattattgtgttgccgtctatctcatttcttaggtctattagtaattgttttataaatttgggagctccagtgttaggtgcatatatattttggattgtgatattttactgttggactagtccttttattgttatataatgtccctccttgttttgtttaactgcttttgctttaaagtctgttttgtctataagaatagctactcctgcttacttttggtgcccatttgcatggaatgtcattttccacccctttaccttaagtttatgtgagtccttatgtgttaggtgagtctcctgaagacagcagaaatttagttggtgaattcttatccattctgccattccatatcttttaagtggagtatttaggtcatttacagtcaatgttagtattgagatgtgaggtactattccattcattgtgctgtttgttgtctgaataccttgtgttttttttattgtgttattgttatgtaggtcctgtgaaatttctgttttaaggaggttctattttggtgtatttcgaggatttgtttcaagatttagagttccttttggcagttcttgtagtgctggcttggtagtggcgaattctctcagcatttgtcttaaaagactgtatcttacttcatttatgaagcttagttttgctgcatacaaaattcttggctgataattgttttgtttaaggaggctaaaaataggaccccaatcccttctagcttatagggttttgttacagagggggttcatagatatcatgcaagaaataattcagggtgagtccatagagtaaagtgaaagcaagtttattaggaaagtaaaggaacaaaagaatggctactccatagagcagccccgaggcctgctggttgtccatgtttatggttatttcttgattatatgctaaacaaggggtgaattatccatgcctccccttttttgaccatatagggtaacttcctgacgttgccatggcatttgtaaactgtcatggcactgatgggagtgtaacagtgaggaccaccagtgacctctggtcactcttatcactatcttggttttggtgagttttagcaggcttccttactgcaacctgttttatcagcagggtacttatgacctgtattgtgtgccgacttccagtctcatcctgtgacttagaatgccctaactgtctgggaatgcagcacagtaagtcttagcctcatttaactcagctcctattcaagatagagttgccctggttcacatgcatgcctctgacagtttctgctcagaaatctgctgttgctctgataggttttcttttataggctacctgatgcttttgcctcacagctcttaagagtctttccttcatctttgctttggataacctcttgactgtgtgtctaagtgatgagtttcccaggtgttctttgagcttgtatttggatgtctagatctctagcaaggtcagacaagttttccttgattattccctcaaataatgtttccaaacttttagatttcttttttttgtcttgggaacaccaattattcttagatttgcatgcttaacatagttccaaacttcttggatgcttggctcatttttaaaaattcttttttctttgtctttgatggattgggttaactcaaaagacttgtcttcaagctcagaagtacttttttctgcttgttcgattctgttgctgagactttccagtgcattttgcatttctctaagtgtttctttgatttctagaagttgtgatcattttttatttatgctatttcactgaagaattttcctttcatattctgtatcaggttttcgatttctttaagttggagttcacttttctctggtgcctccttgattagcttaataattaaccttctgaattctttttcttgcaatccggatattttatcttggtttggatccattgctggtgagccggtgtgatcttttggggggtgttaaagagcttgttttgtcatattaccagaattgtttttctggttccttctcatttgggtgactgtgtcagaggggagacatgggactcaagggctgctgttcagatacttttgttccaaggggttctcccttgatgtggtgttctccctcctcccccagggatggagcttcccaagagccaaactgcagtgattgtttttgctcttctgggtctagccacccagtggaggtactgggctctgggctggtactggggagtgactgctaagagtcctgtgatctgatggaggtagcaggggcgtgaagtggactctacaagggcccttggttgtatttttgtttagtgtgctggttttgtgttggttggcctccagccaggagttggtgctttcaggaacacatcagctgtggtcctacagggaggaagcaaacttgccctaaggtcgcctggttacctattcaggtttcttaggtggtaggcagggccatagagctcccaagagattatggcctttgtctttggcacccagggctggtagagaaagaccaccagggggcagggataggtgtgtctgagctcagattctccttggctggggattgctgcggctgctgttgggatggggatgtggttttcagtctaatggagttatgttcccagggtgattatggctgcttctgctgggtcacacaggctgccagagaagtgggggaaagccagcagtcacaggcctcatcccactcccacacagcccgcagtcctaaaggctggtctcactcccaccgtgcccccacagcagcacggagtctgtttccaggcagctggtgactgtggctgagaacttgccccagaccgccagcctccctgctgagcaagcaggcagctcacatcttttcagagtctcagggagcctgcagtggcgatacagttccttcagagggtctgtggattctcttagtttacctggtatgttgctgtggcagttgttggatcaaaagttcacagtgtgagtccccacacgctgctctgtctgtccgatcgggagctgcaagctggtcctgcctcttccccgccatcttctgtcagacaaaaggacttagtttttctatcagtgtctcacatggaaggttcaagaggaggctcatcagtgtgaaaatccaaatcttaagggactgtacataatggagtaaacagaacatacgggtgtccgtatgttgacttatgttttctttcttcaactatgtactatgtttcccactcatttcttaatgcagaattaatttttttccccacaggaaggaaaagctgatgcgatgctctcagtgccgcgtcgccaaatactgtagtgctaagtgtcaggtaagacttttcagccatatataagtgaagctttcaaattctttactcttaaatttgtccttcactatacctgttggcctgtgtctacttctttacagcctttaatttacttttacttgttattcacctgctgagtcacacaggttgccagggacattaaaatgttaaaactgatgttaaatatatatggttaaaaattgggtgtgtgtgtgtatatgtctactatgtgaaagtaaatgtctattcctccccatcttattgccccccgacttcaattctcatttccacaggcaatcactgttaagtttctcatgtgtctttgcagcatttgcttgtgcagacatatttgtgtatctacatcctatgtttaaaaaaaaaaagatatagtttaatctggcatgaattcttgtgtactttttttttttcatttaacgatctactttggggaacattttgtatcccatatgtttcattgtatgaattgaccataataataatttctttgttaatgaatgcttggcacttttctaatatttggtattgccaataatgcacttcacatcctgttttgcacattttgcacacttccccaaattattagtaggataaattcttattgtattgattgttgaaaggatatatgccttttgaatttttaaagataatgccaaatatcctgccaagagtttgagttaatttacgagtactgttgttaacatctttgaaattcttgaaaggatgtataattaacattcagcatgaccttttcttctaaccttatgattaatcatttaataagaaatgtaattatgtcctaatgagttacatcttattaaaagtctaattagaggttttgtgtctatgtcacttgcctcctccctgccaccctccactcatcctttttgtttcttatgttttgtatatgcacacacacctccagagtttcttctttccttcttttaaatttaggccatgcttgtctcaggggttttcttctctctcattttatcctttgaaagtaatttgagacgacacaaaaagtggtcttaatggaaaagaaatcaaaagttcaaaaatatcaggggttccaggttctcatgctaattctggcatttgctggttaaattatctcagggaaaacacacactgtgtgggcctcagtttctgaatctgtactaacaataagagttaatatttattaggcatccactgtgtgccaggcactgtattattccatttgattttccaagagtcttgtgagaattaggtactattattatttttattttattaataaggacaatgaggacagagagacagccaacttgccaaatattctgtaactagtaggctctgaagtttcaggaatgaaacccaggtattcagacttttaactgctcttttaaacctaaattctgttcttgctctaacattctgattaggtctagttttccattatatattgtattattcttttgtttcttggcttttgggtttttatttggggacagtcttgctttgtctcttggactggagtgcagtggtgttatcaagttcactgcagtcttgaaatcctgggttcaagcggtctccctgcctctgcctcctgagccactgggactacaggtacgtgccaccatggccaggtaatttaaaaaaaaattttaatggagacgagatctcactgtttgcccaggctgatgttaaactcctgagctctagtgatcctcctgctttggcctcccaaagtgctgggattataggtgtcagccactgtgcccagccagtataacactttctaattaaaataggataggaaatttcaaaacaataatattatttctacctcattttttaaacaaaagttttgtcgaagctagaaagatccctgatttatgtaagattgttaccaacaagagtaactaaaagcaaaaagtgaaacattaatactgctttttatacagtattcgttccagaaagcttggtttatggtgatgttctaggtgttttattcacgtgaagctcagctatttgtttctaggaacttcagattaaacagagtacatagagaagcgacagattatcatattatttgacacaagtctaggcaaacttgctttctaatctcaatgacctaaacagtttattaataaaacacttaataaacagtttacttaataaaacatttttttcccctgttttgtgactatttttcctctagtgccacatcatccttttgtagtacactcagggaagagaaaagccattatctgattagaatgagtagcaggagtttggtgggtgggtatgtcattttgattacctgtagtgcatgtgtttttactacatatattagctgtttactgtggcatcaataacaatgtcactgtcagatatactgtggaaggtaacaggaaaacagctagcaagatgaaggatatatgtaataacagctagagtatgtgtttgtgtgtgtggagggggagttaaagattggccagaacatatgcgtttaaactgctgtgtttatctcaaccttaaaatacaacattaaacattgtaattattgtggatacccacaaaactacgcaaaattaaatgacatactgaactgtgaacagtgatgaacagaacgcaaaagcacttggaatggaaattgaaacagaggatgtaaatctgtagtataaaatccataatatgtataccccagggggacatgattttggttcactagcttagcatttgatgtgtgggaccatggcatcaagttgtctgagagaggctattggggtattgcaggtgtaacatgtaccttgtgcccacaggatggtgtcagtgctattggtattcacatttctttctttatgtttttttttttttttttttttttttttgagacagagtcttagtctgctgcccaggctggggtgcagtggtgccgtctcagctccctgcaacctccacctcccaggttcaagcaattcttgggcctcagcctccccaggtagttgggactacaggcatgtgccaccacgcccagctaattttttctattttagtagaggtggggtttcatcatgttgaccaggctgctctcaagctcctgatctcaggcagtctgccagccttggcctcccaaagtgctgggattatagccgtgagccaccgcatctggtgcacatttcatttttaaacataagcaatacaaggatatgtttttattataaaaacaccatatagaatcatacagggtaaaacataaaagtctttccccagcttccttcccccgcttctacttctgtttttcagagataatccatatgtgtctattttatggatggaggatatacaccaaactattggtttatgcatcatatatagcgtacacatcgacatatgtatttactcctgtgtacagtactgtttctgttactggtcaaaatatttttgtcatcactggctttatattctggtctataccttattatcaggtgtctatcatataatttcatagaaggaggtccagtcttttttctctattgctataaacagaacatcacacatgattatgagatcaaagaggaggagcaggctaaaatttcttataaaaaagcattttcaaaacaaaaaatggcagcagtggtgatagcaagtaagtcaatttcaagtaattcaccaagtattattttaccttttgaggatttaatatgattgataatatatacatttctagttgaatgaattaattgctgagcaaaataaggagttaggcactccatcaaattgtaatttatatactttttaaaagcactgtattagcagatacaagctctattttatattgataattatagacctctttaaaaatgtgaatcgtatttttgggtttacattttatgcttagttgtggaatgatttgattcatattcgatgggtagaaaattaatcccacattagtaagcacttaacagagtgatttaataggctggttcttagactaccataaccaaagcagtgataatgaaggaagtcaagctttgtttacttcataaattcggcctgaaactgataggctttgcacggaatgtactgtagataagtcagctttgtatctaactgtcaacacaaagggagtactacatgaagtttaaaacgatttggtcgtatttcagtttttgacctccacaggtgtctggagccggaagtttttcttttcccactttacctttgcctgctgtgtgatgttatctgctcctatgacttcaagtggcatctgtatattaatccttctcaagactccgtctccagcctcctttctcctgatttccacttggctgttgcacaggcgtctctggtgtaacgtgtaaatctgagtacattatcttcccccagacccacttcccttcatgttttccagcctcagtgaacagtttcaccagccacccagcagtctgagttgccaggtgtcatctccgattctcatcctttcttggcgacagatccatttagtcatcatgtcgtgctgattttactattttactacctaaagatctgaattggttcccttctcgtcagcttctttagtactacctgttaccatggtctcttttctggattagctgcattgttaactacgattctttccaacttctaatttattttctacacaggagttagagtgattattatgctctaagtcctggtggttggtatgataagtaataggcagtgagcaagtaaataaggtcctgactttgataaagcttctgttatggagtagagagacagtgacaaatgcccatgattatatgattgaatgtgattggggtgagcacaaactcacctgtgagtaggtggatacagaagggtttcctgtagaggtgacatttaacctgaaatctagaattaatgtagctctttctgcttttcttttgattagtgttagcacggtatatctttctccatccatgtacatttaatctatttatatgtaaaatgggtttcttgtggatgacatatggttgggttttgtgtcttgatccactgcgaccattcctgtcttttaattgatgcatttagatcattgatattcaaagtgattattgatatagttgggttaatatttatcgtatctgttttctatttgttgcccttgttatttgttctgattgttgtctttcactattttttgccttttgtggtttcagttgagccttttgtatgatttcttttctcttcattagaacatcagatatagatatatctccttttttagtgattgccccagagtttgcaatatacatttacgacgaatccaagtttactctcaaataacactttaccactttacaggtagaatgagtaccttagaataacaaaatacttttaattcctgctccctctctttaaaaaaaattgttttagaaatgggatctctctctgtcacccaggctggagtgcagtggcctgaacacccctcactgcagacttgacctcctcagttcaactcatcctccttcctcagcacctcctcaaatagctgggactacaggcgtgcactaccatgcctggctactttttgtattttgtgtggggatgggatttcactatgttgcccaggctggtctcgaactcctaagctcaggcagtacacctgcctcagcctcccaaagtgctgggattacaggcctgagccactgtgcccggcccctgctccctctcttatgtcatttatttagcttatacataaacatacataattaaatacattgatgctattagcagtcttttgaacaaactattatctgttagatcaattaagaataagaaaaatgaaagtttttattttaccttcacctattccttctttgattctcattctttctttatgtagatctaagtttctaacctttataattttccttctctctacagaatttcttttaacatttcatgcgggtgggtctactggcaatacatttcctcaacttttgttttcctgaaaaagtctttattttcccttcacttttgaagggtaattccacagggtacagaattctagattagtaatttttttttctctcagtactttatttcattccactctcttgtacatggtttctgagaagttggctatgattctttgttcctctatatgtaagttgtttattttagtctgttttgtgctgctataatagaataactgacactgagtaatttataaagaaaaaaatttatttttattgtttcaaatttatttaatttgttttcaacatttattttagattctgggggtacatgtgcgggttttctacaaaggtatactgtgtgatcctgaggtttcgagtatgattgaacctgtcacccaaaaagtaagcatagtactcaaaaggtagtttttcaacccttgcacctcctcctccttccccttccttatattctccaatgtctgttgttcccatatttatacacttgtgtacccaattttagctcccacttgtaagtgagaacatactgtatttgatttcctgtttctgtgctactttgcttaggataatggcctccagctgcatccattttgttgcaaaagacatatatatatatatttttttttccgagacagagtcttgctctggcacccaggctggagtgcagtggcacgatctaggctcactaaaacctctgccttccacgctcaagtaattctcgtgcctcagcctcctgagtagctgggattacaggcacctgccaccatgtctggctaatttttgtatttttagtagagacagggtttcaccatgttggccaggctggtctcgaactgctgacctcaggcaatccacctgccttggcctcccaaagtgctgggattacaggcatgagccaatgcgcccggcccaagggcatgattttattcttttttatggcttcatagtatttgatggtgtgtgtgtatatatatatatatataacgttttctttattcagtccaccaatgatgggcacctagattgattccctgtctttgctattgtgaacagcgcagggagagacatatgggtacatgtgtctttttggtagaatgacttatcttcctttgggtatatacccagtaatggaattgctgggtcacatggtagttcaagacttagttcaagtctccaaactgtctccacagtggctgaactaatttacattcccaccatcagtgtataagtgaagagcggaaatttgttgactcacatttctggaggcctggaagttctatattaagatggctatatgtagtgagggccttcttgctgtgacatcacatggtggaagggccaggagacaagagggcatcaaatactggaattaatcctgcccatgaggacagagccttcatggctgagtcacctcttaatggtcccacctcttaacactgatataatggtaattaaagttcaacatgagttttggagggtacagaccttcaaaccattgcacacacctttcaagtgttttgagattttcagaaaatgacatattactgaaaccatttcagtatctataaacacctaaaacagacatatacttatctttagctataaaaatctggcttctctcagtattttaaaaaacttttgattttctgtagtttgaaaatgacatgcctaagtatagatttttggacttttatccttcttggtgttctctgagtttcctggatctgtggtttggtgcctggcattaatctgggagaacttctcagtcattattacttcaagtatttcttctgttccattctctctttattcttcttctgacatatcctattacacatatcttatacctttatataatcattccacagttcttggatattctgttttttttttataaagtctttttttgtctttgcttcttaatgttggtggttaccatattgagataatttcagctcagagattcttctctccagctacgtccagtctgccaataagatatcaaaggcattctttatttttgttggtgtttttgatctagcagttcttcttggtttttagaatttctgtttctatgcctatatcccctgtctgttcttgcatgctgtctccttttccactggaatccttagcatattaattatagttttttaaaattcctagtctgataattccaacatccttgccatatctgagtctggtactaatgctcgctctgtctcttcaaactatgtttttttgccttttagtatgtgacatagtttggttgtgtccccacccagatctcctcttgaattgtggttcccataatccccatgtgtcgcggtagggaccaggaccaggtggagataattgaatcgtgggggcagtatcccccatcctgttctcttgatagtgagttagttctcacaagattggatggttttataaggggcttcctgctttgctgggcacttctccatcctgctgccatatgaagaaggatgtgtttgcttccccttccactacgattataagtttcctccacagccctgtggaactgtgagtcaattaaacgtcttcctttataaattacccagtattgagtattttttcatagcagcataagaatgtactaatacagtatgtcttatagttttttcttgatagctagacgtgatgtaaaaggaaccactgtaaataggcctttagtagtgtgatggcaagatgtaagaggagaggaactgttctgtagttcttttttagtttgtttgttttttttgagacagagtctcactctgtcgcccagactggagtgcagtagaacgtctcggctcactgcaagctccgcctcccggattcacgccattctcctgcctcagcctcccgaggagctgggactacaggtgcccgccaccacgcccggctaattttttgtatttttagtagagatggggtgttaccgtgttagccaggatggtctcgatctcctgacctcttgatccaccccccttggcctcccacagtgctgggattacaggcgtgagccactgtgcccggccagttctatagttctatgattaggtcttgggtttttggtgagcctttgtccctggactgtggcattcataggtgtttctcagtttaggattggctagtttgagtaatatcaggggatcctggggtttaagggtggtctctgtttgcctggtacctggccctgggatgattaaggcagaagaatattgcctcttagggtgttagggccagacagaggatgtatggctgtggatcatttagtttgcctatcaaaggcatgctcaggattgagctttttgctatttcttagaattggctgtccctgggaggagcaggagcagtcttctccttagtcagaaaggtttttaaaatgtcaacacatcataatacaagttgagcatcccaaatcaaaaaatctgcagcgctccaaaatccaaaacattttaagcaccagcatgatacccaaaggaaatgctcattggagtattttggattttggatttttaggtttgggatggttcagccagtaagtataacgcaaacatttcaaaatccaaagaaatccaaaacctgaagcacttctggtcccaggtatttcaaataaggcatactcaacctgtattcagaaataaaaatataaaaactatagccctacacatatatggccagttgattttcaacaaaggtgccaacataattcaataatgaaaggatgatcttttcaaaaaattgtgctaatatgcacatggaaaataaatgataaaagtaaaaacaattcttcactagatttaataagatttaggttcaataagcttaaacttaaaggctaaaactataaaaccgagaaaacataggagaaactctttggatatggggtacataaaatttcctatgtagaacacagaaagcactaagcctccaagaaaaattgataaattgattttcatcaaaattaaacccttcagctccttggaaagacaaactacagacatggagaaaatatttgagacctctctttccccctgtttccctccttttctctttctctccctccttctctctctctcaccccaaccaagaagttgtttccagaatttataaagaatacttataattcagtagtaagaaaactgagtaaaacaggtaaaagatttgaatagatactttaagaagatatacattaaaagataatcattgtcactggtcaccagataaatgaaaattaaaaccataatgagatattactacacacccactagaaagactaaaattaaaaggactgactttgtcaagtgctggcaaggtgatggagcaactggaactcttgttcactggtggtgagaaagtaaagcgttatcattgttttgggaaagtttagtagtttgtaataatgttaaaggtgtacttactgtatgacccagcagttctgctcctagttatttacctaagagttatgaaaacttacatctacaaaaacaacttgtacataaatgttcaatgttccaaacctggaaacaagtgaaatattcatccacaggtaaatgaataaagagatgcatactgtactattacttgtccattaagaggaacaaactactgatgcatgccgcaacgttagtgaatctcaaaacactgtactgagggaatgaagccagatgaaaagaagtaagactgttctaggctagacaaaactgatcttacaattatagagacaaaaccactgagttgcctgggatggaggacttgaatgtaaggggcacaagggaacttttggggagtactaacatctgtagcttaattttggtgttggttatatggagatatatgtgtcataacttatcaaagctgggtgtggtggcacgtgcatgtaatcccagcactttgggaggctaaggtgggaggattgtttgaactcatgagttagagaccagcctggacaatatagcaagaccccatctcaaaaaaacaaaaatttatcaaactatactgttaaaatggatacattttattatacgtaactgtggtttttgccattaaaagtaattacttttgcaccaacctaaatataatttaataatgtaaattatatttcaagtaagtagtttgaaacatattggtcaccacagagctattaagtatgcatagattttatttctttttctgtaatacagtgatcacaatttttaagccactcaaagaattagactattgtttgaagaagccgttgtagaagggtaagagtcagggcaggaagaccaaataggaggctatagcaataatctggatcagagataatcttagcatcaaattcaacaagattctgtacattaaccttccattgcttactcaatcaagccaaaagtagagaaggggtgttttgagactctttggcatacagacttgtggttaattttctctttctcatctatttttcaattccattctaccaatgtatagtctttgattctagatcctttctggaattctgcttggcaggctgaccttccctctcagatgggactgtccctacatgtggcctctttgaccctgcttctgcagcctgtcctcttaccaccactttttcactctcaaatggggctaaccacatccttccctgccactcatccattgatggctgttccagttcactttgggagtaaaaaatttgataattacttgttttgaggaaataaaatacatgtgctcacctaccgtattcagctagaagctggtgttgatattttgattaatctaggatagatgctttttccaaataagattggaagtctgtggaagtgcatgatttattttgctttccagccaaactatcaattaagtcatttcgtcttcatatgatctctcattagatcaagcattggctaatttctgtaaagaactatatagtaaatattttaggctttgtggccatatgatttttgtcgtatgtgttcaactctgatgtagcatgaaatgaatgaatgtaactaataagtgtggctctatccctgtaatgtacaattttactaaaaatgtagcacgaattagaacgtacatgaatttgaattttacataaatgtaaaaatgtaaaatgaattttacctatgagccatatatttttggaaccctgcagtagatgatgattgacttactttgggggcactgttgttattattgtctcatattataggttcctcacttaacaggagaccgtaattcccatttgcccaagaaatggtcatttattcacgttctttttttcctcttgtcaaccttatgccctaagaccattttcatggcacattccttctttatatttagctctattcatctaatttgattaagactagtgagaagatgctcttgctctacatttgatacagcattcagtaagcttttaaagtgagaagtctcatatctatcactaatctctagtgtgctctaaagagatttttttgcaagatcttaatcaatacctgtcagtcaactgtagctgttagacaacctgcttagccttccagttttcttttcccagattccagcttttcagatctgcctgcatctgacaatctgtaattcaatattggactacatttcaaggataaaggaggaggcattatttatttgctatcaagcaaactggatgtaaatggaaaactgtcgagtatcttttatttcctgcaagttgcgtggcagctcaactatcctaagttttgcccataggaaacctctgtagatgattgtttgtgagtggagtaagtcctgaatatgtaggaaaaaaatcactgtgatatttcacgtagaagatgtttagttaatattatatgaaactgttgaataagtgggctcaaaaaattcattttcttttctatatttttaaagacagcttcttcatccttaatgaccaaatagctgaggaaaatactgttgcaaattttcaatgattgtaagcctaacccaagcaggtttcaaacctattttgacataattcagatatttgttaggaatggatgttacagactcagaattttatcattggaagactgccttgcagatctttgaatctaatcttcttatggaataaatacctagtgagctgatgtcatgaattggatgtattttacccaatccaaggttcaatacaggatgacccttcttacactctatcccaaacaataatgagctaccctaaaatggatatccactccaaccaaaacttggtgtttaacagcatttaaatgggttcttgagtgagcaatagggactttgtatgtaaagaggagagggaaatatgataatagtgcaaatgttattttgcgtaagaaagaaataaattgattttctcttattagtgtaacatctcatcaatacactcctttcataatcatgtaatcaagaccatctcttattggtcaaagaaagaattgtgagagtctactttcatttcttctttttgtatggccttaatttcaaataatgataatatatagtaaattttaccccctgaatggtactggttttagaataaatcataaaatatgtattgaacacctgtttcatgcaaggtgtacttaattggtactatactcatttaagaaaaacagacatgaatatagccaaactaataaaagaatttactgagtgaatctctgaattaaaaaagattgcatcagcattacagaacagttcactgaagcattttttaacatttaaaaattaacacatttaaatcatgctttgagttgcaactagatttccaaaataaacattaaaaagttaagaagcaccagtgcctattaaacagtaattttgctgtccctttcgtataaaagtacttctccctgattctcagttactacacataaaattatatttgtttttattcataaactccatgctctttgtagaaaatttaaatagtaatggaaagctataaagagaaagacaaaaatagcaatttcttttaggaaaagctggaaaagttaactttcagtattttaatcatcttctattgtgagcattcttttttttttccccctgagacctggggtctcactctgtcacacagactggaatgcagtggtgtgaccatggctcactgtagtctcgacctcccatcttagcctccagcatagctgggagtgatcctctcctcttagcctctggtgtggctgggaatacaggtgcatgccatcatgtctggctaactaaaaaaaatttttttttatagagatgggatttccctatgttgcttagggtggaacattcttaaatttatttctttatactatttaaattttttaaaataaattactttatgaataatatttctgtgtcaacaatatgcacattacaattttgatattcattaccaaatacccatcagaaagatcagagcagcctacaactctactaacaaggctggaaaatgcctatttccccaaatcctagatgcttctaaatactgccagttttattcatttttgccaaattaatgggacactatgttatctagtttctgttatcatgtctttgagcactggtgtggtttgtattagttgtctattggtttttctttttcagtcatgaatttcctattcatttcctttacctttatttatattttttgaaatattcaaaagttatttgtaaggcctttttgtatattggagacatttaacactgtgtctatatatgtattttagactgtttcatggtttattacctttaaaccttgtttctggttttcttcccccaagacaaaaattctttattgttatgtaattgaatatatatttattttcctttatggtttttacattttatgttctgtttaaaacactttttccaccttaatattatacaatatttatttctatagaacaatagttcaatgataattatagaattgtattttgtttcatctatttagtatatataacgacctcctttgtaatttagtttaactcagtggtttttcaactttagctactcatggaatgcccttgtcttgatctgtttttgtgctgctattaacagagtgccgcagactgggtcattcataaacaatagaagtttatttggctggtgtttctggaggccgggaagtccaaggttgagggattacatctgtaagggccttcttgctgcatcctagcatggcagaaggcgtcacatgacgggagcgtgctcctgagagggaacaagagagggccggactctcttttatagcaaacccactgttgcaatagtgacatgaatccgttcgtgagcgctgtgctactgaacgaccccacctctcaacatgttgcactggggattacgtttccagcacatgaactttgaggtacacattgaaaccatagcagccctgcagtgggatgcttgattctgtctcatgggtagtgtcagaatccctagggtgggtgttaggctatgtgtttaaaaatatattcttgtgtatgtgtgtggcatgtgtaactgtgtagcatttttttagatctgggcttctcagttcttttcagacccaactccccatttttgtgagaactatttttattgccctctctactatcttgaaatgaaattttacaggtagtgcaatatacctagttacatattttcaaaacattaatataatgccataattggaatataaggaaaaagaaaattaaaacctatgataaaataatatgtattttagtatataaatgctgaggtattagactggaagacatcattagtcacatatttgcacctatacatagagtcactgtgagaagggaagtagagatgcgggtcagaagccgtgttgtattggtaactcaagtactctaagtggtgttgccttcagtgatatggctttaattgagtaatttaggtaaaattcttaaaatacagtcttcctttgatttacctagaaaattcagtgctgttaggattatgtaaaaacgagctctttgtttttaaatgtaaaaggagatttagttctaggctcagacaattataaacaagttttccaccgtcatggaatttggttggacacttgaaagttgcattggatttggataattcttcattgtggagaactgtccgacacagaatgtctggctcctttggttcctgctcattaagtgcctgtaattttccataaaccttgtgacaaataaaaatacccgcataaatttctcaaacaaccctcaagataggcgtcactcccattgagaactactggtgtggttaatgagtttatgtcgtgaactgttataaatactataaaaatacattatgaaactgtatagattctgaagttgttttttgagtcatgcatgcactgaaagaattgtgttatagatgtcatttcctttttttccagcatgaaactcttgtctccttttgtttttacttcttaatgtagtattttaatttcctttgtctctcaagccagttcatgcttattgtacatcattgttaattttcagctatgacaaaagaaaatactacagccaatgttatgagcaaaatcttaattatatcctgtattggaagtaatgtaagaaaataggaaaaaatgtaaatcaggaaggttgtcttttgagaaattggcaaatatatatgacaaatgtgtcatcgaggtcttgaccaaggttagtttgttgagtgaagataatgccttttgtttttgtatgattgtcacgttttgcttcaaagtcaaaggagctgcgtaaaaagatttctttgtaagccttttctatggtatgcttgtattcgtaacccttatggtaagatgtgataggtgaagctgaatgataaattttaacagttaatgttttaaaaagaaaaggaatgggctgatatgtggtaccatattacagaccaattttaagtggtatgattgctttctctatttatgcctaaatgatctgatttggcttttcatggaaataatgaacatatttttgctgaagcaaatgagaaaataagtatgttttcaggcaatgatctaggaataagtttaagaaacattttgtctagtttctagttattgttgagaaaaggagctctatatcaattatgttaaggacctaaagttgttttaacaggaattttccaaaatttggatgtttaattccaaatgctgtcatctaactgatcggttgttcattatctggtgtacgttttgtacttatctcaccctggtaagctatcaggaggctgagctgctcaaatatttaggttttaacagaggggttatggatgatctcttgtaattaaaatgagcattgattaaaatctgctcttaaggtcttttgcctcaaattatctctgccttgttttgctgagtgtgagccctgttcagctggacactgaggcatttgaacagagcctaaggtactttctgatagacccactggcactatgttatccgttcctgcctacacgctctgtccatgagagcatctgacaggtttctcaacttctataatcaaaggaaaactaacgccaaagttatggttctcccttctatcagtaaaaaaccaaaaaagttaacattcttgtttcttgtgagtgcaaatgaatgtaaatttgttagcttaacccactcacatacaaagaccaggtgaaaaaaaatatatagatatatctgagttagtgaataccaacctaactctctaaagggtgacaataacaagcatgggaaactgtgttaaataatttatacacatttctttagtgcatagacttttagaacttttaggatgctaagtatattttgaatctctaagtagggtcaacatgatattgtgtttttaaaacttacttgacaattgtaccatgtatattttaggcctcttacacacattggtaattgctaattgctagtcaaggactagccccctgagcaacagaagcttgttctttcactgagttgtattttaatattatgcctttcagtgagtactgatattagaagtcatatgaaaggccattatagttgtgaactgttgttaaggacattgttcagtgtgttgattagcattcttggaataaatccctcctgtgatttaatacttggtgaaactgtatgtttttactttctgtcagttgaggattatataagccattatgccttcttttttgccttgcttgtaaggcatctcaaataaatgtgacgtacaaatactcaaatgtaatgcagaaattattcagctctcatgtttagcatgctaagaatttttactctctctttttgtatttgggcagtttgatagttagatatcagcttttgagcctttatttgtaatagagggataatacctaccatttggattgttacgaaaatcaagtgaaacgtgcttcgttatttgcttagccatgtatctagtaccttgtagaatgctaagtaaatgctagcgtgctttcctttttcccccttccataattttaatatgttctgtttctggttttgcagtcttatttcatacacatctttactttgaatcagctcagtcttgtttagaagtgagtgaagtgtaaatgctaaaacaaaaattatgaacagcacattgattttgtagacccagaaattgaggagcagatttataatttttgaaataagaatgagtaagtggtatcaggcatttcagtaatggaaattccaattttcagaatataacacgagagacatttgattgaggcttcttctactcaccagggctaaatattagatgatctggattttatttccatatgaaagtgattccgtgtgaaaggagccgtcgcctttctgatccaaggctcaaggatagtgtccttccctttagtccattcatctgtacattggcaactgactcaatggtctctttagccacatcaacacatggctaggatcatggcttaggtgaccatataatttgtcatcaaaaccagaacttttcagagtgaaaaggggcactattaatatttaagccaggacatagatacaaacctagacacatccaggacaaactggacatttaatgattttagctaatagttctttttatgttgcttttaaaacaaagagattttatatttgggggtgtgttagccctcctgatatttctgtagcagcacagaaattcagaaggctgtcatccctattttgagtcttctgaaccacgttttattttctaatttggagtgacattttccttttgtattcaaaatgactattgttgaatcctgtttaatcagttccaagaccatcttatacattattaagtaagctgtaatggctctttctttggactccactagccaggtaataaccaggggacaaatgaaagcacagaggtgaagctgaggcttttaatgtccttgcatagtaattgcatatttggcaaagactcatcctggattattttcagatttagaatattgcttttattttctattgtgcagttacatttggactattaaaatttaatgtttatgactcttgatgttcaaaaccagtataaatgaaagttaaattttaggtcacctatgttctccccactcttgttttaatagaaaaaagcttggccagaccacaagcgggaatgcaaatgccttaaaagctgcaaacccagatatcctccagactccgttcgacttcttggcagagttgtcttcaaacttgtgagtataaaactcatgaaatatagctgggttttggttaaataaacatatgcaattgcattttccggtatacctcagagatgttgcaggttcagtttcagactaccacaataaagcaaatattgcaataaaatgagtctcacaaattttttggcttcccagtaaatataaaagttatgtttacattataccgtagtctattaagtgttcagtagcattatgccaacagaacaatgtacatactttaattaaaaaatatatttctaaaactgctaaggatcattagacccttcagtgcatcatcatcttttcgctggtggatgttgatggctgctgactaatcaagtggtggttgctgaactttggggtggctgtggcaatttcttaaaataagacaacagtcgaatttgccgcattgattgcctcttcctttcgcaaatgatttcactgtaacatatgatgcctcacagcttcttcaccaggagtaggttccatctcaagaaaccaccttctttgttcattcataagaagcaactcctcatcttttcaagttttatcatgagattgcagaaaatcagttaatttttaatcagttaatttataattctttaggctctacttctctctgttttaaaaaaagttttgcttttattttagattcagggggtacatgtgcagatttgttacatgggtatattgcatgatgctgaggtttggggtatgatggatcccatcaccgaggtagtgagcatggtacccagtagctagcttttcatctcttgcccactccctgcttcttacctccccctcgtattccccagtgtctgctattcccatctttgtgtccatgtccacccaatatgtagctctcagttgtgagtaaaaacctgtggtatttggttttctgtttttatgttaattcacttaggataatgccctccaactgcattcatgttgctccaaaagacatgatttcactctttttaatggttgcatggtatttcatagtgtttatgtatcacattttctttatccattgtgctgttaatgggcacctagattgattccatgcctttgctgttgtgaatggcactgtgatgagtgtatgagtacatgtatctttttggtagagtgatttattttcctttggatatatacccaacagtgggattgctgggttgaatggtaactctttgagaaatctccaaactgctttccacagtggctgaactagattacattcccactaacagtagataagtgttcccttttctctgcagcctcaccagcatgtgttttttttttatttaataatagccactctgactgttatgagatggtgtctcattgtggttttgatttgcatttctctgatgattagtaacgtagagcatttttcctatgttttttggccacctgtatgttgtcttttgagaagtgtctgttcttgtcctttgtgcactttttattttcactttttgagacagggtctcactctgttgccccaggctggagtgcagtagcatgatcatggcgcactgcagcctcaacctctggggctcaagcagtcctcctacctcagcttcccgagtagctgggaccacaggtgcatgccaccacgccccgctagtttttgtgttttttccttttttttttggaaagacgaagtttcatcatgtttcccagtctggtctcaaactcctgggctcaagaaattctcccacctaggcctccccaagtgctgggattatataggtgcgagccactgtggtggccctttgtccagtttttaatgaggttgtttgttttttacttgtgaattgcttaagttccttatagattctggatattagacctttgttggctgcatagtttgcgaatattttcttcgattctgtaagttgtctatttactccattgcaggtttcttttgctgtgcagatgctctttattttaattaggtccacttgtcaattttgtttttgttgcagttgcttttgaggactcatcataaattctttgccaagactgatgtgtagaagggtatttcctaggttttcatcttgattccagctccttcgttcttgctatcacatctacacttacttcctctactgaagtcttgacccctcagtgttatccatgaaggttggaaccaagttcttctgaatcttctgaactccggttcatgttgctgttttgacctcccactggtaaagcataggcaaagtcgatttaccacaaatagtaagggccctggcattttaggaatggtaaatgaacactggcttcaacctaaagtcaccagctgcattagtccctaaaaaaaagtccacttgttctttgaagccaggcattgaattctctctagctatgaaagtcctaagtgacatcttcttccaatataaggctgtttcatctacattaaaaatctgttgtttagtgtagccaaattcaattattttagttaggtctcctggatcatttgctgtagcttctatatcagcacttgctgcttcaccttgcacttttttagatttatgtatgtatgtatgttttgagatggagtcttgctttgtcacccaggctggggtgcagtggcgtgagcttggctcactgcaacctccgcctcttaggctcaagcgattgtcctgcctcagcctcctcagtagctgggactacaggcgcccaccaccatggccagctaaattttttgtacttttagtagagacagggtttcaccatgttggccaggctggtctcgagctcctgacctcaggtgatctgcccgccttggccttccaaagtgctgagattgtgggcgtaagccaccgcacctggccacctcgtgcttttatgttatggagatggcttctttccttaaaccttatgaaccaacctctgttaacttccagcttctcttctgcaattttctcccctctctcagccttcacagaattgaagcaagttagggctttcctctggattaggctttggctcaagggaatattgtggctgttttgatcttctatatccaggccactcagactttctctagattagcaataagactgttgtgctttcttatcactcatgtgttcatgggagtagctcttttcattttctttcagaactctcccttgtgttgacaacttggctgtttggtgcaagaggcctgacttatggtctatatcagctttcaatatttctttctcactaagcttactcatttttctagcttttgatttaaaatgagagatgtgtgactcgtcctttcacttataggtcattgtaaagttattaattggcctaatttcaatattgttgtgtcagagaatacagaggcctgaggagagggaagagataggggaatagccaggcagtgggaataagccggtcggcggagcagtgagaacacgcacaacatttattgattaagtttgtggtcttatatggggatggtttgtggtaccccaaaacaattacagtagtaacattaaagatctctgatcacaggccacagtaacagatataataataaccaaaagtttgaaatattgtgagaattccaaaatgtcacacatagacacaaagtgaacacgtgttgttagaaaaatggtatggacagacttgttcgatgatgtaaatcttcagtgcaatgtctgcaaagcactataaagtgaagtgtgataaaatgaggtatgcctgtgttattcctatttaaggctgaaattaaccccatgttaatgtagaaggtagattattccagggagtgtcttagacaaaaaaatttgttcttttcctattaatcatggaatctgtagcagtgaagaaatacacagtctctctttgaaggccctgctatcttcttgtgggaataaagatggaggaggttctatctctgaggtatgagatggtagtaatctctgttacattgcctttataacttgggtattgtaaactaatgcacagggcgagcatgtcattttctactttcctcttcaaggaagatacacatacataattagtattgactggaagagtacttatcttatttcctaaaattcactgaagtgatttcttcggccctttttcataagtggcaaaacagtaaactctgtgaaatcttgctgtggtgaagccttttagatttttttacccatctttagtgtgaatatctttctcaaattattgtaggctcccgatttgtccttctcctttttttcttttttgagacagggacttgctctgttacccaggctggagtatagtagcacaatcatagctcattgcaagcttgaactgctgggctcaagtgattctccctcctcggcctgctgagtagctgggactacaggtgcatgccaccatgcctggctaatttttgtatgttttttaggcatagggtttcgccatgttgcccaggctggccttgaactcctgggctaaagcaatctgcctgcctcggcctcccaaagtatcggggattataggtgtgagctaccatgccccaccttttcctattgtttactgactcttttggccggtacacgattttatagagggttttatgaatataaaaatatgggaactttttgtacaagagttttgcatttggagattaaactgttgagtgaagatacaagttagatttttattttaaagttgttgattaattcagtctaatgagagtgatgaatagaaagaatatatagaaaatgttctttttgatggactttcatttaaatatacaaaggtactcaaacttatttgtttatatattggaacacttgaaattgttattggcgttttccccttttccttcacagatggatggagcaccttcagaatcagagaagctttactcattttatgatctggagtcaagtaagtgattgtctatcagcatcttaaaaaagtttctataatttgtttgctgagttggtgaatggatttatttttaactatgtttttctgtttctttataatgtgatgcaaacctaacaaaatttatttttatatacaactgtcacactggtttatttcacttattccagggtagcttcgtcctgataagggttagtaaagcgccatgaagatgttcaggttacatggggtagtgtaaccattagtccagttgacaaaatcatttttcttctttttttcttccctgtttcccttcttctgtctcttggtttcctgttctgttttctttttgatgtcagagaagagtgattagtgaacagggggattccacagagcttttagggttactgatcttttagacattaaggaaggtagaaggaacagatgactcagtctctgtggcagtgtgaagcatcattcttctctgaaactaccatgtaggtagccaccttcttgtgatgacttaaaaagcttcccatatctgagtgctaagcaaaggtaggtttcgttttgattttgtattggcgcagatccttttcgttaaggttgtaagtgatttcaactcaaaactagccagggcacatacagtaaatttgctgcacagtttaatacttctggatggagacaagaagatgatctagtacagatttatataaggttgtgggatctgaagttcccatggtaataaattattatttaagaaaagcaatggcaacaaaagcaaaaattgacaaatgggatctgattaaactaaagagcttctgcacagcaaaagaaactaccatcagagtgaacaggcaacctacaaaatgggagaaaatttttgcaacctactcatctgacaaagggctaatatccagaatctacaatgaactcaaacaaattaacaagaaaaaaacaaacaaccccatcaaaaagtgggcgaaggacatgaacagacacttctcaaaagaagacatttatgcagccaaaaaacacatgaaaaaatgctcacaatcactggccatcagagaaatgcaaatcaaaaccacagtgagataccatctcacaccagatagaatggcaatcattaaaaagtcaggaaacaacaggtgctggagaggatgtggagaaataggaacacttttacactgttggtgggactgtaaactagttcacccattgtggaagtcagtgtggcaattcctcagggatctagaactagaaataccatttgacccagccatcccattactgggtatatacccaaaggactataaatcatgctgctatagagacacatgcacacgtatgtttattgtggcactattcacaatagcaaagacttggaaccaagccaaatgtccaacaatgatagactggattaagaaaatatggcacatatacaccatggaatactatgcatccataaaaaatgatgagttcatgtcctttgtagggacatggatgaaattggaaatcatcattctcagtaaactattgcaaggacaaaaaaccaaacaccgcatattctcactcgtaggtgggaattgaacaatgagaacacatggacacaggaaggggaacagcacactctggggactgttgtggggtggggggagtggggagggatagcattagtatatatatctaatgctaagtgacgagttaatgggtgcagcacaccagcatggcacatgtatacatatgtaactaacctgcacattgtgcacatgtaccctaaaacttaaaatataataataataaaagaaaaaataaataaaataaaaaaacatatatttaccatcaaaaaaaaattaacaagcatataaaatagaaaaaaaaagaaatcattgggttattctgttgaataagtaatctaaaggatatgcatagacataagcaacagagttatgctgtagttcaacttgatgtatcttttcaagttttaaaagacagcaaagtattcaaattttcttgttatattactgctaggtaaataacatctgttaccatgggttttactcttcacattagccctactcagtactagtgtcatacacatgaccttaagtgaaatgctctcacatgttattaattgacctgttgtatcctttcagccttaacaccccatttgtggtatgattgaaaatgatatttaagggggtagtattggcgttagaacttttcttcttcttttgttttagaaccatctccttctgtttgggttgatgccacatcatatcttgttttttgtctttgttttttggagatggagtctctctttttgtccaggctggagtgcagtggcgcgatgttggctcactgcaaccgccacctcctgggttcaagtgattctcctgcctcagcctcccgagtagctgggattacaggcgcacaccaccacgccctgctgatttttatatttttagtagagatggggttccaccatgttggccaggctgctctcgaactactgacctcaagtgatctgcccgtcttggcctcccaaagtgttggggttacaggcgtgagtcacggcgccaggctcctttatcttgtttattcaactcagataacttgaagttgaaattgctgtgcttgatccctgttctattcatgatgtactagccatatgacaaatttaacctatttgaactttatctgaactttttagttcttattttctgtctttttgccttagaggtgatgctgtttattagtttagtcatgacctagttgtaaattatttcatggaaaagtctgcttaagtttactgacttaataagaactgataattgtttgtatgtgtgtacagaatgatgtagaaaatctggtaacacacaatctcagtgattttggttttaatgctttttcatatatgtgcgtacttatgttttgataggtgtttgatcttacattgcagacaaaatttggcagaatttaattgataacatatgcatcatatttagttgtcaaaagataaaacaatatgtatttgctctttgtcaaaatccaatgtaaggtaggaaatatctggtttaacagccagcattgaacacttgaaaattatccttcagaagtttactttgagattgtgctatttattttctctttaaaaaagatattaacaaactgactgaagataagaaagagggcctcaggcaactcgtaatgacatttcaacatttcatgagagaagaaatacaggatgcctctcagctgccacctgcctttgacctttttgaagcctttgcaaaagtaagtgttaagtttgctctttgctaattccatacatcaaccatttgctccttattttgttgttagttacaaaaatgtcgagaatcttgacaggaaattcaagacccttaatgccttatattacttccttatcatagtgagtagagcatgagagaatgtattgtgtgcattgagaagggtatgaatttttctgtttgattaatattcttgttattgcctgagtatgttcattgtgaattctcaaagtgtacccttggaagaaagagtatgctttcttttctcagaagaaaatagcatatcccattattttttgtgaatggacttgtttgccgttgcattgcattcattgagttttatggtggttgtttaagcatagagcctgtctttgaaatgaaaaatttattgaaatccatttcttttcttttcttttttgtttttagacagagtctcgttctgtcacccaggcttgagtgtagtggtgcgatctcggctcactgcaatctccgcctcccagaatcaagcgagtctcatgcctcagcattctgagtagctgggattacaggcatgagccaccacgcccagctaaattttgtttttttttttttgtttttgtagagacggatggtcttgaactcctgacctcaggtgatccacccgcctcggcctcccaaagtgctgggattacaggcgcgaactgccacgcccggcctcctgaagtattttttttttttttaaatgattccgagggtttatcttggcctagggaggaagagtgcgatgattgatttttttttttcttcactagcccataggcatgaaatgattgcttcttgatatttaccctgggatagggatgacagaaacaccccctcactgctatggatctgctgtcctcgctttctcacattgtgtgtttgcatttgttttaatgttgatcacaatttaataacaagtaaaactttacttttgacaattttgccacttattttgtaatttgtaagcacacgtttgaagatatatttatgccattaatattttaaggcatgttttaaaatttactgttttctgaaaaattaaatgtaattggtttgattgctggagatttattccagtttttctcaaatgtatttttattctgtatggtacatttttatgattttctgattaatgtcatcttagcattatattctggttatctataatttaaaattgatttcaaaatttactgatttcttacagtgcatctgaaaactttctcatctatttcatatgcttctgaaaattataacctgtagtagtatcgtgtgccgtgcccaaggctgttttcatgttcaacactataaacacgaacacctactgaaagataaaaatataccttatgatgattattacctcattcctagtgttaagtttgtggctattctgtggtaattatttctattgttggaaaatgttccagtgataattactgatgttattaatatccatgaaaaatattttaaaatactttctgttgctacatgtaaaatgtgaattactatcctagttcttctttctttctgaagattttagtctcatgtattttataatgaaattatctccatgttgtatagggggaaaattctgttgctatgattaagtgtaccaatttttaatataatgcttacccttctccccacataatatttgttattgctagaaaatacacagttttgagatttttgggcataattggccttagtgtgtcacttctgcattaaaatataggttaataatcagatgaaagcagccaataacctatggcttctgtactttctggtgaaagttttgttaatgtttttaatttgtatttttctgcttataaatttgtccttaaatcactcccctccttcccgcccccccaactccttctccctccttcccgcccccccgactccttctccctccttcccgccccccgactccttctccctccttcccgccccccgactccttttccctccttcccgcccccccgactccttttccctccttcccgcccccccgactccttctccctccttcccgcccccgcgactccttctccctccttcccgccccccgactccttctccctccttcccgcccccgcgactccttctccctccttcctgccccccgactccttctccctccttcccgctcccccgactccttctccctccttcccgccccctgactccttctccttccttgttcatgaaagatcctaaattaacctaaatagatcctgcagctttcagggatgagtcactgagcccagaatgttgacggtgtgtgatggtgcaagtcacatcaagcacacgggaactgggtgaagatccctgggcagagatttttatcccagtctactgctcctctcctcattttactctggtataaaattaattaatcaaagagaagaaacgggcaccataaaaaaataacataaaacaggattttgtttattgaggccaggtaaagccagccttcttcacagcgaaaattcaaaagtcagttcattaggctgtggaaagcgggtcaacatgcaactatccctgactgacagtttgtacatacagaggaagctgctgacttctgaatttacgctgtcaacaaggctggctatacctggcctcaataaacaagatcttgttttttgtttttcttttggttcctctcatttacattcattcaggttctgtgcagataatagacatactaagcttatgttttagcccatcttttttttttttttttttttttgagatggagttttcgctcttgtcgcccaggctagggtgcagtggcgcaacatcggctcactgcaacctccgcctcccgggttcaagcgattctgctgcctcagcctcccaaggagctgggattacaggcgcctgccaccacacctggccaatttttgtatttttagtagagacaacgttgcaccacgttggccaggctggtctcaatctcctgacctcggatgatccgcccgccttggcctcccaacgtgctgggattacagacgtgagctaccgcacccggccagttttagaccatctaattttcattgaaaggcatatggaattctgagagcttttctaaaattgcttatgtcttaatttttttgacttttaaattatggacattttcaaacacacacaaaaatagagggactagtagaatgaatcttcatgtttctatcagctggtttccctaattttcagactcattttatatctgtcatttttaatacttacagttcacacagatgttctttctcttcggagttttaaaccttcattagaattagtcttttcttaccaagtctcttgccctgctgagaggtgtttgttagttgaatctgaatttgcttagcaagtacagcagacttttatttatttatttgcaggtctagtgtgtacaaaatactcttgacacagggttgtagaagtatgtggctaattctaaatctcaaaattatctatcaaggcagaaaacttcagcaggtcaaaagtcttacttgaagaatatgcatatctttatcaaacttgcacttcccctgaaaggaaagggctcagggaggatgagaaagttcttaatcccgagagcatatttcgtcgtctggtgagctgatggctttttctaatggaagctcatgattattgcctgaaaagttggcagtttgtattttgaacactggagtttctggcggaaaaatggtgtgtctttcctgtcggaccgggttctcaatgctgaacgtgcatctgctgcgtaagccttaattttacctggaaaatttcttctgttacttgtaattttcccggtcatattcccagatattcctccttttcaccccacttcttagcaccagtgttagtctgactctgactcttagcaccagtgttaatacacacacaccctaatagcaattggagtttgattgtggagttttctatatagatatatcctgtccacttatgaatttgttgcctggctgtaaaaactgagtaacatgagccataggaaggaggaatttttctaggggtgggtgtcaaggaggacctcatatcagaagtggaaactgacgtaaatttcaaaagcgaggctggtgttgggaaacagtgatatacagtggtctagaaatgctgttggggagtgagggtgttgattcctccaacctcctgagggaaatatatcaacctcctccggagaaggttttcaaaggaagttgttacctgtggaatacagatttcagttatatttagtaattacagtagagttagaataagagcttgatgtttaaaatgtttgttttgcactaaatgtaatagaaagtgagggtagggatactcccagaatttctctagaggaggggatgctgagtgataatctgttggatggagaggctagagcaaattacttgcagctttatttggatagttttgttttttttaaaaaacttagattgtatgttccctggggagtgtgtggctgaacggagataaaagtgtaaagtgtgagcaatgaaaggtgttaatttccacagacagcaatgaaggtgttgaaaggataggaagtgcaccggggatatacagatgaacacaggagatgtgattatttatatgcatataaaaaataaaggccaatttcatctctgctggctctttttcacattgtttagagaagagaagatgtatgtctccatctctacaagctgtttctcctctctaccacacacttttttttttttttaaatctccacttccattttcaaacaaaatttcctttgagatttttttccccctctttgggaatagggtctcaccctgttgcccaggctggagtgcagtagcgtgatctcggctcactgcacctctgcctcctggctttcaagttgagtcttgtgcctcagcctcctgagtagctgggattacaggcatgcgccaccacaccgggctaatttttgtatttttagtagagatgggcttttgtcatgttggccaggctggtctcaaactcttgacctcaagtgatccacccaccttggcctctcaaagtgctgggattactggtgtgagccaccccacccagcacctgttagattttgaaatggatttattggtcaggcacaatggctcactcctatagtcctagcactttggtatgccgaggcaggaggatcacttgagcccaggagtttgagatcagcctgggcaacatagcgagatgccatctttacaaaaaaacttaaaaaaaaaattagctgagagcagggtggtacacacctgtagttccagctacttgggaggctgaggtgggaggattgcttgagcctaggaagtcgaggctgcagtgagctgtgatctcaccactgcactccagcctggactacaaagtgagaccctgtctcaaaaaaatttatcatggcatgacaaatgctgtgattcggtgtactgattgggtccgaaacatttgctacaaatatagaaaatgtatatactcctaagcataaatatatccttcgaaactcagaaaattacaattagctactcggtgtgctgagatgggaggattgcttgagccccggagtttgagactgcagagaaccatgagtgctgcttgggggacggagtgagaccccaactcaaaacaaacaaaaattacagttagagagaggccaaatttaaatgggaggctgaataatatgatggttaggtcattttcctcagtcaagtaaataaaattctctccatctcaattttcttatctgtaaatggaaatactaatatctacttcatagatttcaaggaggatcaactataacgtacttagtagtgtctgacacatattattaatttctactactgttgctcccacctctcagctttatttttattggattatagaactttggtgttttaaatctccctgtgctgtcatctagccaagagcgcagtctgccactgtttgtaaactagagtctcagatggttgctcacagttgtgcccagtgctggtgtctcttgagatcctgagaattacctgttttgttgagaagaaattttgcaaacaggcaatggtgtcttttcttgaggcttagtttcagtcatagccattgtggacagaaatcatgtactgttgccaacattcttagaaactccatggtatcaaagtagtttcttggaatttcacgtgggaaatgtaaaagtaggcttcccttgatgatggaaatctttctcacacatgcatcttaaaaggatggaattaagcgtgcttcagttgtcatgttctaattaattgaaacgccatggaatgtattgtatttctctattctatcccttaaaatgtccattgataattattggcaatggttattgatagtctcaacgtaatttcagtagaatttgttttgagattttttttatgcacataaaagatttctttagggattattgtacagagttctagaaaaatatataatttttttttctgggcttataactttcttttctaaaaatttatttggcagcctgattagaaatgtggtaaaatctgaacaataaaatagaaaatagactagttgcatagaatgtttcaaaaacaggcattagattggcggcaacaagaataaaagtgaccttcctgaccacagaacatatgccattgttagtgtttccggagctctgcaaagtactgctgaactttataatgttgtgcaactgccacagaatttttttgattagaaattccacatctgtttgagaagatgttctctccttctttctttcaaattaataattctcctggtagcatgttatttttgttctttagggcacgtatgtgacctccggagcttgcttttccaaaatctaatttttaattatattagctgtagctggttttgcaatatgtactggttgcatagattggaaagtgagtattttagagggtgtttttggtactatgatatttaaattttacagtttcattctgagtaaattattttttattggaggattcttttttttttaaattggagaagctgtgaaggtgttaaaacgagaatcttaccaattcacaatacgataagaaatcgcgatttaatattttgtggtatgttagaaataaagcaagagaaaatcgtgatactatattcaagattacatgcttgtgtttggccggtatgtgcctttacatttagagtgatcataaataatggatgtgatattctgctataacctccctcataattttagtgaagtatataaatcagcatggagggaaaattactaaatgacttttttgtgtatccttttcatcctctggtgaacagtgtacctcaataaaaagcgagaacaaagttgatcatgttatattcagcttttaagcttaaattttcagttctgttaaccatctcattctggatacactggtgctctgttacttcattgttgttggtgggctaatttgtgggaagagtattacctctgttgttttgaaaggtcaggagtgtgtatatgtttgtcacttgagggtttcaagttcatgtaggaccagattttagagccttttttgttgatgagctctgttgggtttcactgctgtagcctgctataaggtagtaaagaaagcaatcttttgaattaataaagtgatggattatctaattacaaagttgatgtgaaatggcagtatgataactttgactgcattactaaatgatcccagtgactgatcagatgtgcctgggttccattaaggaaaaatatgccattaaatatttaacactaaaagcgagcaggcacaccaggattgctaacctccagtcaccggggtgcttgtgtgtttacgtgtggtggtgactgctacatgccacatctctctactctgctcacaacagctgctagaatacttagctgttgggattatacttctcttctggtgttaagtaaagcaggcaaacagctaggatgcttaactgcatgcagatcctggcattctaattatgaaacggtgtcatgcatctatgatttatatatgttgtctttattacaacagattgaatctcgaagttgattcaggagacaattattctcagaaatatttctctaccttcaaataaagtgatgtttgtaggacacttgggctttcaaagaaaacaactcattgtttggatttttaatgatgatatttgtttatcgtgttcttcattcgtagccatttggttaaatatttcttttcacttatgtgttaataacctatgatgagttggtgtatatttatcatagttaaaaaccagatgccagctaaacttctgaagttgggaaggataattagtaagttcttaatcagcatttttgtttatacccgtgttggtcaaggttaattgcttatgtaaggctaatgctttgcttgaaagtattgatggataaatgtgtttgtcaagccttgttgctttatctatttaagtgtataacttgccattaatgcagacagaggtgatattttttaaatgtctgtatgacattatgaaatggcaaaggttactgtcattgctttggcttttcctttagtgacaacaatctactggaatactgtgtctctctactagaatgcaattacgtggagccaggaattacatcttatttattttgaattcctagcaaccttcattgtatgcaggaggtctttaatttttgacggattgaaggaatgtgagaaaacagtatcccttttccgttttgtggagcacactttgataaatgtttttatattttatttcatttcattaaaaaattatttttaaagacaggatcttgctctgtcacccaggctagagtgcagtcatgtgatcatagctcactgcagccttgaactcctaggcttaagtgattcccctgcccagctgggactacaagtgtgtgccaccatgccttgctaatattttgctttacttttgtagagacaaggtcttgctatgttgcccaggctggtcttgaagtcctgggctcaagtgattctcctaccttggcctcccagagggctaggatgacagacatgagccactacagctggcccagataatgtatttttaaaaattaatacataatataaatatatgagacttgacaaaaagaaacactaatatcatgataagattcaagaaatctagtaattacttgatagctctgactcatagagactgccattatactaagttcttcaaggaatgatgaataactatattaattattccaggtttgaagaacatttttctctaaaagctcacattgtaaatatttaggctttccaggcaggagacaaaagtgagtcacaactgcctcatgacaatttgtagtgtgtaaagagagtgctacttatggtctctgtggtagctgcttctttaaaaaaattattttaaattggcaaataaaaattatatatatcatgtacaacatgattttttgaaatacgtatatattgtggagtggctaaatggagcaaattaacatatgcattacctcacatgcttatcgtggcaactcaactctgccattgtagcctgaaaggccccgtgtacaatacgtgaatgaatgggtgtggctgtataccaaagaaacattgacactgaacactgatttttcatgtaattttcacatattcaaaaatactctttctatttctccccaaccatttaaaaatgtaagaaaacatccttagcttgcagactgagcaggtggtgggccagatttggcctctgggcctttatttgccaacccctgaattaacatttgtaagctggaaggttttttgcacacaattggaaataggatgtgctgggagaaaattctctacttaaaaaaggatcggaaatactttgttattttctaaaaagccattggttctgtcggtttacattgctggtcacatttctgagcacagtacacacacagtaattgttttttgagtcaatttttgttttactctaaagccaatttaattcaataatttaaaaatgttttatctcaatggtatagtaagaaaactgcaattattttactaaagagagaaagaaattataaaatagaaaaagcagggactttattgtcttaatattttaaactgtcattcttagctgtttcctttttttttaaatttttattttatttatttatttattttttgagtaggagtctcactttgtcaccaggctggagtgtagtggcgtgatcacagctcactgcaacctccacctcccaggttcaagcgattctcctgcctcagcctcccgagtatctgggactacaggccgcacaccaccacgcccagctaatttttatatttttagttgagatggggtttcaccatgttggccaggatggtcttgatctcttgaccttgtgatccgctcgcctcggcctcccaaagtgctgggattacaggcatgagccaccgtgcctggcctttaatttttaattttttaaaagacagggtcttggccagccacggtggctcacgcctgtaatcccagcactttgggaggccaaggtgggtggatcacctgaggtcaggagttcaagaccatcctgggcaacatggtgaaactccgtctctacaaaaaaaaaaaaaaaaaaaaccaaaacaacaaaaattagctgggcgtggtggctcatgcctgtaatcccagctactcagaatgctgaggcatgagactcccttgaacctgggagggggaggttgcagcgagctgagattgtgccattgcactccagcctgggcgacaagagtgaaactctctcaaaaaaaaaaaaaaaaacccatgaagacagggtcttagtatgttgcccaggctgacctcaaactcctgggctcaagcaatcttcctgcctcagtctcctgagtagctgagactacagacatgtgctatcatgcttttggttcttaattaaaggtgttatattttgttattttgttttgaaatgaaacataaagataaaattttctattagaaatattgtggttatgtaactcaggttcaaagtttttgtttgatttttcttagattgtggattattgccctcaaactttaaattatgatttggctgtttctattgcaaataagaaggacctttcatgggaggaaaaaacaaatatgttttagagatataatattaagagtgatgaaaaactgtgataaactgctctattaaattttgtaataggcagaaacagagtgttttttttaggggcaaaaatcagacattgccatttgatgtggaaaataagatgacttggtatatcataaaggtaagcaggcgagtttggggatggcttcgccaaaccagattcttttaaagcatcttaatcaaagaggaagagtcttccttctatcttcaaaagttgattttcattacagtttctgtgtttagtacctaatgttacatgtttaaagagacatattcaaataaatgtctatttacaaagcatgatgaagaaaggacaaaaatactgttttattatctagaagagctttataaccagagcgttccaacaacgtatcagcgtgtcctggtacagctggaagctacttcttcctggaagagtttcactgaggattagaattacgtgtcaggatgggttgtctctataaggtaggcctagatgatatgtaaactgctctttgaatttgtgagtttgtgatatttctggtgcatcatggaagggtgtagtttatcttccctcgccctctctattgaggtcctgcttattcttaaggtttctactcagatctttggtgaaatctacttggttaggattgagctttcccttttgtaaaatcagtagtcactgttattttctatgccaagcatttgacaactgtgactatcccctactttctaagttgtctgtccttttttcttaggttcccacttagactataaatttcatgaaaataggtcatgtgtccccattttcttccttaagcaaaataaaattatacaactttagggctgaagagatcacagaaactctctgataccatagccttcccattttttctcctctccctttctccagaatacatcagttgtggcttagagagggggaagtagtcacccagtgacaggaagaaagctagaactgaagtcttctgagttctgtctaatgccctttctgttagttgatgcccaagtgctcaagaacttagctgctaagttgaagtgaaaatgtgatacagcaaacagaagttaaattacagacaacctttcagcaatatctgtttcttatattgaagcctatctgtgtaaaggcagaaaattaaaaataagttacagaatagtatcgttcgacatttgaaactagattagcttgtctaatgatgagtttcaattcagagattctgtatgtccgtgtttaaatgattttggcttcccaaaccagctgtctgccttcccttcagataactcagttataaacagaactgctgtattacatatttgagtatgtggatttgtcttgtatttcccattttttggcccatactttccaggaagcaaatgagtattagacactggtacctgtcttacatcaacagatcaagggacaattggcggattgatcacaagtttcctagtgccgcactcctttgttttaattttttattctaccaagtactttaatgtgtactttcacattatcttctatagtagccctctgagttatgggtatcgtgcctttgtagatgagaaagtgcgtaaggtcacactatatttaagtaaaagagacagagctttaacatggctttcttcattccagagttcttattttctgcattccaccatactgcattctgtgttatattagttctctgttagagccctaattatggaccattataagccttagcaaaatccagaatgatggaaataagaatatttgataatattctctaatactaaagtattgctctaggcaaaactgtaaattatttaatcaggatttctgctatttttatccaggtggtacatcatgccttacatacctctgtccttcatatattcaaatctaaataaatgctggtagtttgagtgggaggagggtggattattcatgtcaaatgattctgtgctgatgttgccacaactgtatgtgaaaataaagataattgacatggaatttgcatggagttaaggtaccttttgaaatctgcattctacaatcttttagtactgcatattaaaacattaattattcaggagccctccagattgagtctttatcattttcaagccattattgggtgtgcttttccctatgattctatagatacatgcatttatagatttaaacattttctatgctataaactatatatgcagtgtataagaaaatactctttggccttattaacacctctttttcttttagtgatatttatttgaccttaacatttatacttgatattaatgacataggcaaataattttaaaatgttgtttttgaataaatacttgtcaagtaaaagaaaagcattagagctacatgtgaccagacttggcagtcatgggcgctatttcaagttttgattgacatttggttttcgttttgatgcttataggaaaaatttatcaagacactgtttatgcagagctgtttaattaggatcacctgaattaggatcagaattaaaaatatccttaatagaatttcctttccttccccgatgggtggcagcattttcttcagccaatacagcatctgcagaggcgtgtgtgacttgctggttggtgtcctagggtctgtttttcctccttcacaatcattcagtggctgtgggtctttcaggttagagcagaagttggtaaggtatattgtttgggggcctcaaaagtcttctgtaataagaagtgactatactgtgggttttcttgtttcccatttggccaagattttatggaacaatacccactttgcccaggtgcagtggctcacacatgtaatcccagtcctttgggaggccgaggtgggcagatcgcttgagctcaggagttggagaccagcctgggcaacatgacaaaacccatctctacaaaaaatacaaaaattgtggtggctcatgcctgtggtcccagctacttgggaggctgaggtgggaggatcgctcgagcctgggaggtagaggttgcagtgagccgagaacgtgccactgcattgcagcctgggtaatagagcgagactcggtctcaaaaaaacgaaaaacaaacaaaccaaaaccaacaatacccacttaaatctcaaggtatgcagatttgaggtgtgatagtgtttaaccttcggaagtcttttaacctgctcatcattgtccttctgcctgtctcaccagtttgttttaaaagttatttgctgatttgtctctggttacctgttgaatgacaatatggtgctgccatggctttacttgcctgcctgtgtttctgagctcatcccatattttctatataccaacaaaaatcttcatctatgtgacctggttttacttcagattcgtcgtgtgcagtgcctaaactctgccttttcttccgcacagcatactgcttctccacctttgctgtcttctctcttgacgttgcaatctcctgagccagccgtgccaggaatatcaggaatacctctgattcttcccccaaacttctgtatgccctgcttatgctgcttttaaagatctcttgactctattgttttatttttatattgttttgtcactgtcccagttattattaaaatccttccgatctcacctaaatggcctctaactcatatccttgcctctcactgtttccctgagtctcaattcatttttatattttgccattagagataattgaaaaaaaacccagatttgatcatttaatctcttgcaaaaagatgtctgttgattccctactgcctttgtatgaaatcaaggcttttaagtatggcatttgaggaccctgcaagcttcatctcatgccacgttcctggagctggctgactgcttgcatagactgcaagcagcttgagggtcgtaaccattttcctagcacctggtgtagtgacaagtagattgcggagattcagtgagtgtatgcttttcctccatggcttgcattatgctttcagtccttcccattgttgcattgcctttatgcctccattccttcacgttgcattgtcacttacattacgttttagctccttcccattgttgcattgccagtgtgtttcttcaagccaccaaagcttgacgatgcctgccgcactgttgctatgacattagcaaactaatgtccatagggtatttctctagatatagatgtctgtagggtatttttctagatagggaattatttttgaaaggctgggtatttttgaaccaattcgtaaagctgctcatatacacgaaggagggtcatgaaagcaaatgacaattcagcaaggcctagttatggctggggtgtgtgtgcgtgtgtgtgcgcgcgtgcgcgtgtgtgtatgcgtgtcacgcgtgtgcgtgtgcgtgtgagtgttcaaggagggtggttcctaaggctaatgagcttctacctgtaagttattctgatttggtagaaatgtagctttgaataataatcattagcagtagctgagtgggcttgtgctttgtcaacactgctgagtttgataattagatgattacaaggatgtgatgacattttgtaaatcctttcctggagatatctatatgagtttgctaatcattatggcaggcttctagcttttctttagagcaatgatgatgctacaaagattttttttgtgctgaaaatattttccttgtatcagtaagatttggatgatatttgtcactttctgccacctcagagtcagcaaggagaatcttgcaaagtatttagcattttgtggaaacaagacattatgttctgtatagttaaaaattatcttttagtttattggagtggaagggcattttctccatgacaaggaaggtttaaacttgcatcatcttggtatttaaaagttcttttgaaaacaactcatgttttcaattacaaaataatatagagctctcagtcagtgtgatcattctatagagtgtgatcattccataggtcacatatttactaacagtcttcagtattagttgagtaggctctttaaagccttactgttaggccaggtgtggtgggtcacgcctgtaatcccagcactttgggaggccgaggtgggtggatcacgaggtcaggagttcgagaccagcctggccaacatggtgaaaccccgtctctactaaaaatacaaaagtcagccaggcgtggtggcacatgcctgtagacccagctactcgggagactgagacaggagaattgcttgaacttgggaggcagaggttgcagtgagccaagatcgcgccactgcactccagcctgggtgacagaggtagactccctctcagaaaaaaaaaaaaaaaaaaaaaaaagccttactctttgtcctttcccctaaaactcaggattccttttcttcttccaagctttgctcgtacagtttcttcagctctgcctggcaaatttcgtttaaacatggtgccttttctaggaaacctttcacaactctcttagacatgtccattaggacaggaatgggaaagcagaagtgtaaaatataagtgggtaagagaaagggcagcaacttccattattttgctcctccagttaggtgctagtatcttaagctggccatttcatcactaatgggaagagctaaaagctccagtccatcaggattgaatggctgctgaaaatgaatgtcagtgtctcacctccagacattttggagctcttttcttccagtctattcgtgtcattctctcttttcaggtagacttgcctccgatttctcttgtcctctatgaagaatcaaaggattaatggtttctgaaaaaagcaggtcttgttcattggagctgccaagttactaattacttctaattatctttatagcaaaatgataaacatagaattcagtgctgtattgtacagcaaatttttttcctgaaaacattgcttataatgtttataaataatataccaggttatattaactaggaaaatttagagtttaacagggttctattatgaacctttttgtggaagaagatttattttggcaagctcattgctctgtcttaaaaacctagatttcctcatgtagtgtctggtattccataaagtaaagctcatttgcagtcagttaaatctttttcttttttcttttgcagagacaaatcattttttaaatggagttcaccagattcttagggcctatttgaacttatatttctagaattgggtgggatctgcctttctaaattataattcataggaagagtgctatggaattggctagtaaagactcttggccgtgaaggcaatgtctcagcaagtggcttcctcttttctaaaacctcattagtgtccttgggagcatttcattgataaatacctatcccacagtccagcttgcttttttctgaatgtaatttcaaagcccggtaacttcagtagatttttttgattgaccacagtagacacagagtatgagaaacaaaatagaatcctcaaactttctacctggtaaacagaggaagtaaggatagtgttttcaggggcattcattttcaggcagccattcagttctgacatgtttgatgtattggagtttttggttattctattcctgtttgtggtgaactctctagttcactataccttcgtctggctggaggagtatgataatccaagtgcctgcttttattttcttgtctgcatgtattttatatttctgttttcccatccatggcataatgtgatcatgtattttgataaatgcattgttttgctagaattgtagcctagtctgtgaaatgaaaattaaatgagaattaaacttttttttaacaattaagctttttttaacttttttttagtattgctagtattaaactttttttcacaattaaaaaatacatattggttttggaggcacctttgatgttctactaattatattaatacagaacggatgcttcttaaaaacttttagtgcaaataagcttttaaaatcttagtatcttaggcacataagtaattttcattttttagatggataataaaatcttactatcttaggcacataagtaattttacattttttagatggataataaaatcttactatcttaggcctgtgagtcattttacattttttagatggatactagtttaggtgcccattttgatgttgtttttaaaaatactgaccttacagtcctttccatctttatttttgagtgacagcagaatcccgagtataagaaaatgtgattaattctcccatattgaagtcatttaatcatgctttgcctaacagctgctttctattcagtacactgaacataaaattctggagtgcctttgtgctatcataaattgtaaatgtgaaccattcttcctcttaagtatcatatggtattgctgttttgaatttgtcagtttggtagggggtttttctagagattgctgttgtagtcggctaggagggccttcttctgggacgaaactctctccctcattctctatatcactgtgatatttagtattatattattataatatttagtattatttgtttgcagtaaagaagtgggggaaaattggtttgacttgtcatccttttatttctatggcatattgaaaaagtggacaaatagggccaaaacaaagcagtgggattcttacttggctcttttaggtcagaaagaaccagtttaataaatttcagttcaacaaatttgtactgactctattcacagcaccatgtggagaaataaggataattaagacttcatttccgccctgtctggtaggataaatgaaagaaatatataaataaatatagttatattgaagattcgttgaaagcaaaactgtgctgccttctttttgtaaatcttgctttccacgttcagtacatggaggtgctcacagtattctccagcagactgcgataatggtgatgcggagacctaagatggagatttggagtggggagatcatttgatttggcctttaatggaagatactgtaggtggaagagtcagtgctgacttcctagaatttaacagtcaccattgcaaataggctaccgaggtacctggagttgagattagatccttgtgactggatgccaaggagcttcttgctgctggttcatgcttgacggacgtgcctgttttgggttaggagcagttgatttcaggtttcccctgcaatttatgcctggggctgttctagtgagcctcacttccctttgtgagccctcctcgtgctgctttctcttcctgataagaatcccctaatttggccgggcgcggtggctcacgcctgtagtcccagcactttgggaggccgaggcgggcggatcatgaggtcaggagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcacgccactgcactccagcctgggcgacagagcgagactccgtctcaaaaaaaaaaaaaaaaaaaaaaaagaatcccctaatttatgagagcagggttcttcaaatgggaaacgtggctgtaggcctttgtttgtttattttgctttttgttttctgcttttcagaataaactgagaaggatttttagaaagacatgaagagaaagagccacttaaggtgactcaggatttgggatctcaggtggtttgagatctataaaagaagagagtttcaaaaaggaggtggccaatatataaaaggacaaattcagcactaaatacagcaattagaaattcagcggagctatttttcatgtggactaaaagtgtgaaaactattttatactccagagtagaagctgagtgattaggcttctcctgtttttaccaaaatgataagttgtttctcagaatatattgctctgaatgaaaagctgagttgttttttttttcattcttaagaaaaacccatcctcccctatgtttgaaactcaaagttacttccatctgacttgatgtcaggtcattggtctgaggatcagccagtgtgttttgaagtactgtatctcaccaggaaccacagagtcacttaaatcctacatgactcggcaaaatccttgtcattaggattggctttgccaagtcatttaggattagtaaacttgtgactgttttgttctgtaatgaaaatgtctagcgtgaagaacagaggtcaaaatgatcttatctgagcgagtttgcttcaattaattctttgtagtgcagagttttacaatattacaccttaaaagtggtgtacaaatttaattttggtaatacttataccataataaattggagatagaggtttatttttatgtattgtgtgatctcttaagtattatactaaagtactaaagtgactatccattgaaaagccatatctgttagtggttccaccatgctgttaaggtattataattttagagtataaaatatagttttattcatgagcattcaaataggaaaaatatatctgtcccagtttctaattttttttttatttcaagggaaaaaatggcacaaagtttgaagatacaccccgctgaatttttttttgagacggagtcttgctctgtcacccatgctggagtgcagtggcacaatctttgcccattgcaacctctgcctcctgggctcgagtgattctcctgcctcagcctcccaagtagctgggactatgggactacaggcaggcgccaccacgccctgctaatttttgtattttcagtagagataggatttcgtcatgttgtcctggctggtctcaaactcctgacctcaagtgatccgcctcccaatgtgctgggatcctgttgaatatttttaatgcagcttaaatttgtataagccttcaattttgatttgtaatgaagacaggagcagaaatatattttgtggtgccaccaagagagttcagcaaatccactgtaagttgtgtgagtacatggctcacctatcaacaatagctctttctaaacttgaaggtgagaactttagtaattttgctttgtcatggttgaacgctgccattagacatcaagagcaaattaaagaggagagttgggctgttaaatatcatactcatttattaagataagataatgactgaaaattgtaggacaagctaactttgtgtactttttgaagaaaggaaccttaaaatgtttttttattccttcatgttagattttgtaattaagaattctgtggtaattaatacaaagtctgactttagttagaatgtttctctaaatatgactatggaagcccatgtgttatttcaaataatcttcttcaaatagctatatttcctttatcatccttatttgtttatttgacatggtgtcacgttatccctctttaatattcatttttaagcagatttatgagaaaataccccttatctgtacattataaaatggatgcagcctgaattgaccattaacttttttttctaatgtaacaaagctgtgaaattagcatgattcctaatattttatgttaaaaagatgatttgtgttacattgaagataacaaggaagctcttctgctgaggcttgtgttgaaatgagattttctataattctattaaattgttgttggagttcaacatttttctggaagcgattctgtatcttcttgtaagattttagaataaaatatgaaacagaatctttaatcattgtttcactgaatgaggtctgtgctcctcaaaatgagtgctccgaaccctttcggattcagcattactgtgagagatttaggacaccttctcatgtaagcttatggcaacctcaggaaaagggacttatgttaggcaatagattgtaaagtaacacatgctccttattccaagtaatcgtatgagaatttagcttctatcttctgtgcctgttgcagggtgtaagaccaagcaggtatatgttagttgttcctggtgggctgtagcaagcaaggctgctcttaatgatggagtgcaggaacataaaaaatctcaacaaagatgaaagtttcatgtctcattggtagtttttaaaaacaaacaagccgcagcccacagaggtttatcatggggcttttcctctttacatatgaagttattaatttgtagcctatggctcagaaagcagcagaggcattgacagaacattaagttcaaacttaatgtcaagagttgtacagcgattaggctgcagggggtgtattttaaagataatggtgactgtgtggctaatgggataaatgcttgggataaagagaaaactccaaactctagcagtgctagtaagtggattttcatgctttgggcttgctttacttggctttgaggctaaacatcaaaatctttatgatacctttttcctctctattttttttcctgcttatgtattcattgaagtctatttttatcatattttcagttgctggtcatttactaatgttcagagaaatatgtacttttatggcatatgtacacattacattgaaagtctttcatgtttattatttttacaatgtgctttgaactagttttttaaactgaaataaatttctatatgtattatggctatgtccatgggaatgacttcaagttcattatattttgctgcctgctttatacagatttatactatttgttttgtacgtgtgctatataggagttcatgcaaatgtattttgtattatggcttgttttcttagttacgagcatctgaaatatagtatctttatttaatactatcacatacataaaactataatttcatttaccagtaaaattattatgctttgttctctgctaagtatttgttgacccaatatgtattacaaataactttgtgatgttatattttgtttttaggttagtagactatcattgaatatcctgaacttatttccaactggattccagtctaaagtagatgaacacaataattagtttccttctacaaaatcactttaaaatcactctcaatacacgtgttgtagaaagtattttttagtcaattgcctgccctagttctttgtatcactgggatgcatctgtctgcctgtgcatcttctgtgctagcaaacatgatatggacaaactgaatttttgtaattagaatgctattttaaatgtaccagaatgtacacttaaatagaatccaataataatagctgatatttattgagggcttcctatgtgtcaagctgtgttctaagtactttatcgctgtacacatttttctattgctgcataataaattactacagtcagccatctgtatctttgggttcttcatagattcaatcaccacaaataaaatatgtttgaaatgaaaaataacagtacaataaaaataatataaaatttaaaaaagagtataacaactaatttatatagtgtttacattatattaggtattataagtgtatagatttaaagtatacaggaggataggtacaggctatatgcacatagtatgccatgtaatctaagggacttgagcacctgtggattttggtatccacaggggtgctagagtcaatactgagggaggaatgtatgatcttagtggcttaaaacagcactcatttattatacagagtgtgtactccaggggtgcaggaatcttggggccaccttaaaattctgccaaccacaataagtatcaactcatgcactcctcacagcaactctgtgaagcaggcactattattagcagaattttatacttgaggacacttggtcaaaggagtcacagaacaacaaagtaggagagcctgggtaggaactcaggcagcctgacttgagagcatagactctgtctgctcttcagctattgttgtgttaggagctcagtgctgtagctattcattccattgctttttctgtatatccgcaattctctcttctttctcttgtcatatagtgttccgtagaagacccacatatttgtggtgtttaggaaacctttacttgggtccacataccttttgtatggatttgattttactttcttggccatttaagtaacctctgagtcacaaagctaactgctggatcctgcctcatagacttgcttattggttctgtatgttgctataaactcattcttttgctattaactcctgccagttcttgtaaagtctagattgagctttttgttggaaaattgggagttgtggccatattgggtcagtttccacatcgcagtaattttcttgagctgggtagcagccaccccttcgtgaagcatgaactgtccaatttgctatactcagcctacttagctaaccctaacccattctattcagtcttcatctgaacttaaacttgaaatatatatatataaatcattgtaacagaagtagtcttctgttttcttacttcacttattgtttatacagtttttttcacctgaattccttctgtatttaaaaacccactgcagttttcagtgatgaaatctaattcagtcttttcatgaaaacagtttcacatgacagaaaaatccagcccacattgaatgaagcacaaaaggaatttgttggctatgactgaaaaatgcttccttttagcattgctaaggccaggggctcaaacaacattattagggtctggtctccccccattgctaggctttccttctgtgagttgcttcgattctctgatagcctttcttcttagggtggcaagacagtggccaaaagttctaggttttcatcctctcagctccaaattcaacaggaaaagtaacttattattttgttgcttaagcataatccccaagattagtggtgattgtatttcactggtggggcttggggcaggtatgcactcttgaagcaattgctataaccagggaaacgcggtatttctatgtgcttgccttagctcgcatgtcctccctgggagtctgttccaaggaatcacagagacagataatgaggaagggatgattttcagaggaatatgaggagtgagtgctagatgacagaaatagtgcagcttccttgcttactttctgtccctctcttaaacttctctaatacggattatcagtgacacgtataatattctgctttgtattatagtcacttatttatttattcatttgccagacatttagtgccagtgatgttgcagggattgtgcaagaggatgggaatagaaagataaaaaagacacatcagttgcccttggggaattcacaatacaatatgcataatttgctccccagctggattgtaaagcttaggagatgtcagaaatgttattgtgttcccttatagcacgtaacattatatttcttataaaacagactctcaatagacagtataaaatgtgtgcatgcagtttattaaaacatattctcattacttcagacttgctaggtgaatcaatcttaatttgtggccatcttgtttgtactcatacctgaaaaccattcccactgtagctttattgttttcccttgtccctgcaggaagtgtactacctccctttcgggcacctatggaatttttccagcactcatctcatcctgtcttttatcacagttacttattggtttgtcttggctcctgcacgagaattgaacattcttgagagcagtgaattgcttaataaatgtttgctgatttgaatctgtcgaatggtggaagtgtcctggggactagtttcaatatttttttcattgtctatttatattttatttgttcattagactttgttcagattttcccttaagttcccatttatgcttaataggcagatttgggttttgctcttcattagtcttccatgtgcacatttggtactggtagtattttaatacttttcacacagtcagagggttggtattgataatcagtgacgacttctatctctacaaagctgaactacccttaggacgggtagcattattctagaaagaaaatgaacttcactgacaggctgggtgttttctattatctgatctgaagttaatatcccttgtttctattttgcttgcaataaaatccagactttgatttcctgaggtctttgtaatcagtaatgaaaaagcaaacttgatgtgctttgagaaggataagagccaacattgaatactggctgtattccaggcactgtggcttgcatatattatattttaaatcttcacaacagttctatgggggtacgtactattattatccctgtattccaggagacaagactgaggcctaggaagatgaaggaacttgcccagagccacatagctagtcagtggtagaactgatccttaacctaggtgtctgtaattttagagttcatgtttttagtacctggaaagcacagaggcatttgaaaattccagattcataccttggcgtcccacaccaccacaaagatcaatagcattctcattcaggtaatactttaaacattgctggccgctttcctcacccgtacacctaagaaggcaattttgggtattttagaaatctctttggtaataacaacagcagactatagacagccatcacattacctttaatacatctaagtccccttgatccttcaacacaacaaaagccattgtctataatacatgcaaatgtgcattttcaactgtgctaatacattttatcactcatttgaaatgtttattggggtctataaaaaaactatgtgcattatgaaaagttaaagtaagtaaaagcacaaatgagaaatccaagtaccctagaaaccttacttcttagagaccaacactgttaacagttgggtccacatttatatctttatttagtatatacacagctacatgcataccacgtataattttttaatggttgtatactattccattgtatgaacatgttaaactttgttaactttttttttttttaaactttaattttaagttcaggggtacatgtgcaggactgttttataggtaaactcgtatcatgagggtttgtcgtacagattattttgtcaccaggtgttaagcctagtacctagtagtcatttttcagcctagtacccagtagtcgtttttcctgatcctctccctcctcccatcctccaccttcaagtgcgccccagtgtctgttgttcctctccgtgtgtccatgtgttctcattatgtagccctcccttacaagtgagaacatgcggtgtttggttttctattctatgttagtttactaaggataatgacctccagttccatccatgttcttgcaaaggataccatctccttttttatggctgcttagtattccccagtgcatatgtaccacattttaaaaattcagtctaccattgatgggcatttagggtgtccatgctttttctattgtgaatagtgctgcgatgaacatagatgtgcatgtgtcttcatgataaatgatttatattcctttgggtatgtgtcagtaatgggattgctgggtcaaatggtggctctgtttgtgggtctttgatgaatcgccacactgttttccacaatggttgaactaacctacactccgaccaacagtttgtaagcgttcctttttctctgcaacctcaccaacatgttattttttgagtttttaataatagccattctgactgctatgagatggtatctctttgtggttttgctttgcatttctctaatgatcagtgatgttgagctttttttcatacacttgttggctgcatgtaacattaaaatttaatgaaccagtacgctattgaagtatttccatttttttccactgtagggaacatcagtatacatctatctttgcatatgaaactggtttttacataggataaattagtagaaatgaagttgcagaaacagattttacatttttatatatgttgccaggttgtgctctaatatatattgcatttacactccaccaaccctatacaagaacactgcttgcttactcacagccttgctagtacgggatactgttactctttttcatccttgccaatcttaaaagtgatataagtaatgcctctttgtaattttcattttcattttttagttatttgattctggtgggtttgaaatcatgaagttttgcataataaaaccatgagactttgactcttttttttccccatgaaatttttaaggccatgacagttctaggcagacctagacattttctctggcttttaaaagtagagctgttccttctttatatgatgaagtataatatacagggagtgttgcatattcttgatggtccagtcatcatcattatataaagatagcttttggtacaatcttatttttaaagctgttaggtccagaaagtttttacctggtggaagtataccttttactttattagtacaaaacctccatcttgtctctgatattttatgaagggatacttgggaacaaatgtggcagctcctataataacacttaaattgtattgaaaacacaagatagcctctttatattcagctttcttttacattcatgtactttgaacttaaatgagttcattaggcattaggttgggtttgtaagctttaatatgattttggtcatagaaaaaaattaatattcagtatttagattatttcaatttgccacctttgtagttcttgatattagtatgcacttatgttttattctttttttcctgctgtaatagcttctatttattattattatttttttacctcagtgtgctcttgctctttatgaatgtttccccttctgaagttcttttcttatttctctttagctgttgacaagtggcactgtctgtgaacctgcaggtttatatagacaaaggaaaaagcttatgttgtttattgtctttccagaagagggtgtagcaagagaggaaaagagcagctagactgtcccatcccccttcattttaagcatctcataaaaattaaagatgatggaatattcatcatactgaaaagcactcttacagttataattcataaataacattggcaattaaattcaagatgtcctgttaacagaaaccaaagagtaaagctgtctacctctaaaatatgaagatcattgtcctatgagacaaggatgaatggagataacacatatttagaactgaaatggaagtcttagaaggaaaaattgcttaatttaattgaaaagtattgtgaatcttgggtagattcatagcattctctggtcaatacagtgaatctctggtatttatacatcagaataattgaatatttgacatttgatgcatcagaaaaatattctagtcaagaaatttattcttgtttagggttaaaaacgttttcattacaagccagtaatttcaggttctgtccttattgaacaaatgctcttgtccttttaacttaggaagggttatgatgtaagcctgaatcacttacctttgttcgttgagggttcttgatcttagaatataagacaaattcttggatgcgttgtttccctgctaactcattaacccattgtaggctagctgctgcctctactaccgtactgaagtgaattcactcacgtaactagttacatcctaaatgttgaatacagtattttgttctctttctgtgtcctgtttgactcctctgaggcatatattgttgactgtttccttaatgaaactcctcttttatgactttgaagatacctctgtcaccttgtttgtttcacctccatggatctttaaatgttggcatctctcaaagatggtccttgtttctctttcttactttctttttcacattgtttttctaaatagattcaactattacttaattgtgaatgagtaaatttttgtctctgtgtcagagccccctcctgagttccaactctatttctaactgctggccatttatgtccctgaatcattgcccaaactatttaaagtctggatgattatctagcactttcctcaaatctctatcactcatgagtttcctttattgtattcatcgattgttagcttcctctacctaagttcctcaacctagaagcattttcagaatctctgtgatctttaagaacgctatctcaacaaaaatatgttatctgtactaagtatagtacaataatacataaatgattcattaatcacttaaataggagtttatttaaataggaatatcatattgtattaatattttgtctgaacttcatagaatttaaaatgtctgattttctaaggtatgctgaaccttcactgtgattttaacaaatgtcttttcggaggggtagaggacagtgctccaattttatagagaaagtagaaggaaaatgacttacagaaaatgagattacacacaatgttcaaggctgtttcagaaaataatttagttattttgtatataaatatacatttataaaaatatatgttctaaaaagtatataatgttatttatatataaatctgcattaactatataggttaaggcaagagccagtttcttctgtcatgaatgtaggtattttcttgtgaagccaatttattgtcgaagccaaaggagttgcagtttttattctggttgtcattctagacattcagcatgcatatacagttctgtaaagttattaacacattgaagagaaatgagttgttcatggctaaagttgtgggggcaagtgttaccatttcttgaatcgttgtagaaacaagtacttgaaaagtcttaactgtagagaaaatccatgtgattttcatgggcgtgactgaggcttcggtggttgtggaggaagtttctctgtctgcatagtctgcatgtccagactcagagcggcctaattcctgacagtcacttccttcctctcctgtctagaatcagttcattttcaatatgtccttctaacattttctagatgaaagcagcaagttaaaaacatccaagaatgtcctggagtgcaaaacctacctccgcatgcatacatgcatacatacaacagcagaacaaaacacccaaatcaaacctttgaattttctgtgagaaatttagtctttataattcatacctcccttggggattgattttgttctccttctgatgaattttgactttcttgtcccatgcctgtcatctcaattgtttaacgatttatttttcttgctcagaggattcagatttccagatcatatggctatagcttgtactggtgtcaaggtcaaaatcttttaattttattgatggaactggtattgtaacctgagggtctcttgctgtatatttaaatcctgtcatattgcctaaaaacagtcatatcttggttttggtccaacagatacttttattaaattccttggctacatctagtttactttttccttgagagaaatataacagaataccaccagcatcttgattgcaaatagattgttaccgtggcaacctgacagtttttaatattagaatcttcttgttaaatcaaaacttatgaaattggagacctttccctgactgaaaacattatgctgcctcttatagttggaattacactgtgtccaagcagaaaactgtttttctttattaagaaaacaaacactttgtttgctcatcaactcctcggctactatcttaggacctttggcttctcaactgtagacccttttctgggtaggatcttttatgctgctgggcagcagtgggatctgtaagagatactaagtaaagagaatcacagtttggtctctgacactaaagaacgttaccacctagggactgcgtgagtgggcttggggagattgcttaggttctggtgctgctattagaatactaatagaattagtattctgagtgggaatactaattcctgccttaacttgtcttataagcttgttttaacaaaggagtacataaaatatttattattacatattattcacagtgaataacagacataagtaatatgcaacatattagatttatgtattatctcatgtaacctccacagtaaccctgtaaaatagatatattattctcaccttatatatgaagacatttgtaggcagaaaggctaattgggtcgggcacgatggctcatgcctgtaatcccaacactttgggaggctgaggtgggcagatcacttgaggtcaggagttccagaccagcttggccaacatggtgaaaccatgtctctactaaaaatacaaaaattagctgggcgaggtggtgggtgcctgtaattccagttacttgggagactgaggcaggagaatcatgtgaacctgggaggtggaggttgcagtgagccgagattgcaccactgcacgccaacatgggcaacagagtaagactctgtcttaaaaaaaaaaaggaagcttaattggtttgcccagatcacacacagatgtatacatggactcagaaagagttgtctgtttctattttcagggctttctccacgaattctttggcctatcatgtagctggcacatagtaggcactgtgctgacacatagcaggcactgcatatttgttgactaaatgaacacttagctgaacacttacaggcaatggtagtcagccctcagtaagactgaccatttgtagatagatttaatctggtcaagaaattagaatttgctaaagctaactctgcaacatagtgggccctggttgcttctgtaattgtctatcattcatcaggctttcatctgaccttactgagtgagtgctatgtgctggggacgccggtatttagaaatgaggaagacattctctagagtatacagatgatggctaatgctgtggaggtggaaggaatgtagggagagggtaggtagaaaagaaaataggagcagcatggatggaacactttggaacaggaacatttaaggggcaagctgaaaaagagaagccagcaaaggcgactgagagggagtaaagtgggaggaaaacctggagagaaagatatcatagaaaccaagggagaaaaagcacttcatggaggtcaacagcttcaagtgctgcagagacgtcagttaacgtgaggactgaaaaggttcattgagttcaataatagggaatcctttggtgagctttgctagagcaccttagagtcatgagtgcttgatcattttgagaaacctgactgtgaatagaagaaaagaatagggcactaattaggagtgtggagtttttggttctgtttttttgttttgaagagatttgaatgtgtgagccagcaaagatgaagatttaaagataagtgggcaaaagggttattaatgatgaagtgatatttctgagaaggtgagagcaaaggaattaaccttgaatcctgggatagacgctcttcttctgagactgtcgtgggtttttccactgtgccgggggaggggttttcttggagtagtctcactagcaggagggctgcttttgctccatgtctgcaaaagtggaagcacgtgggtgaatgctaatgtgcgtgttatactacttagaagttacagtcctctaattttttaacttgccttctgatactggcttaaaataagttacagtttaattaaaggtatatattgatcacacttaccacacctatggtaaagtagccttctaaaagctccagatctctagggtgccagcaaaacatccaagtacataatacatgtagatgaggtagcaagcgaatgatttgttgttcagactacatgaccaaatatagttcagaagatatctgtcagtgctggggcctcatggagagagggagagatcatccactaggtcagggacccataacattctttagggggtgatatgatgtagtttggggattcacaatcctttctcggtgaggagatgcaaattggcctcataattaccaccatgtatggaatagcatcatacatgatctagttgttgttttttatggtacagtgtttttacagtacagatacatttacccaccaaatatggtggtttggaatgattctttgtgatcttccttgatttcatcagcaatttttcccaacccatgtttcagttttcagtcttaatacttagcattaactaaaattatgttcttgaacatggctatatgttgaccctttccttatgttttttcagtgtctgccatgctccctgcctaagcttcctgttgtttgctcagccctttgtgttccttttgcagagactccaatttcagcatgactcttttgcccccaaatgctctcaagtaataggttggcaatacgtgttcatggtcttctgtttaagggaagcttgtaatgtgtcattccttttactgtgtcacatggtttactgcagcatatccctacaaaatttatattgtgctgtgctggagtgactggtatgttggagtggatttttattagcaatatatttatccatatagtgatcatatctgctttaatacttgacagtgatagtaagtctaagatactggtgtattggatagtaagtctaaggtactggtgtattggatagtaagtctaagatgctggtgtgttggatagtaagtctaaggtactggtgtgttggatagtaagtctaagatgctggtgtgtaggatagtaagtctaagatgctggtgtgttggatagtaagtctaatgtactggtgtattggatagtaagtctaagatgctggtgtgttggatagtaagtctaaggtactggtgtgttggatagtaagtctaaggcactggtgttttggatagtaagtctaagatgctggtgtgttggatagtaagtctaagatgctggtgtgttggatagtaagtctaagatgctggtgtgttggatagtaagtctaagatgctggtgtgttggatagtaagtctaagatgcttgtgtgttggatagtaagtctaagatgctggtgtgttggatagtaagtctaatgtactggtgtgttggatagtaagtctaaggtactggtgtgttggatagtaagtctaagatgctggtgtgttggatagtaagtctaagatgctggtgtgttggatagtaagtctaagatgctggtgtattggatagtaagtctaagatgctggtgtgttggatagtaagtctaagatgctggtgtattgcattggtcatgggaggtagaaatggctcctttactacctacctgtgtgatcgtcaaattcatattttcccaaggctaatattttcttctttctactgtaattagcttcctcattctgcaagttaactatgattataaatactgaatacctggcatgttttctcaagtatgaaaataaaagcttatacttaatgtgtaaattacagttgaacataggtccagacatatggttattagtgttgcttaaattactggtttttcttgtcattgctattgcaagtgttctcaaagtgacggcaaatcacttcctttcctgtactgtgtaagtaaaataaatatattttaaaatgtatgaatgtgtaatgtagatattactctatttgaccttttatttggaggttaacatataaataaatagcaacaactagtattgagaagtccagatgcactgggcttgcttaggtgcctcgtggtctccataaacatttggtctagtgtttctggctaaaagccagcagcaaattatactttccatgcaactcttagctcactctcttccttctcagagcatgatctgcaaaatgcactcataagacatcaaatttgaattgcaaatttgtatgcgaatattattttacaagtagtcgggaaagaaaccagaggggaacgtttccctaatttgttagcaagctgtatacataatttgtaactgatgcttgtcttgaccatctagtcatcagtattctgtaggttatggaaataccaatgttttcaaatctttgctttgtttttatcaagactactttattaacctatgtatttttttttttatcacgcttaaaagcttgtttaattgtcccatcacaaggtaacaaatagtcttgttttttaaacatgggaaagcattttatattgttgaaactggcatgttttaaaataaatatataacctcaggagctggcttataaattattatatttctttctgctgctttgaaatggtgctagggtagctgatgatgaagacatcagtgtggtaaattaagattgtgtgtatttaattatgtgtgtttagttcagaaggaagctagatttttttccaccagctgggcaaggtaaaagaaatgggatgtgaaggaaaaaaaaggaaagaatatagggtttttcagttcattgtgagaggctgaggtgcttttattccttctgccttgctagttgtgatattgcttattgatattaggaaaacgaaactccagacacttgagcatgaaaaattacccagtgtttatggccttgaaaatatgttgatgtgtctgaaactctcacactcgaaagttaagccttgaagttacaggccaatttcaaggttagacaaggaatggtttttacaggtgcacttcattgatgaagaaactttttgtagagaagtcatacttaaggagttcataatttaagaaattaaccatatatctcttccctgatagctttactagggttttcagggcttctcttgtctagtgaaatgagaacagtaactgaaatgaacagtccaaaaagaagcttttaaaatttcaagcgacagtagaaattggccaaaagtttagatagtttagtggataataatcactattagtgacagaagatgaactatggaatgtagatggtttagttcccttttctccagtttttgctggaaaactctcaggtcttccccagtccaatttcctctcttcatatgctaatgtagttattttgctgtgttgctgtttctcctgtcatcatatatttgaacatcatttgaagattcctttaagtatggagcagcatacttttggtcgccaaggagatggcttcttttagatctgtgtactttctgattttgctaagttatgatagttttttcctcacaggcccacacactcgtgataaatatatacaagtgagtcgtactgtctgtgttgatagtttgggaattattttgagcagagtggctccctatatttatgatatatgggaatagtccctactgaggaagtctgtgtatccacttacccggggttgccctggattatggttgtggacctccattggtgagttcatggttactgttagatgcaggtaaaatctcctctagccactagcacccacgaacagtaacatttactgagcatttaccaagtgccatgcactgcaccaagcagtcgaattatcttataaaatgtccactgagatcagtgtcagtgagtggtagatttacatacactaccagtcatgcaaagaaaatatactatcaaagtaaattttttgaaaagttaaaacctgactctcacagaaatacaaaacgaaatgccaaagatgtattaacttattaatgaggaaaccaggcagagttaatgcaggtccagagtactgaaggaactgatctttaggcattagaataagattgctagattggagacaaaactggtgacgttctgcatgcactaaaaccacagtttttagagttatcctttctgctggacagaaatctataagctaacgttgtagtttcacactatctgtgctctaacagcaagtaacaaagtcaaatgcattggcattcttctagggaattaaataatccttgggtgaagctgtgaaacagtgctctagagtaatatgagaaggccacacagctccctaatctttttcttttttcatgttttggataattttaattaacaatcgctttttaagattattattttcttttgagacgaagttttgcttttgttgcccaggctggagtgcagtggcgcaatcttggctcactgcaacctccgcctcctgggttcaagcgattctcctgcctcaccctcccaagtagctgggattacaggtgcccgccaccacacccagctaattttttgtatttttagtagagacagggtttcaccatgttggccaagctggtctcaagttcctgaccttcaggtgatccacacaactcagtctcccaaagtgctgggattacaggcgtgagtcaccgtgcctggccaggcttttaaatattttataattgaactacattttcttacctcagcccatctggggaagcagttaagtaaggaatgtacatgattggacaaacttaccccttaatggtgcttctgtttcttgtagtttaaagtccttgggtagcttgtctttttttcagataaatgctcaattctttgcattttcccctccttgtccttccatggcaatgggagcaagactgcagactggtcctgattctcttctgccccaggtggttggtttatctagtcttgtgcctggactagccttagcttttattcttgccatctctccactctggggagtcttagtctctgcattacccccactgggtcacaggaaagctcaggatccactgcataacatacgcatggggctgtaggggaccaggaggccacttctgggttttccctcctgttgtgtgtggatcgtagttttgaaccaaaccagaagcttctctgtggagctacggttctaaatccaggctgcacatttgaattacctgatggcggagttcaagaccagcctgaccaacatggtgaaaccccgtctctactgaaaatacaacaattagccaggcgtggtggtacacacctgtaattccagctacttaggaggctgaggcagaagaatcgcttgaacttgggaggtggaggttgcagtgagctgagattgcaccactgtactccagcctgggtgacagagtgaaactccatctcaaaaaaaaaaaaaaaaaaaaaaaaaaaaagaattacctgatggcatttcaaaaacttgccaatgcttgagttcctgagcccagaccaatctaagtgtctgggggtgggggccccaggccgtgtaacgttccaaggccttcctaggtggttctaccctgcagctgtgctcatggaagcaaggtgagcttctcattccgttttcagccctcattttaaaaattagtgttttaggaatttagaaagcacattttctcttgacaaagcttggctgtcaagaattttgcttgttgactgaaaatattgatttataggtgtcataattgaacactgagtctttctctttgtattcctgtttccataaacctgaatatcccgtaggcagatggatgcccctggccaaaacagagacagggtcaggtgtaaggaaccacacaaaacccccccaaatctaattactatacttcaagaatagtattcccaaaacttggtatttctatgtccatcttagagatgtggtaataggcaaagtgaggtttagtatgacttgcccaaggtcacctagcaagtgaaagaaacgcaatttaaacccagcttgtccccctccaacccagtttggacatagcggtaagttcttctggagtcctaacttaacagatggaatgccaaacacatttttagaaaacataaactattaaatagtgattacattcatgggtttttactacaaaagctttttaaatttgtaatgaaactgtaaaaggaaatctttagctcattgacctaattattattccgaaaactatatatattagaaaatattttctaagtttaaaacaactctggactttcactaatgttttctgatcaattgatattcatgaaattctaaaatgattgttgttttttaaaatgttattttaggctgggcactgtggctcacgcctataatccttgcactttgggaggccgaggcaagtggatcatttgatgccaggggatcaagaccagcctggccaacatggtgaaaccctgtctttactaaaaatacaaaaaattagccggtcctggtggcgcacaactgtaatcccagctactcgggaggctgagacatgagaactgcttgaacctagggggcggaggttgcaatagccgagattccgtcactgcactccaacatggatgatagagcaagactgtctcaaaaaaaaaaacaaaaaaaaagatttttttattatatcttgaggtcatatattttccaaagatataccactacagttttataatgatggtcaatggagaaaatttctccacttgaaatttagaattcaaaagtctgattatcaaatatttgagaggcagcagacctacgtactctttagttaataaatattgagtgtctggtatgtgccatgccctatactaggtggatatacaaagatgaacaaaaacagtgtctctgtattacatttatattggcaagtcattactacatacaaatttctaaaaatttttaaaaagaccttcagggagtctgtagaaaactagcactaattttctgagagtttgagtacagaactaatgtcagtcttgtgttatactcaggaattttcattgagtgaaaacttgaggaaataatttgtatgatgaattttaaagaaattgggacttccctaagacagtggaaaatatttgtttttaagaggcattgatgggagctgtgtggtgatttgtgatttgtcagattaaaaaaaaagtgctgtgtttacctatgtaacaaatctgcacatcctgcgcatgtatcctggaacttaaaaacaaaaatttaaacaaaagtgctggcaaagcaaggttttgttattatcctttattaagctttttgtgggatggaggttttactttagaatcagaaacctcaagtgtctttctcatataatgacttcttttcctctgggtagataccgagtagtgggattgctggatggtagttctactttagttctttaaggaatctccacactgttttccatagtggttgtactggtttacattcccaccagcagtgtagaagtgttcccttttcacagcatccatgccaacttctattttttttaaatttttttggttatggccattcttgcgggagaaaggtggtattgcattgtgattttgatttttgtttccctgatcattagtgaggttgtgcattttttcatatgtttgctggccatttatatcttcttttgagaattgtctattcgtatccttagcccactttttggtgagattgtttttttcttgctaatttgtttgagtttcttgtagattctggatattagtcctttgttggatgtatagattgtgaagattttctcccattctgtgggttgtctgtttactctgctgactgttccttttgccatgccaaaactctttaatttaattaagtcccatctatttatctttgtttttgttgcatttgcttttgggttcttggtcatgaagtctttgcctaagccagtgtctagaagggtttttccaatttttttttttgtagcatttttatagtttcaggtcttagatttaagtccttaatccatcttgagttgatttttgtataaggtgagaggtgaggatccagttattctcctgcatgtggcttgcactcgcatgtttgtaccagcagagttcacaattgcaaaaatatggaaccagcccaaatgcccatcagtcaatgagtggataaagaaattgtggtatatatacatgatggaatattactcagccatagaaaggaatgaattaatggcatttgcagcaacctggatgcaactggagactgttgttctaagtgaagtaactgaggaatggaaaaccaaacattgtgtgttctcactcataagtgagagctaagctatgagggtgcaaaggcataagaataatacaatggactttggggacctgggggacagggtggagggaggtgagggataaaagaccacaaattcggttcagtgtatattgctcgggtgatgggtgcatcaaaatctcgcaaatcaccgctaaagaacttactcatgtaaccaaataccacctgttccccaaaaacctatggaaataaaaaaaaaaaaggaaaggcagttactagtcaatatcactagtaaacatgagtttttaaaatcctaaataaaatattagcaacctgaatccagcaaataatttaaaagcaacatgaccagattgtgttttcttccaataatgtaaggctggtttcacattagaaacctattaatacaatttaccatactcccttaaggagaaaaatcatttgattatctcaatacaatcagaaaaagtaaagaaaaataaaagaattagaggctgggcgcggtggctcatgcctgtaatcccagcactttgggaggctgaggtgggcggatcacgaggtcaggagatcgagaccatcttggctaacatggtgaaaccccgtctctactaaaaatacaaaaaattagccgggtgtggtggcgggtgcctgtagtcccagctactcaggaggctgaggcaggagaatggcgtgaacccaggaggcggagcttgcagtgagccgagatcaagccactgcagtctggtctgggcgaaagagtgagactccgtctcaaaaaaaaaaaaaagaaaaagaaaagaattagaaacctcagagaatggaaattttgctcatgtttcatggtattgagagaattcacgttgctgacctggtaaccctgaagtgtttaagtgctgcagatggtcaaaggaaagctgaaagatttcggagcctgctgctttctttgttctgcgtttgcaacacattaccagatgctagatgcagaagtactgcagcacttgcctgttgggaaagcttaatctaactgctcaagtagctgatatgcagcatctgacagcctgctatgccgttttgcagcatactcaccggtgcttttgatattggctctgaggaagtacttttggttgcaagtgacatggcatgtacctctccagcaagacttcgtttctgagaaattcatgtagttcttctttcatgagtaatttaccttgtttgatttttctactggttgatatgctattttagtcaaatattaatgtgctacatttaaatgcttgacttccttttgttattttgaaatcagttattagggtgaatggtgtacctgaaggttgtgtgtaactcacagttgtcatgggctgtgaaagctggcaagtgctgcagtttttgtttatgactcggttgtgtcagtgggagacagaaattctaaaagatactgcaagcagatcctggtcgatttctgtgagtgctataagttctgggagaaatgatcttgggctttagatgttatcgctgtggcaattatatttcttctggtctcacagaagcaagtgtcattaagagctttaaatatttgaaattagaaccatatgagttattttgagacctctagttactgtaattaaacatacacaggtatatatgaatgaggacgttatttatgcatgagcaagggaagcttttccatggctctgattattggcaggcaggggtggtgaggaaggaaagcaagatggacacatctgacacatttaaagcccagtttagccagagtaaggattttgaggtcctttctctttgttcagattgcgagtcgatggtaggactttgggagggatgtagcaaaggggatgtaataatggcaatagctcatgctcatgaaacacataggttccaggtaaaatgctaagctctgtgcatatgatcactcactgttacactcttggcaatgttattatctctggcttaggaaagtagatgacatgcccaagattacatttgtagaactgtggtgtgaacccaagccaccctgagtccagatcccaaaagcttgaccactgttttattttctatggggggttacatgctccctcagtaagttttagatttttaaggtgccattgttgagcagaagaacctttagagctccttatttcttttgtggcttttcctgtctcagggaaggtgcaggcagaggaagttaaattccgatcactctgaaggaagaagtttgcagcagtggtaggatgatatagaaagtattgacagtgctgagaatctgggattatttattcttgtttggagtgagagactggatcttcagtttactttagataattaacaactgcaacaaaccaggttgatttattacattttctagttagattttgttgactgttcagttattctagtcatgaataaatttttatcatttttccccataacatatgttgaagcagaagtctcatctgctagaagcaacatttaaagtgcttgcataacaatattgttgatacagaagattttttgtatccaaacaaagaagttaactactgtgcttcatttatcttcatctgtctgaagtaccaagaaaagagatgtggaaaaataatgataggtaagcaaaagaaaagaaaaatacatgcagctttttttttttggaacaaataattttattttttaaaattattattaatttttttgagacagggtcttgccctgttgcctaggctgcagcacagtgacgccaccttggcccacagctcactgcagccccgacctcctgggatcaagcgatccttccatctcagccttttgagtagctgggcctacaggtgggcaacaccacccccagctaatttttttgctttttttttttttttttttttttttttttttttttgtagagatgagggtcttgccatgttgcccaggctggtctcaaactcctgggctcaagcagtcctcctggcttggcctcccaaagtgctaggattacgggcatgaaccactgcacctgaccaggaaacaatttttagacctctacattatatttgtttttatgatcttctgtctttcctactatgccatgatctatataagtaaagtatacatatttggacctttaaaactggattcacatagtccccgtcttgcagaactatttttcacatcatttggtcttgtagatatgttacaaaaacagaaaggaatttaatgacattctacctcctctctcttttttcctctttaataggtttcatttccaatagcccagcaccagtgtgtcattgtcctctgatttaggagtcctttttctgtttgattttgagctgactggtagtatgagctgtattgacatagcattctgtttacttatgtcttggaacttctccttttctttccatagtcacgtatgggtgtctgtgctcaggaatcaaagcctttgcctcttctttcttttcctccactgttttctcagtgcctaagcataggttatgcccatagtatgtatttagtagctacattctttcaataatattttcatttgtatgttttgcagatgtttttagagtgcctactatgtgcctttactgaggtatatgaggttctgaggatacagagatgacaataacgtaatttcctgtgcttaaggtgtttgctgttgtttagaggagaaacatctctttaaaggaaaaacattgcggtatgatatgatcagtattctcacagagctttactcacccatgatacaagcttgagcataaaatcacctatctcacagagttactgagtagggtaaatgtgatagtgtgtggaaagcacctaactgtagtagtctctggcacatagtaggttgccaatcaatggcagccattataattcataaagcacagtgagttcacaaagaaggaagagaacacattgtcctgggccatttcagtaacgaatctcaagtgacctggcaccagtgaggcaggctctaccacgggctgaatggggaccccacttccttctcacctgtgtggtgtccaatgatatgctagaattgaattctcagatgtatcttttcaatgactcataaatgcctgtaagtacctggagggcaggtgctgtgattagaaaaatctttatttcccggcagtctttgagaaatctgtaaatgtctattgagtgcattaggttttagaataaattcataggctataggagatacttctttggaatattagtgtgattttaattgctaggtttttgcaaataaaatagacaaaggtctgaggaaggcatccttccatttggaatttggtacaactagccatctttgtcccacgttttgtttttgaggtggcagcctgatcaaatataggttgaactatagaatgcagttagctcttgaagcatctgataaatgcagaaacagaaaagatgaggccagcaggggtcagtttaataccagtttaagttgcaagcacagtgtttttttaattctctgtaaagtggaatgataatagaaactgacatgcacagtctaaatgtaagctttaacatttcaagctacagtaggagattgccaaaaattgaggtagatgtctttaacattcttttaaagagagaaatggagatttcactgtgttgcactggctggactcgaacgcctgggctcaagcaatcctcctgcctcagcctcccaagtagctactgtgcccagcttctctaagatttttaagtagatgatggagattattagtgacagaaggtaaactatggaatgtggatagtttagctctcttttctgtcgcatggcagcataggactttcagccaaaccgatttactccactaactggcttgtactgacaagtgctagaaaaagcctgactatatcatgtgcatttctttgatgttcgttacttggtagactttataaaataatactttgtgcctatttttttcctagctggttataaagaaaagttagttttagttatagcttgcatatgaaatgtcaatatttccaagttacagttataagaaactgagcatggaatgattacttgaggacattaaactttaaataaaatcacctcatgctactatatatattcctttgttatcttcgtggatatgaatggccttttctttgcaacctaatgtatggcattcacatttataagactaggctcccaaatcctaagaacatcgtgtgtgctaaactcagaattctgcatactaatcttacttactacgagtaagtactcttagcagataaaattgttttcttgatgccttagtacactttccccccaagatactataattgttcaactaaagatttttatataatgtagaatgatagactcttagacctggaagacgccttaaggatcataaagccttgttttatagagaagttgtgtgatgcgtcacaggcagggctgtccctggcagagcaattcacacttcttggactgttcttccccatggtactacactatcgtcttttctctccctactctattcttccctgttcaatagtctgcatatttgagcttcctgctaaatatgttatagaggttaaataactgcctttgtcttgcatcccacttcctctttagctgtagagtagaaccccatgcacataaccattggtctcaacaatctttttttttgtttttgtttttgttttgagaaggagtcttactctgtcgccaggctggagtgcaatgacatgatcttggctcattgcaacctccgcctcccgggttcaagtgattctcctgcctcagcctcccaagtagctgggattacaggcacgcgccaccatgcccagctaatttttgtgtttttagtagagatggggtttcgccatgttggccaggctggtctggaactcctgacctcaggtgatccacccgcctcagcctcccagagtgctgggattacaggtgtgagccaccgcgcccggctggtctcaacaatcttacattgtagcttaagtggctctttgggattgttgtgtcatgtccactggggccacttagagccaaggggtgtgtgtctccacagaagggagtaaggccctggctttaaaggacagtaggtactgttctccagtgctcttagaactgttgtgaagtctgtgagtcacatgtagtagcactttagggcctagaggatgctggacttgagtggttgctcctgtcatggtgtcaggaaggaacacagggcagcatgacttgttaaagaagttgctgcatgatcctgacaacagtcaggcagctctgcctagcgcttgtgttctgaaaatgccgactttattgggtgtattgttttttctttttaaccatttaggtatcttctcctctgtttatattttttattttgtataatgaattatcacatactttgtggcctaaagcagcatatattttttaatcgtatggtttctgtgggtcaggtgtccacacacacctggatcctccatgtagggtctcataaagctctcgtcaaggtgtcagctgggctgtgttctcgtatggaaatccggggaagaagccacttcccagctcgcttgggccactgaaagaatttatctccttgcatcagtaggactcagggccctggcttcttgccggctcttggctgaagtctacccacagttcctggagaccacccacagttccttctcaggtagggctttccccacatgaccatgtactttattaagtcagcaagaagagcttctagtgaagatctgatggcaagatggagttttatgaaatgtaattggcaggagtgacatatacctttgccatattctgttagaagcaagtcacagatcatgcccatacataaggggcaaggcgaggggattgtacaaaggcctgcacaccccaaggaggtagctaggtgtcttaggggaggggccaacttaaagtttgtcttctcagcttttttttttttcttaaacagaggggagacggaaagggacatcgacatacatgagagtaacccaggagatttgttcctgggtttcacattcacagcacttgtgggcctccaggccgacctgaggcattgaaaatcccagttgttggtttggtctgtgctgagctccttactcaccttttaaagttggctgtttgcagttgtactcccttcctcatttctgttttctttgtacctttttatttaaataaactttaagtatatactttgggtattaacaaatatgtatgccatgaatataatatacgatgattatcatggcaatgaagatacagaactttccgtgaccccaaaagttgccatatgtccctttggtatcaatcctcctacacgtctggctgcagcaaccactgatctgctttgtatctatagatgacttttgtctgttttgaattttgaagaaatggaactgtacgttatagactgtggtctgactcttttcacttagcataatgattctgaggttcatccatgtcgtttgtgtcagtagtttgttcctctttattactgagcggtggtctgtattgggataacacaatttgtttatccattcacctgctgatgaacatctgtgttgtctcccctgattaggtattgtgaataaagctgctgtgaatattcatgtatgagtctttgggtggacatgtggtttatttcccttggataaataccagtagtgagattgctgggtcatataagagcatttttgttgttgttgttggtggtggtggtggtggtgtttgcttgtttttacatgttaaaataagatacagccaaactattttccaaagtgatgatgcattccagtcagcagttgctccgcaccttcaccagcatttgatgtagtctctttttaattttagccattgtaacagtgtgcaaggacgttatattgtggttttagttggcatttccttgataaatgatgttgagcgttttatatataggcttattggtcatttgtacatcttcttttctgaaaccttgcactttttttttttgaaacaaggttgcctaagctgaatgcattatttcaactatttacaagttcacaaaataacacctttttaatgtatatttgctcacatattaatgtagtaaacatattatttaccatgtgctaatcactttacacatactggcttatatgtacatctccatattagacatatgagattagtactttcattacccccattttgcagatgggaaactgagacctagagacattaaataacctgccagtgttaatacggctagtgaaaaaacggagttagtattcaaacatgggcatcagactccactagaaacattaaataacctgccagtgttaatacggctagtgaaaaaacggagttagtattcaaacatgggcatcagactccactagaaacattaagtaacttgccagtgttaatacggctagtgaaaaaacagagttagtattcaaacatgggcatcagactccactacagacattaaataacctgccagtgttaatacggctagtgaaaaacagagttagtattcaaacgtgggcatcagactccactagaaacattaaataacctgccagtgttaatacgggtagtgaaaaaatggagttagtgttcaaacatgggcatcagactccactagaaacattaaataacttgccagtgttaatacggctagtaaaaaacagagttagtattcaaacatgggcatcagactccactacagacattaaataacctgccagtgttaatacagctagtgaaaaaacagagttagtattcaaacatgggcatcagactccactagaaacattaaataacctgccagtgttaatacgggtagtgaaaaaatggagttagtattcaaacatgggcatcagactccactagaggcattaaataacttgccagtgttaatacggctagtgaaaaaacagagttagtattcaaacatgggcatcagactccactagaaacattaaataacttgccagtgttaatacggttagtaaaaaacagagttagtattcaaacatgggcatcagactccactacagacattaaataacctgccagtgttaatacgactagtgaaaaacagagttagtattcaaacttgggcatcagactccactacagacattaaataacctgccagtgttaatacgactagtgaaaaacagagttagtattcaaacatgggcatcagactccactacagacattaaataacctgccagtgttaatacgactagtgaaaaacagagttagtattcaaacatgggcatcagactccactagaaacattaaataacttgccagtgttaatacggctagtaaaaaacagagttagtattcaaacatgggcatcagactccactagaggcattaaataacttgccagtgttaatacggctagtgaaaaaacagagttagtattcaaacatgggcatcagactccactagagacattaaataacttgccagtgttaatacagctagtaaaaaacagagttagtattcaaacatgggcatcagactccactagaggcattaaataacttgccagtgttaatacggctagtgaaaaaacagttagtattcaaacatgggcatcagactccactagaaacattaaataacttgccagtgttaacacggctagtgaaaaacagagttagtattcaaacatgggcatcagactccactagagacattaaataacctgccagtgttaatacagctagtaaaaaacggagttagtattcaaacatgggcatcagactccactagaaacattaaataacttgccagtgttaatacagctagtaaaaaacagagttagtattcaaacttgggcatcagactccatatctttgttgttggccaggagcaggcaaactataagcctgggtgccagaatgagccatgccgttcttgtatgtatcatgtcttgtctattgttacagcagcagagctgagtagtttcggtagagatggtttggcctgtgaaggctgccctttacagaaaacagttgcctgcccctgctcttgcgcattgtattttgtcttcactgttcctgccttcttgtctggttctaaggaatgaaaggaggacaccagctcagatttcctaaaaatgtctttatatataatttttaaaaattctcaaaaaaaatctgcctataaaagtcaaaaggatgaaaatgaatgtagcaggaacaactgtgaggtgtcccagctacagtagtcattgagtttttttgcataaaaatacgattgtaaagatagattccataaaatgtgatgttctttgtcctggtactgaccccggtagagtgttgcctatgtttttggcttaacatttatagggcattatttgaaaaactgaattctgatccaagcagagatgaggggaacaaggctgagaccttaattactggctctctcttgtcagagaaaggtgctttttgtcatattcccatgggatttgattgaccttcggacggcctgtgtctgttaggaggcatttctatttctcaggtttgagggctagtcagtaaaatttggatgaatttggactggatagagggactcaacctgaattgtgaaaatcctgagttacagaatttttaaaagttctatgttgtagttatatataataatttagctattttaaagcacaaaacaaatacgtgcacttggagaatggagtccacagcattcagcaacagtggcctgaagcagagccccagataaaacactgggttgaatgtcagtgtgctgacatcagtgttttttattatatgactgtgttctttctataaaaatcaggcattgtgagaagcccagatgtgaagcttggaacaataaaaccaaaggaagaatacatcagaggtttgtaaaacttagataatatggaagtaattaaccattagactcacgatatgttctctaacagtaaccttgaaactccatgttttgtgtctaatgacttctaggacacataaagacaaaaggaaagaataatatgctttcagagcatgaagaacttgctttagagtccctgtgtcttttgactcgaatacacaggattattatatcatgcagttatgaatctgaggaaagtatgacatgatcgataggtctaattctaaaatatctgataaagaagttaataccaaaattagtgagtttcctaactttaaagtgaaataactagataaagaagaactaaatgcaaagctagcagaaggaaggaaataataaagattagaacagtgttaactgaaatagagaataggaaagcaataggagagattagtggccgggcgcagtggttcacgcctgtaatcccagcacttaaggaggccggtggaccacgaggccaggagttcgagaccagcctggccaacatggtgaaaccctgtctctactaaaaatacaaaaattagcagggtgtgatagtgggcaccagtaattccagctactcaggaggctgaggcaggagaatcgcttgaacctgggaggcagaggttgcagtgagccgagatcgtgccactgcactcccacctgggcgacaagaccaacactctgtctttaaaaaaaaaaaaaaaaaaaaaaaaagattagtgaaaccaaaagctgcgttcttgaaaagattaacaaaattgtcaaacttgtagatagatggactaagaaaaaagaagattccaattgctaaaataaaaaatgacaatggggacattactgggccgggcgtggtggctcatgcctgtaatcccagcactttgggaggccgaggtgggtgggtcacttgaggtcaggagtttcagatcagtctggccaacatggtgaaaccccgtctttaccaaaaatacaaaaattagctgggcacggtggcgggcacctgtaatcccagctgctcaggaggccgaggcaggagaatcacttgaacccgggaggcggaggctgtagtgagccgaggttgtgcctctgcactccagcctgggaaacagagcaagactctgtcccccccccaaaaaaaagaaaaaaaaaaaaaaaaagaaaacagggacattattatgaatcatacagaatgaaaaaggattataggagggcattaggaagagttgtatgacaacaaattgaataccctagatgaaagggacaaacttctggaaatataaaaaactgtgaaagacaaaaattatgaaaatctgaatggacctatacctagttaggagattgaatcagtaatcaataatctctcaacagagaaaagctgacttggagggcttcacaggtgaattctaccaaacatttatagagaagctgatactaatctttctcaaacttttccaaagtattgaagaggaagaaatacttcctaatgcttttattatgaggccaacattaccctgttaccaaagccagacaaagatattatgagaaaagaaaactacaaaccagtatcccttatgaacactgatgtaaaaattttcaacagaatactagcaaaccaaatttagcagcatattaaaaggattatacaccatgaccaaatggcatttattcccagactgcaagaatggttcaaaatgtgaaaatcaatcagtgtaatatatcatataaacagattgtagggggaaaaaaaccccacgtgatcatctgaatcgaagcagaaaaatcattttgacaaaattcaataccctttcatgacaaaaatcactgaacacataaggaataaaaagaaactacttcaacatagtaaaagccatatatgaaaaacccatagctaacatcttactggtgaaagaccaaaagcttttcctttaagattgaggatgagataaggatgcctgcttttcaccacttctattcaacatactactgaagttctagctagaccatttaggcaagaaaaagaaataaaaggcacacaaattggaaaggaagaggtaaaattatctctgttcatagatgatatgaccttgtagatagaaaatcctaaagatcccacaaaaaactatcaatgctaataactgaattaaacaaagtattggggcacaacgtgaatacacaaaaatccgttgcatttttatacacaaacaaacagtgaacaatctgaaaaggaaattacaaaaacaattccatccaaaagaataaaatacttaggaattaacaaggaggttaaaaacttaacaatgaaaagcagaaaaacattgctgaaagaaattaaaggcaacataaataagtggaaacatatcccatgtttgtgaactggaagatttaatattgttaagatgtcattacctacccaaaggcctctacagattcaatgcgttccctatcaaaatcgcaatgatgtttttttgcagaaaaggaaaaaaaaatctaaaatttatatggaatcttgagggactccaaatagctaaagttatcttgaaaaataacatagctggatgactcaatgtgctgatttcaaaatttgctaagaagctactgtgaccaaaacagtgtgttactggcataaagacagacatatagaccaatggaatcaacgggaaagtccagaagtaaaacctcacctatatggtcaaatgattttcgatgggggtgccaagacccttcaatggagaaagcacagtcaattcaacaaatggtgccaggacaactgggtatccatatgcaaaagaatgaagttggacctttatctaagtttgtatacaaaaatcaactcaaaatggatcaaagacctaaatgtaagaccccaaactataaaactcctagaaaacatagggcagaagcttcatgacattggatttgtcagtggtatcttgggaatgacaccaaaggaacaggcagctaaagaaaaaaaataaacaaattgttctttatgaaaatttaaaaaatttggtgcatcaaaagacagtatcaacagttaaaaggtaacccagagtatgggagaagatatttgcaaaccttatatctgataatggatcaatatcaaaatatataattaagaactcaacaatagaaaagcaacatgattttaaaatgggcaaaggacttaagtagacatttttccaaagaagatacgccaataagcacatgaaaagatgcttagcatcactaatcatgacggaaatgcaaatcaaaactacagtgagataccacttcacacaaattaggatgactgctatttaaaaaaccccagaaaataagtgttggggaggatgtggggaaattggaagccttgtgcactgcgtggacgtgtaaaactgtatagccactgtggcaaacagtatggcggcaactcaaaaatttaaaaatagaattactgtatgatccagcaattccatttatgtgtatgtacccaaaagaattgaaagcaggatctcaaagagatgtttgtatgccagtgttcatagcagcactattcacaatgactaaaatgtagaagcaaccctcatgtcatttatctgaaaacaaaatgtggtacatacatacatatcataaaatgtcattcagcattaaaaaggagggaaatgaagacacatgctacaacatggttgaaccttgaggacattatgctaagtgaaataagccagccacattaaagacaaatactatatgactccacttttatgagatacttagaggagtcaaaatcttagagccagaaagtagaatggtgattgccagaggctagaaagaaggagggaactggagttactgtttaatgaatttagagtttcagttctgcaagatgaaaagagttacagagatggatggtggtgatggtgcacaacattatgaatggatttagtaacactaaagtgtatacttaactatggttaagatagtaaattttttatgcatattttattgcaataaaaaatgaaaacagtttcaatctaggaggattttggatgcatctatgccttgagaaatgaatggtttgatgtaaatgcatggtagcaagaataaataattatgttaattcatataatatgttatatatagttttaaagaaaattctatcactgtcttcctatgggtagggctataatgtccagttctttcagggattaagagggtagggtctgaagttaatccttgtttgtcgtaatgttattaatttattcaaccaagacttaattgagaatgacctagcaaaagagacaatctgttcaaattaaccaacttgagtaccatttcaatttgaaaactctgtctctggtgttggaggtcattcttcaggaaccaacatggttcttgggaaggtaaacctcatgtacaaagtcactcaggaataatacttgaccgctgggtgtggtggtacacgcccggaatcccagcactttgggaggctgaggcaggaatatcacttgagtccaagagtttgagaccagcctgggcaacgtaggaagacagcttctctacaaaaaagattttttttaaaatgagccaggcaagatggcatgtgcctgtagtcccggctgcttacggctgaggtgggaggattgcttgggctcgggaggttgaggttgcggtgagctgtgattgcaccactgcactgtagcctgggcaacagaacaagagcctgcctcaaaaaacaaaacaaaacaaaacaacaaaaacaaaaaaaaaaaagaaaaaaaaagaaacagaaagaaaacaataatatttgacagaataaattccagggtcatactggaatatgggggaagagtatgaaagtatgaattggacagataaggattctaatcgtggttctatcaccaccagctaatcttctgaccctccatttcctaacgtcaaaaatgagaacataatatcagtgtcataatgttaagaagattatattcattcttataaagtgataacttagaagccgttcaattcagtatttattgagttactaacacaggctcttgctgtgttgttagtcgatctactaactaaagtgtgagatctggaaagggtggtatcagccagtttcagagaaaacaaaggaaactgggaggcttcatgtagttgggccttaaccctgggccttgaagcatacattttagatggtatggtgggattacagtgggattactggcatttagtgggatggaaaagggagagattttatttattaattagattcagttacgtgcttattattctttactgattctaatttagtaatgggaacctgtaactttttactcttcagctactttagggttaattgggttaacggtgatgaagtttggatcattttattaacagtgatagtgttgcaggaccccaagggagggctcttggatctggcgcgagaaagaattcagggcgagtccatggtgcacagtgaaagcaagtttattaagaaagtaaaggaataaaagaacggctactccatagacagagcagccctaggggctgctggttgcccatttctttcttttcttttcttttctttcctcttctcttttctttctttttttgatggtgtctcgttctgtcactcaggctggtgtgcagtggcgagatcttggctgactgcaacctccgcctcccaggttcaagctattcccctgcctcagcctcccgggtagctgggactacaggtgtgtgccaccatgcccggctaatgtcttttttttgtgtattttagtagagacggggtcaccatattggtcaggatggtctggatctcctgaccttgtgatctgcctgccttggcctcccaaagtgctgggtttacaggcgtgagccactgcgcctggccggttatttcctaatgatatgctaaacaaggggtggattattcatgcctcccctttttagatcatatagggtaacttcctgatgttgccatggcatttgtaaactgtcatggggctggtgggagtgtagcagtgaggacgaccagaggtcactctcatggacatcttgcttttggtctgatttgtccggcttctttacaacctgttttatcagcaaggtctttatgacctttatcttgtgccgacctcccatctcatgctgtgacttagaatgcgttaattgtctgggaatgcagcccagtaggcctcagcttcattttacccagctcctgttcaagatggagttgttctggttcacacgcctctgacaatacaattcccaattgataagtgataccttggaatcagtgtgaattatttttacactactgcacacctgggaatggtgaatgtgtgaggcctgtcctctctcaggctcataggaaaagacagaaatgatcttgcttctttagggattgacagaacaaagacaaaggaccctagactttgggaatagaaatctgttgaaatgagctggaattggtaaaataattgattttgtttatgaattgataaaagcctactttcaattcatcaaatattgttgagcatgcaacagtatgctcccgtacctaaggtgcagtctctgccttagagttgtaatccaggaaggggctgcaagagagactcagaagatgtggtctgacaatatataagcacaatgtctgacccttaaagaatgacaggatttcaacaggcagacaggagaggaggaggaattctaagcaaaggctttcacatgtaaacggtgaattcttagataagatctgttttctatataccaggaacagtttgctggcatttgaggacgaggagtaagttcaaatgaaaactttaaaatgtttccccaaagtgttcatatgaaattttaaggatgtgcctatggactgggaataatcaaataacataaaataaacataaataacataaaccataaaataataccattttttttctacttttaaaattgggcccagaatatagcttgcagtgttttcttaattgataaaacttcagttcatcaccttcaattaatatgttaatgcatgaccatttgctttgtatatatctaggctatatttataattgtggtctgtcttctttggccaagtatgtatgtattccgttatctcttagctcctttgtattcaggctatgcacatttattataatattgctctattccatctttaattaggcaagcaaatattctaataaaaagtttcaaagtgaattttgcattatccagtactagatacatattctgtaactttggggcaagatatttgccaggcttataaaactagatataactatccataaataaaattgcctcaataagatttaatggaagagaattaagaagctgtggaaaatgaataagaaaaggaaaaaaatattattttcgcagtttacttttttttttacttgggatcatattcttttctgaggttttactcgaaaaagtattttctctgtcattactttctttctctctctatctttctcttctctctctctctttctctctttctttctgtctttctttcggctggagtgcactggtgcaatctcggctcactgcaacctccacctcccgggtcccagttaagcaattctcctgcctcagcctccctagcagctgggattacaggtgtgcaccaccatgcccagctgatttttgtatttctcattactgtttcagagactattcagagagtattcagtgttatagtattttccttaaataagattatcacttagggatttggaatcacgttaataaaattattcaacatacttttactgagtaactactctgtaccaggtaccgttggaacatataaagatgaataagacttcactatcggcataccaaaacattctatactcaatatattaatactctaataataataatgtgaacaaaatactttaggaatacagaggaaggaactgttaattctgtcacgcagtttggacattagagttggtcctggtaggatgaatataaagttgcccgattaaaaaaagatgggatggatggacagggcatgacattcccaatagagttctttccctgttttttacaaaaaaagaaagccaaacttcctaggaatcataacctttgatacattgtaaacaaaatgtttagtagatgactatgaaggatggactcaaatggaagagtggttaaaggggatttgtggggttcccttttaaaatcaggtgttcagcaaacaagaactaaaaagattagtgggatcttgaacaaatgattgcgagctcaaaattctaaggaaggaactcagttgcacctgcttttttgtaatagcaaatacaaggaccttcagtgttaaaaacattcatgagagattagctaacacagaacagaagattctcaaacccaatagcttgaggagaaaatccatcttctcattaactggaagattgtcaatataaggagatgggagtaattctcagttactttcatataatcctactttaaaaagcaagcactgcgggagtattttctgttgatccgttggttcaaaaagatgctctcacaggagaaggctcatacaggctggatgatgagctcattattaagacatgtgatggtcactggatcccacaatatttctgacatgtttattcctcttgctgattttctgactttttattgttgttttgtttatactgagagctgctgacatgtgaatatcccaatagctatcatccctgaaagatgtgctttttaagaatgaagactgcagtttttctggagtcagcctcttgtctctttctcctggctcacacttcacaaaatgagaattttttcttaagacaaacaaacaacaacaacaaaaaaaacgaagcagaactggatatagtggctcatgcctataatcctagcactttgagaggccaaggagggaggtttgcttgaggtcaggagttcaagacaagcatggacaagaaagtgagaccctgtctattacaaaaaaaaaaaatacaaaaattagctgggtatgttggcatactcccacatcctagctacttgggaggctgaggtgggatcacttgagcccaggtgtttgaggttacagtgagctatgctcacaccctggtactccagcctggtcaacagagaaagaccctgtctcgaaaaataataaagatacactgaccagaagcttcagtctgatccattgtcaataaagaacagtgcaagagcaattaatattttacaaaatcaaaaaagaaaagctagcaggattatttcattagcatgcttctcttcatatgcacctttgatttaaaaatcactctcctgtagttttttatttcttcacaattatcagttggaaactaaatttgttcatctcgtaataagactgattctgtatgcatcatagaattgcaaacattaagtaacaaagtccatgtaaagtgtttagaacatagcacttagtaaatagtggttattattgttgtcactatccccactgtctttctttgtagatatttactttcaccttttcttctatagcagagccactaacaggtaatagagaagtaactagttagatcttaggaatttaagaagcacttcaagatgtggacagaaaaggatttggttcagattgcatactcttaggctatggagatggtacctgcaattcccatagaatgtgtataaagcactgtattgcattagaggccatgggattacaaaagctattctttgtaagacatcttagaatgttgttgatgtgtgagaataaaatcatattgaaaaaatatagaaaagttaccgtctttcatcagttctaagatgcagggtctcaccatcttgcccaggctggtcgtgaacttctgggctgaagccatcctcctaccttggcttcccaaaatgctgggattataggtatgagccattgcacccagctaattgtttttgttttaatcaattaccatatttttagcactgctgtggcttatgctttgttcctttttactactacttgctttgaatgatgcttaaaatggacccttaggaagatgactgtattgaattattatattcagaacaattgatatactaatttaaaaagaatatacagtcccaagtgatagaataaacaagagttactgcttagtatacaataaattttgtattcatttgatttccctcagaagtctgtattcgaaatctgagtttccttctatttatatgtaggttacaaagtttttaaaaaggcaacaaaaaaaaaaacatttatttctgctcttcttaggcaatatggccttttggctagaactcagaaattaaaagcttgatttgttggttgtgtaggcatcttatatctaaggaattattttggcttaatttggggataaaatattaattacacctaataagcagaaatgtaattatttaagacagttactgtcttacacatttttcacttaagatatgaagaagtggttaacgtaatttcttcttctgggacttaaaagaaatgttcaaattaaccactatttaggtttgatcatgcctttggaaggaattggtattatcctttgaaaatgaaaaggcataatttgttgaaggtacatagaattgtacaaaaagaaatcagtaattttcccatttttactattaagttatatcataagcagctattttgaatgacagtatgaaaaagtatgtttgtgttttaaggaggctgtttttgaattaggaaagataaatacgctggtatgaagatcagctcattcaggagcaggcattttcctgcatactaaggagctttaaaggttagacagtaaaaagaaggtgatcattatgtagtctgctccacctcatgcctaccagaaaatttatttcccagcctccctaacttttctacttcaatatacagctaactgttaatgagccctaactctgacctgggtatgtgcccaggtcacatacatcctgtcatttagtcctcaccataatctctgagtgcacagtagatgctgttagaattatctgtattttatagtacagaaacagcctcagaaaagtgaaataacttccctcaaaataaggtagctagtaaatggcagagctaacattcaaccttatccatgtctgactacaaagtaatccatccattacttaccttttttcatggtaagcttttgctttttggtcaacactatgcattgtgccttgagtacatgtaccaacattggaagaccattcccatgtgatatttgtaatagaattaggtattcaaatcacgcattcttgagacaattaaagaatgtaggatttatttacatacaaagttgagagaatgtgcatcatgctgtgtcaggcttcctttccatgattctgttagttttcagtgcaggtatttgccacctgacttgggtttcctagatgtctataatcaatgaaatattttctcttttgaaaaactatttttaaaatacatgttttaacagtgttgaattacaagatgttttaagataatataaacctggacccaaatttctatgtaaatgtttattttatagagacaagtaaattaaccaaataattcagtgaatcttcattgagaacctaatatgacctaggtactgtgctaggtgtcagagaccggctatatggtttagtagaaagagaaatggtagacgctgtgccaagcatagtgcctggaacaagcagaaagtccataagaaatatatgttaactgaaaggaagaacaaaatggaaactgtgtctgtctgagtcacccaaattagtaatgtctgtgagtttatttcctcatctgaaatgaagggtaataaaacctacctcagaaggattgttgtcaagattaaacgagttaagatatgggaatatgtccagaactgtgtttggtacatattagatgtttaataattgttagtcatagtgcgaaaaataagtaacacattattcccattctcaagcaatgtcaagatttaaaatcggattcttatccaccatatcgttagacttcagttgccttgttcttctatttgctttattctgcctgagcttcactaacaatccacagggcttttggactctacaaagaaaacacacacacaaaaatatcatacactcttctatatctactcacatctgcactcaaatttaattctgttctgtgaaaaagaaaatcggcacaaagttattgcttaatactgtcaaatactttttaaaattagttgccctctgtaacaataggagagcatggaagaataaacaagcagcagaatgatgtcagagaaactttggccacagaaggagatcagtaggtattggaatttgaacagcttatttttcacttacttctatacacaatatggatcttacagatttattgtaacttttttctccgatttaagaattgccagaaataaagctgagtgacaagaaaaggatgtgtgtacatgagacagagggcgctgtttatgcccatctgtacagaatgtcattcgttttaaatatgattttcctctttttcctcacagaaagagaaaatggtatatttctccttctatgcaacagagaactgattttttttttaaattcttattactgtttttttttgaagtataatagaaacaaagcagtgtttttctttgttaaggtcagttcatgttttagtaatgtgtcttgagctttctgtattttctgagctaaccatttaaaaaattttgacttctacaccaattattttatgtgtgattgtttaaattctatgggtcttgttgatgaccttcctatatttattgtcattgaaaacattcaatatgtaaatataataaacgattatatctttaagaaaataaaagttttctaaaattaaatgtgaattatcattaaagcataaaatgctgtgactataaggtaacattaaaaaaaaaaaacaaagagagctgggtgcggtggctcatgcttgtaatcccagcactttgggaggctgaggagggtggatcctgaggtcaggagatcgagaccatcctggctaacacggtgaaacccagctctactaaaaatacaaaaaattagccaggcgtggtggcgggcgcctgtagtcccagctacttgggaggctgaggccggagaatggtgtgaacccaggaggcggagcttgcagtgagctgagatggtgccactgcactccagcctgggtgacagagtgagacgccgtctcaaataaacaacaacaacaacaacaacaacaacaaaacccagaaagagatgacttccagccagaaggcgagactctgtgggaaaagccttccttctaaggggagggtttgggctgctatttttcttactttccttgagagcagcttcaggactgtacttgggtcactctacaagctgtttcctttattttttctctctcaacaaagatttacctgtccatttataaagtgcagattgtttctctaagatggcagataagaggcttgtagcatgcctcagccacttggaaatggctagatagtgcatgaagataaactgtatgagctttttttcaagaaggaaaatggggctgggcgcagtggctcacgcctggtaatctagcactttgggaggctgaggcgggtggatcacgaggtcaagagatcgagaccatcctggccaacatggtgaaaccccatctctactaaaaatagaaaaattagctctgtaggcccagctactcaggaggctgaggcaggagaatcgcttgaacttgggaggcagaggttgcagtgagccaaggtcgggccattgcactccagcctggtgatagaacaagactctgtctcaaaaaagaaacaaacaaacaaaaaacaacaacaacaacaacaacaaaaggaaaatgggaatccactggaatcgtgagggacacccagatcctggtgagcagaacactggcaaacaacctctgcgacagtgtctggtggataaaaaagatcctggtgtagggaggccctttctgctttacacctaggcagatctccaggcatttggagcacctgcttatctggttcagcagcctgagccacgcaactcttcctgtgggacagtgggaccctctctgctctaagcccaggcaggtctgcaggcatttggagcacaagcttacttgggtcagtagcccgagctgctccatccttcccgtgcagagatcctcatatagggggactctctctgctccatgcccagacagatctccaggtattcagaacacctgcttgcctggttcagcagttcgagtcaccctaccccttttatgcagagatcttggttcagggggagcccactatactacacacctaggcagagctcttctggatttggagtttagggcatcccccattcctgtgtagagaagttgatgctgaagaggtttcccattcctgtgcagagaacttgatactgaggagctccatgcctaggcatacctctgggtgcttggtagccacccattggattctctgtcagtgctggtgcttgtgcctgtatcaggggacctttaggtggacctgaccagtctggccccatgcccttggggctgagcagggagctcagaccactatgcattctatgtatcagcccattgtctgaggcaacagagaacttctgccagtaaacaaggatcaagtatccagctacattggctgcaactggctcttacctataagcatcatctactggcatgtagattgaactgcacagcctgatacaaaacctaccagaagaactggtagaaacaaaaccaaaggcagagcaaagatagaagcaaaacaaatagatcttacccaaaataatctgtagtcatacccataggaagcaggggaaagggaaagagaaggaaaaaaaacccagtaacattatagaggaagaaaagagaaagaaacatcctacctacatgaaaataattacaaaaattagaagtgctagcatcttcagctgagaaagaatcagcacaagattactggcaccattaaaaatctgaatgtagtaacaccaccaaaggattgcacaagctttccagaaatggttcctaaccaaaatggaaactcagatatgacagataagtaattcaaagcatgaattgcaaggaagctcaatgagatccaagacaagactgaaaatcagcacaaagaagcttctaaagctatccagggaatgaaggaagagataaatatcttaaaaagaaatcaaccagttctggaattgaaaaactcacttaagaaatttaaaaatacaattcaaagttttattaatggtttggaccaagtagaagaaagaatttcagaacttgaagatcagtcttttgaattaacccagtcagacaaaaaggaagaaaaaataatttaataaaataaacagtctttgagaaatatgggattatgtaaagtgaccaaaactacaaattattggcattactgagagagaaggaaaaaaataagcaacctggaaaacaaatttgaggaattaaagaaaatttccctaagcttgctagagaggtagacatccagttacaagaaatcctgagaacacctgtgagatactatacaaaatgaacatcactaagtcatatagtcaccaaactgttcaaggtcggtgctaaagaaaaatatcttaaaggcagctagagaaaaaggtcagattttgtacaacaggagccctatcaggccaacagcagacttatcagcagaaactttacaagcaaagtgagttgggggggctattttcagcatttttaaagaaaagaaattgcaaccaagagtttcatgtcctgtcaaatgaagcttcataaatgaagaagaaataaaatttttttccagacaagcaagcactaagggaatttgttaccactagaccagcctcacaagagttccttaaaggtgttctgtattagtgtgctcttgcattgctgtaaagaaatacgtgaggccaggcatggtggctcactcctgtaatcccagcactttgggaggccgaggtgggcggatcacgaggtcaggagtttgagaccagcctgaccaacatggtaaaaccccatctctactaaaaatacaaaaattagccaggcgtggtggtgcacacctgtaatcccagctactcgggaggctgaggcaggagaattgcttgaacccaggaggcagaggttgcagtgagccaagatcgcaccactgcactctagcctgggtgacaaagtgagactctgtctcgaaaaaagaaaagaaatacctgagactgggtaatttataagaaaagttcaattgacttatggttctgcaagctatacaggaagcatggcagcatctacttttggagaggcctcaaggaacttttactcatgccagtaggtaaaggaggggcagccgtcttacaaggcagaagcaggagagggaagggtggtgtgacacctccctcccacccagtcccacttccaacactggagattacaatttaacatgagagtttttggggacacagatccaaaccatatcaagttctaaatatggaaacagctgctgccacaaaagcaccttaagcacatagcccacagaccctataaagcaaccgcataatagaaactacaaagccaccagctaacaatttcatgatagggtcaaaacctcaaatgtgaatattaaccttgattgtaaatggtctaaacagtctacttaaagggcacagagtagcaagtttgataaaacaacaagacccagtcatctgctgtcttcaagtgacccatctcacaggtaacaacacctacaggctcaaagtaatgaataacaaaaaagagcagggcttgctattcttacatcagataaaacaaactttaaaccaacaacagtaaaaaaggacaaagaaaggcattacataatgatagaggattcaattcaacaagaggatttaattgtcctaaatatatatgtacccaatattggagtagccacattgataaaacaagacctaggaaaagacttagacaaccacacaataatagtggggaaattcaacaccccactgtcactattagatcactgaggcagaaaacgaacaaagaaattctggacttaaagtaaacacttgaccaattggacttaataggcatctacagaacacttcactcatcaaccacagaacatacattcttctcatctgcacctggaacatactccaggattgaccacatgttcagccataaagcaagtttcaataaatttgaaaaaatctaaatcatagcaaccatattctaagaccacagtggaataaaaatagaaatcagtaccttaaaggactcaaaaccacagttacatggaaattatacaacttgctcctgaatgacttttgtgtaaacaatgaaattaaggcagaaataaaaaaaatttaaataaatgaaaacagaggcacaggtaccaaaacctctgggatgcagcaaaagtagtgttaagaggaaattttatagtgctaaatacctaccgcaggaagttagaaagatcccaatttaatgatttaatactacacctaaaggaactagaaaaacaagaacaaacatttcaaagctagcagaaaaagagaaataactaaaataagagcagagctgaatgaaattgagacccagaaattaatataatcaacaaaactaaaaattggttatttgaaaggatacacaagattgatagaccattagctagattaacaaaaaagaagttcaaataagcacaattagaagtgacaaaagtgacattacaaccgatcccacagaaacacaaaagatcctcagagactattatgaacacctctatgcacacaaactagaaaatctagaggaaatggatgaattcctggaaacacactgtgatggttaatactaagtgtgaacttgattggattgaaggatacaaagcattaatcctgggtgtgtctgtgagggtgttgccaaaagagattaacatttgagtcagtgggctggggaaggcagatccacccttatctggtgggcaccatctaatcagctctcagggaatataaaacaggcagaaaatcatgaaaaagggagacaggcctagcctcccagcccacatctttctcccatgctggatgcttcctgccctcgaccatcagactccaaattcttcaattttggaacttgaactggctctccttgctcctcagcttgcagcctattgtgggaccttgtaatcatgtaagttaatacttaacaaactcccgtttatatctatgtatctatctatgtatctatgtatgtatgtatgtgtgtgtgtatctatctatctatctatctatctatctatctatctatctatctatctatctatctatcttattagttatgtccctctaagagaaccctgactaatacacacacaatctcttaagattgagtcaggaagaaattgaaaccctgaagagaacagtattgagttctgacattgaatcagtaatttaaaacctaccaactagaaaaaaaaaaaaaaaatgccccagacaaatggattcgctgccagattctgccagatgtattgtacaaataggagctgctaccaattttgaaactataccaagccagtgttacctccataccaaaacctggtgaagacacaataacaaaaaagaaaatgacaagccaatatccctcatgagtataaacccaaaaatctacaacaacatgctagtaaaccaaataaaacagcacatcaaaaactttattaccatgatcaagtaggcttgattcctgggatgaaagttgattcaatatatgcaaatcaaaacgtgtgattcaccacataaacagtattaaaaataaagaccatatgatcatccccaatggatgcagagaaagcttttcacaaaaccccaaatcccctcatgataaaaaccctcaagaaaccaggcattgaaggaaaataataataataataattattattataataagatccatcaaataataagatccatcaaaataataagatccatctatgacaaacccatagccaacattatcctgaatggacaaaaactgggagcattctccctgagaactggaacaagacaaggaagcccactcttaccactcctattcaacatagtcctggaagtgctagctggagcagtcagtcaagtgaaaaaaagaaaaggcatccaattaggaaaagaagaagtgaaactatttctctttgcaagtgatatgattatatacctgtaaagtcccaaagactccaccaaaaggctcctgaaactgatcaatgacttcagtaaagtttcagatgcaaaataagtgtgcagaaatcagtaacgtttttatacaccaataacgttcaaactgagagccaaataatgaatccagtctcatttgcagtagagatacacatgcacaacacctaggaatacatctaaccaaggaagtaaaacatttttacaaggattagaaaacactgctgaaagaaatcagaaatgacacaaacaagtggaaagacattccatgctcatggattggaagaatcaatatcactaaaatggccattctgcccatagcagtctacagattcaacactattcctatgaaactaccagtgtcatttttcacagaattggaagtatgctaaaattaacatagaaccaaaaaagagtccaagtagccaaagcaatcctaagcaaaaagcccaaagccagaggcatcacattacctgacttcaaactatactataagggtacaataaccaaaacagcatggtcctggtacaaaaacagacacatagaccagtggaacagagtggagaaccccaaaataaagccatacacctacagccatctgatctttgataaagtagacaaaaataagcaatgaggaaaggactccctgtcaataaatggtgctggggcaacttgccagccataggcagaagaatggaactggacccttacctttcatcttatataaaaattaactcaagatggggaaaagatttaagtttaagatctgaaactataagaagctaggaaacaccattctggacatagactttggcaaataatttatggctaagtccttaaaagcagttgcaacaaaagtaaaaattgactggtgggacctaattaaaccaaagaacttctgcacatcaaaagaaactatcaacagagtgtacagtctacagaatgagagaaaatgttggcaaactacacatctgacaaagtttttttaatagaatgcctattattaagaagtaaaaaacaacagattttggtgaggcagcagagaaaaagagaaaagggagtacttatgtggatgggaatataaacctagttcagccactgtggaacgccattggaggtttctcaaggagcttaaagcagaactaccattcgatccagcagtcccattaatggatacatatccaaaagagaacaaataattctaccaaaaagacatatagttgcatgttcatcgctgtgtgcagaaatcaatagcgtttctatgcaccaataacgttcaagctgagagccaaataatgaatccagtctcatttgcagtagatatacacacctacaacacctaggaatacatccaaccaaggaagtaaaacatttttacaagaactagaaaacactgctgaaagaaatcagaaatgacgcaaacaagtagaaagacattccatgctcatggattggaagaatcattgctgcactattcacaatagcagagatgtggtatcatcctaggtgcctagcaacagtagactggatgaagaaaatgtggtacatatacaccacagaatacaatgtggccttaagaaagaacaaaatcatgtcctttgcagcaacctggatgcagctggaggtcattattctaagtgaattaatacgggaacaaaaaaccaataccgcatgttctcacttagaagtgggagctaaacattgggtactcatggacataaagatggcaacagcagaaactgaggactgctcgaggttggagggagggagcaagggttgaaaacctaactggtggaaactgtgttcactacctgggtgatgggctcatttgtaccccaaacctcagcatcatgtaatataccctggtaacaaacctgcgcatgtacccccttggttctaaaattaaagttcaaaacacaacaatcccagaaaaatttattaaattcaaactatcagtttcaggcacatattttcatcctttttagaagtacttttgagctgaaattgaaatgtcaaataacatatcatttgaaatacatgtttggttgagtattgccatcacatggtattaaatattaaacattattttatgctgttagcgggtcacaagtttcagtgtgtaatgaagaaaatattatctgtttgatgacttctgtgctctgtgatagaactgtgtgtatttatttaccatagtaacaggctttgttctgttagtgaatacttaaatgtgattattaagtgttatgtgaatataactatttcagacatagtctataactgctatacacaaattctataggttttgggaaataataataatgaaaagatgcctctgcctcatatataacagtccctacagtaatcaggacagacgtctttagaaccaggtggtttgtacccagtgataagttaatatgtaataaagtcttgctataagtgaatctgagaaaaaagctacttttaataaatacatggatttttttttaaacagaaacctttaacagaataaatttataatattttagagtcagtgcagttatacatatgtttcttcatactgcttactgtctatgtgaccttgggcaaattcactcatctccgtgtgctttagtgtttttatctgtcaaatggttataataacagtttctatctggtacggtacctgtagttgtacctggcacttagcaaacactgtgttatcttttattatcattgtgtatacgccattcagagtacgtgggcacagtgtttgaggcacctactaaagccgggcacagtgtccgaggcacctactaaagccgggcgcagtgtccgcggcacctactaaagccgggcacagtgtccgaggcacctactaaagccgggcacagtgtccgcggcacctactaaagccgggcacagtgtccgaggcacctactaaagccgggcacagtgtccgaggcacctactaaagccgggcacagtgtccgcggcacctactaaagccgggcacagtgtccgaggcacctactaaagccgggcacagtgtccgaggcacctactaaagccgggcacagtgtccgcggcacctactaaagccgggcacagtgtccgaggcacctactaaagccgggcacagtgtccgaggcacctactaaagccgggcacagtgtccgaggcacgtactaaagccgggcacagtgtccgaggcacctactaaagccgggcacagtgtccgcggcacctactaaagccgggcacagtgtccgcggcacctactaaagccgggcacagtgtccgcggcacctactaaagccgggcacagtgtccgaggcacctactaaagccgggcacagtgtccgcggcacctactaaagccgggcacagtgtccgaggcacctactaaagccgggcacagtgtccgcggcacctactaaagccgggcacagtgtccgcggcacctactaaagccgggcacagtgtccgcggcacctactaaagccgggcacagtgtccgcggcacctactaaagccgggcgcagtgtccgcggcacctactaaagccgggcacagtgtccgaggcacctactaaagccgggcacagtgtccgaggcacctactaaagccgggcacagtgtctgaggcacctactaaagctgtaggctggaggttcttgcacttgagataagccccgattacaaaataacactctgtggaaggtgttttatatttgcagcttacctgtgaatattccaagtaaagtcactgctatttgaagccaacccagctgctttcctttatcagaaaagaatgttcccctgtgaagcctttttatactgtcctaacaacccaaatccaggaacacaacccctgctcccaactcaaatggactttttcacccagtcaaatcaatgttggttctgtctgtccattttctttacattaggaaatgacatgtagcccaaaggacaaatgttttaggggatggataccccattcttgttgatgtgcttgtttcacattacatgcctgtatcaaaacatcttatatagcccataaatatatacacctactatgtacccacaaaaattacagaaaaaatagcatctgaaacaaattgccaaacttatgcataggattgagtgaagtaaattaattttgagtctcaaaatgttgctggtgtatttaatttttaaaagagcttaagatagtgggctttcaggtttacattttagtttattgctttcttaaagcagttaactatcattaaaagatggttgcactttaaaagttgattcgggagagtagtatttattgtccaaagtttcatattcatctttaaaagatgtacgtcaaagtaatttttttcttgttttgtttgatagagttctaaatacatgaatatagctttaagagatggaccttaaattgcaatttaatttcagactcaatagacacacgatactctgctaccattttggcagtgttataagcctattgattatttctgatattatcagtgagcagcttttgtagtggtcaaggtgctatataaatataatgatttcttactgactttctgtaaacttacgtgtttggactggtgaagatttatttctagaaataaaatattctcatatgaagtgtgaacattgtatttttacacctagtttatgtgaaaaatatctgtattgtgtattatagttttgcagtcactgaaaatagtgtactgaattcagctgttttcttcaggtagctattccatgataactgagtttgtcaagcaacaattgaagatttgaatgttggactatgaaaatgaggtttcagcagtcacagtcatcacagggtgagaatagattagatagtgttgccaggttttagaagacagagtattagaacctagtatcagtaaggaggaacacaggaatatagagaagaccatttttgagttttagattttatagaatttttagacagttttgcaggtatatatcaagagagggggagggaaaggaatgcgtttgaatttattctgcaggtgcctgcagttattaatgtgctctataattgtgtcatgccagaaggtgacttaatttgaaagtaagctaacatggaacagacttgactacctgggggagctgctcttagaagaaaagagataaagtttaatataaacagtacaaaatcacctatccagtggggaaataacttttgagtttggagaacattgtatctaaggaacagttgccaaagcagatattacagtgaaaggtgagatcaatagacttaacgtgacctgatcttattagttgataagaaaaagttttggaagtacataaatacaaacacacattttttaagggtgaaacagaaattatatttttcatgttactttaggtaaaactgttttgttgggctgtactactatgatgatcaaatataaccttaattgaaaatttttatagagcttattttttcagaaatattttatcccagtacatttaggaaattacaaaaaaaaatacaaaaaaaacaaaaaactaggatccatactgggtgcatttttgtgaattaaaacctgaaataattgtttaatagtttccatatttgtgttgtattttctgtgttttgtgtggagtatcaataatcaggccaggtacggtggctcatgcctgtaatcccagcactttgggaggctgaggtgggcggatcacttaaggtcaggagttcaagaccagcctggccaacatggtgaaaccctgtctctactaaaaatacaaaaattagccaggtgtggtggcaggcgcctgtactcccagctacttggaaggctgaggcgggagaatcacttaaacctgggaggcaatgagccagagatcgcaccactttgctccagcctgggtgacagagtgagactgtgtctcaaaaacaaatgaagaaacaaaaagcaatgatcatactataaaaaaatcaaatactaaaaaaaaatcccagtaatcacctattttaaaatgcactttgtagttttcgcatcttgttcttgatcttatttgaccctcagagaaatactgtgaattaggtaaaagaagtcagagagcggctgggcacggtggctcatgcctgtaatcccagcactttgggaggctgaggcgcgcgggtcacgaggtcaggagattgagaccatcctggctaacacgatgaaaccccatctctagtaaaaatacaaaaaaaaaaaaaaaaaaaaattagccgggcatggtggcgggcgcctgtggtcccagctactcgggaggctgaggcaggacaatggcgtgaacccgggagacagagcttgcagtgagccaagattgcaccactgcactccagcctgggcgacagagcgagactccatctcaaaaaaaaaaaaaaaaaaaaaaaggaaagtcagagagcttttgcataactggcccagagggtgtggtagatggagctacactcagactttggagcctgactaataacacaattagagcatgagcaagaggaaggccaggggcagctttgacatgggaagagagctacttacatactgaccggtaattgataatgggaacaaacgacctgcccaaattactttccaaaaagtctctgttgggagacatttcaagtttagaaatgaacaattttgagatgatctgggcagatttgaaatcttgtgaaatcccttcaaaatccgaaaatgagtgtgtgagagcccagcgtgtgttttgtgaagacttctcttgtgtgtcttgtattgcttagagggcatgatttgatgacatggtcagaacattctgggcagaatcgttacatcatcagttcttgtcatattggctccaaccttattttcttacggttgcttttcagttttatgaaacaatttcctccaaacaccttatcagtggctcagtatccgaaccttttactccaaatacagtttcaaaagagatatgctctctgcctgttaactatttcagttgagacccaaccttacatcaatagaatgaatctctgcaacggttggtttcagcaaggtggtgagagggattttgatggtgagggacagcgaagcaggaaagggtatgttctcatcactcatgaaaacttacttctcagatagcgtttgctcataaccgctcgctaatccaggcagtacttatccaggttctcttgctacctggattttttaaggataaaagtctaccaaaatttttcaaagcaaattctgtaatctactagaagaatttatttttttgaaggcaataggtgactcttagctagaaaataaaaagtgttaactgtcgtttctatttactttgggaagcattttgccaaacaaaaaggcctcttttaggtgtgggaaatgagtgatgagtagctgactcaggagccgcagctagcctctcttatatatagtctatgttcagagtgcggaaaaaagagaagaaactgctttgtgacagtttcccacgcacaagagatattaatgaaataaaatgtttttaactcgtgtgtatatatatatatatgagtcccatgttaaaaaatatatatatatatatatatagagagagagagagagagagagttatccttctctttcttaaaccacagtgctagaggcaaaatctgtcctggtagtctgttgaatgtgtggttgcctagacacacgttataaataattatttaattaatttttaaaaatggaacttgagattttagcattttgcttataacacataaaatttgagatctgggacctcagaattttcttctgtacttgcacacatgctttcaaatgtcattacctacttgagtccagcatctggcaattcgttatactgagcagctaatttttcattgtggttcctctgggtctcagtgcagagtcatacaacacagctgactacagagtagcgacctggattcagatcagctgccaaattaagtttacaattctgtaacattcaggtctaataagggagttatatacaaaagagcatttagtcttagttgatttagtagtttgatgtgtatcttcgtattttaacatataactaacgaagaaatatgctgaatattattttcttttaaaaaacattttaattatctgaataatcgaattcatccctatgtgagactgtaattatattaaacagtgtaatatatgtgttacatatatatatagtatatatgtataaaatatatatagtgtaaatgttagagtcaggcaaattgggttttgatttctgcagaaatactgttatttgggcatcttctatgtggctcagtttccacataggtaaaatgaaaattctaaaaataacttcatagggccattttagaaattaaataaagtcataaatatactattaatgcatattataaagtgtccagtaggtggtattcttattgcatttgatgtaatttatttatgaatttgaagcttcaagcttccttgaccgtaacaaatgcatacataacccagaatatgaacaattcactcttcaaaagttttactcacttgaaataatatactccacttatgataatgacttcattttagaaatcatattacttgggattggtaccctttctattacaacaggagccctagctactcaaatagacttactttccagtagaaaaatatatttttacaatccacatagaatctcatttgaacaactagagcaatgtccagagtcctcacttcttacttaaaataaaactacagatacagtaagatcaaggatcataccgtaagaacaaaggcaaaagttaggtagtaaaggggaagagaagaacgttttattaatttttttaactaaagaaagccaccataattgaatgtcaactttagctgtgacttttctggcagctagaataaaagtaagatcgttgtctgatagaactgaatgtctcagtttattagaacaacaaaatactgtaatctttctcaaaacctacatggaacaaactggaacaagtatttcatgaaaaccaaatgaaaaataagtaaataaatgatttcatcaccactgtcaccaaaaacaaatgaattttttggataggaaaacatggctaagttggtaattgactgagacattggcctggtgtgttatctgtggttgtattttattaaacttatatttacagaaatggaaaaaaactaacttttcatacagtttggtgtattcatagcaaaatatgaatagaaatcacctctggaatcttgatgaacaaggcctttagtggttcattggtgtagaatgaatatcaatttagagaaataggtctataagtcaggaagtgatgcagaaatgtcataaggcttattcataatcacaacatttttcagatattttccacgttaaatctgaaattttaatttcttagataaaaatctgttatttttgatttttttttacttttgttttgatttgtaaaatttctatttcatttctctctttaagggttgagattttcctaagtgtgagatgtctgcctctttcttaataaaagaggatctacatgtttcaaaaatacttttattcccagtatttctgttttttgtttgtttgtttttggagacagagtctcgttctgtcacccaggctagagtacagtggcacgatcttggctgactgcagcctctgcttcccaggttcaagagattctcgtgcctcagcctcctgaatagctgggattacaggcatgtgccaccacacttagctaatgtttgtgtttttactagagacagggtcttgccatgttgtccaggctggtctgcaactcctgggctcaagtgatccgctcgcctcagccaccatgtctggcctgttgccagtttttattcttatttttaaacttcatcttggaaataaaactaaaaaaaaaaaaaaaaaaaaaggcagtagctgctgaattcttttaggaactctatggagttcaggttcttggtctatttagccgtagtggaatttatgaaaatctaaaacattaatgatgcctaagaggcaggctgcctcactgagatgaatgctttgcctggcctgatagcagaattaaagaaaattgaaacttcagcgttttgaagatcactggggtatcatttggtatgtattcagaatagttcatgaataatgtttagatggagtccatataaacccaattcatagtagagtggaaaaatttttatatacagaaaactgctgtagccagatagtaaaagaagatatatttaactgtttatagtaggcaacagaaggcagtgtggaagagtccaatgaaaacagtgttaggagtgcttcttgtccctttttacacaactagaaaatataaagcaaaagtaatttttataacatatgccaaggatctactcatatggtacatgttttatatctgccataacagactgacatagcatctttcactgtcaaattgagttagctgtggtacatatcatggatggtttcaaagctattttgccattaataaggcatttacaaatactataataagtgcttatagtatatactgccggtcctttcagattgctgctttgcatgcatcaaatcctatttataaagtggtattatccaaagtgaatagggaaaatgatctagaaagtcaggattttttttttccacactcacaagtagaatccttctctctagtgaattgagtcagcatttcagaatggaaaagtctgatgtgcaaatagctagccccaagatacctataaaatggggtcactcaaaaaggtgaaaagtacaatgaatttacatttaagtgtccttggcctcttttaggtgtgggaaatgagtgatgagtagctgactcaggaactatagctaacctcttttatatatagtctatgtttagagtatagtaaaaagagaagaaactgctttgtgacagtttcccatgtacaagagatattaatgaaataaaatgtttttttaactcatatatatatatgagtcccatgttaaaatatatatatacacatatatgtacatatatacgtgtatatatatgtatatacacatatatgtctcccaagtagctgggactatagacatttgccaccatgcccaacaaagattggttggcttttattcattttttaaaaataaggaaaaaatccccaccttttacaaaacgtgtagaatgttatttctttctaatcttaactctcaatctcttgtgttcttagtccatcaagtaagaattctttctacaccaaactttcaaagtaagattcaaaataatcttgaaatagttaaaactctttccaagaattagaatgatttcataacaaaacatttgatatatgggccaacaaatagaatagatttagccaaagactgatttttgaaaggaaagttcaggaaacctcccagaatattcatatatataatgtacagtataactgattaatggataatttgggaaattagaaacttgggggttaagatctgtgaagaccaacgtctttctaataggatttccagaggcaggtgatagttaagatagaggggtggaaatagtcaatgaaatgataaaaacattattcacaaagctgaaaaaagccttataattcttcagatagaaagggctcactatgtgttgaatcacatgatttaaaaaagtcaaaaactcaattattcctagtaaaattttagaactccatagaaaatatatatataccaacatattcccctagagggaaaaaataagtgacaaaacatgcaggaactggactaaaatcacatttctcatatgcagcatttaattctagaagatcacggaacagtactttcaaagttctgaaagataaataactttgaataagtgcgatgtggtgctgagaagaatgtatattctgttgatttggggtgcagagttctgtagatgtctattaggtccacttggtgcagagctgagttcaagtcctggatatgtttgttaactttctgtctcattgatctgtctaatgttgacagtggggcgttaatgtctcccattattattgtgtgggagtctaagtctctttgtaggtctctaaggacttactttattaatctgggtgcttctgtattgggtgcatatatatatttaggatagttagctcttcttgttgaactgatccctttaccattatgtaatggccttctttgtctcttttgatctttgttgctttaaagtctgttttatcagagactaggattgcaacccctgctttttttttgttttccatttgcttggtagatcttcctccatatctttattttgagcctatgtatgtctctctgtacatgagataggtctcctaaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcatcgatggtctcagtaaagcactcctcagcaaatataaaagaacataaattataacaaactgtctctcagaccatagtgcaatcaaattagaactcaggattaagaaactcactcaaaaccgctcaactacatggaaactgaacaacctgttcctgaatgactactgggtacataacgaaatgaaggcagaaataaagatgttctttgaaactgatgagaacgaagacacaacatgccagaatctctgggacacatttaaagcagtgtgtagagggaaatttagagcattaagtgcccacaagagaaagcaggaaagatctaaaattgacaccctaacatcacaattaaaagaactagagaagcaagagcaaacacattcaaaagctagcagaaggcaagaaataactaagatcagagaagaactgaaggaaatagagacacaaaaaaaacccttcaaaaatcaatgaatccaggagccggttttttggaaagatcaacaaaattgatagaccgctagcaagactaatgaagaatagagagaagaatcaaatagatgcaataaaaaatgataaagggggtatcaccactgaccccacagaaatgcaaactaccatcagagaatactataaacacctctatgcaaataaactagaaaatctagaaaaaatggataaattcctcgacagatacactctcccaagactaaaccaggaagaagttgaatctctgaatagaccaataacaggctctgaaattgaggcaataattaatagcttaccaaccaaaaaagttcaggaccagatggattcacagctgaattctaccagaggtacaaagaggagctgttaccattccttctgaaactattccaatcaatagaaaaagagggaatcctccctaactcattttatgaggccatcatcatcctgataccaaagcctggcagagacacaacaaaaaaaagataattttagaccaatatccatgatgaatattgatgcagaaatcctcaataaaatactggcaaaccgaatccagcagcacatcaaaaagcttatccactacgatcaagttggcttcatccctgggatgcaaggctggttcaacatacgcaaatcaataaacataatccatcatataaacagaaccaaaggcaaaagccatatgattatctcaatagatgcagaaaaggccttcgacaaaattcatcagcccttcatgctaaaaattctcaataaactaggcattgatgtgacgtatctctaaataataagaactgtttatgacaaacccacagccagtatcatactgaatgggcaaaaactggaagcattccctttgaaaactggcacaagacagggatgccctctctcaccactcctgttcaacatagtgttggaaattctggccagggcaatcaggcaggagaaagaaagaaagggtattcagttaggaaaagaggaagtcaaattgtccctgttagcagatgacatgagtgtatatttagaaaaccccattgtctcagtccaaaatctccttaagctcataagcaacttcagcaaagtctcaggatacaaaatcgatgtgcaaaaatcacaagcattcttatactccaataacagacaaacagagagccaaatcatgagtgatctcccattcaaaattgcttcaaagagaataaaatacctaggaatccaacttacaaggaatgtgaaggacctgttcaaggcgaaccacaaaccactgctcaatgaaataaaagaggacacaaacaagtggaagaacattccatgctcatggataggaagaatcaatatcatgaaaatggccatacagcccaaggtaatttgtagattcaatgctattgccatcaagctaccaatgactttcttcacagaattggaaaaaactactttaaagttcatatggaaccaaaaaagagcccttattgccaagacaatcctaagccaaaagaacaaagctggaggcatcatgctacctgacttcaaactatactacaaggctacagtaaccaaaacagcatggtcctggtaccaaaacagagatatagatcaatggaacagaacagagccctcagaaagaataccacacatctacaaccatctgatctttgacacacctgacaaaaacaagaaatgggggaaagattccctatttaataaatgttgctggcaaaagtgactagccacatgtagaaagctaaaactggatcctttccttacaccttatacaaaaattaattcaagatggattaaagacttaaatgttagacctaaaaccacaaaaaccctagaagaaaacctaggcaataccattcaggacctagggaggggcaaggacttcatgactaaaacagcaaaagcaatggaaacaaaagccaaagtagacaaatgggttcgaattaaactaaagagcttctgcatagcaaaagaacctactatcagagtgaacaggcaacctacagaatgggagaaaatttttacaatctactcatctgacaaagggctgatatccagaaactataaagaacttaaacaaatttacaaaaaaaaatcaaacaacctcatcaaaaagttggcaaaggatatgaacagacgcttctcaaaagaagacatttatgcagccaacagacacataaaaagtgctcatcatcactggccatcagagaaatgcaaatcaaaaccacaatgagataccatctcacaccagttagaatggcgatcattaaaaagtcaggaaacaacaggtgctggagaagatgtggagaaatacgaacacttttacactgttggtgggactgtaaactagttcaaccattgtggaagacagtgtgactattcctcaaggatctagaactagaaatactatttgacccagccatcccattactgggtatatacccaaaggagtataaatcatgctgctataaagacacatgcacacgtatgtttattgcggcagtattcacaatagcaaagacttggaatcaacccaagtgtccatagactggattaagaaaatgtggcacatatacgccatggaatactatgcagccataaaaaatgatgagttcatgtcctttgtagggacatggatgaagctggaaaccatcattcttagcaaactaccgcaaggacagaaaatcaaacaccacatgttctcactcataggtgggaattgaacaatgagaacacttggacacagggtggggaacatcacacaccagggcctgtcatggggtgggggtagaggggagggatagcattaggacatatacctaatgtaaatgatgagttaatgggtgcagcacaccaacatggcacatgtatacatatgtaacaaacctgcacgttgtgcacatgtaccttagaacttaaagtataatttaaaaaatcataactgcttaaaactcactgtagtacacactgtcctgctggaatattgcagctgcctcccgttgctttcgtggtgggctcaagtgtcgtgactatccaccgaaaacgttgtgtgacgctcatcaggcatctctacttgcacagttcgtctctccagtaaattgcactgaagtaaaaagtaatttccctcaaaaaaaaaaaaaaaaaccaaacaaagaaaataactttgaaccaaaaatctcatgtagccaaaactatttgttaagtaagaaggcagtgatagaaagatactcaaatatgcatggatataagctattttttatctaattatctaggcttcttatatgaaataatatatgtaaggagtttctgcaatgaaatggtagaagaatccaagaaagaagataatctgagatgtaagaaagaattgcaggtaaagtaaagaaaagcaaaaaaacgaaaatgaaatctgcttgactcttgggatattttgtttcaaacaggagaagttgaatggcataagattgcatttcctcccctgtggagctgttccacaatacttagttctacagtgagtaatagatatataattataatattgtgaatgctgcctgttgactatctgtctccaaaaatcaactgagaaagcacagaggactgggatctatttatggaatagaatttaatgaattaaaaataatcactgacagtgtaaaataatgctgtaacaaaagtcaagaagtaaatataggaatgcatcgttgaaacctggccaggtgtggtggcacactcctgtaatcacagcactttcggaagctcaggcgggcagattgcttgagctcaggagttcgagtgcagcctgggtaacacaatgatacccatctcaagaacatcaacaaaaaacaactactcaggaggctgaggtgtgaggattgcttgagcccgggaggttgaggctgcagtgagccgagatcgtgccactgcacttcatcctggtcaacagagccagaccttgtcttaaaaaaagagaaagaaaccccagtggtatctatgagaaaaatgaaaaaacagaagatactctttagaaaattttatcacccaagatagagtgtattagggaaaggaaaattttcaatacttaaaaaaatgcatgtattactttcctagttttaagaaaagcttaaacatttaaagggtaatttaatcaatgggggattgttaaattatatttttttctaataatgcagcaggtaaaacaactgcaggagatttctttgtgtactgaaatcaagttttaagtgaatacagtaaactaagtcacagtacgatacggatggcatggtctaattcagtgtaaaatgcttttatgtttgtatatattcatgtggcaaaaagtctagaaggctattctcacttcagctttttaaagttctgtgcatactagaggtttacagggacttttaaaatgtcattcaaaagttacaataataaagatattttgaaaaatgagtttgtttaaagcccagaaacggggagggagtgacttactgagattaaccaggaagctggtggcagaattaggactaaaatccagtctgaagagatgttacaaagccctgggaagttttagctttcccccttgaatttccagcagccctcctaagctacctctagtaataacagtaatagaacaacaaccataagtatgtgttaaatttaatgtgaagtgtgagtaaaaatatctttaggagaaaaaagtctgtgttcctcatatcttggttggaggcgatggtcaggaaaggcttaataaagggaaggtatcagttgagaaaagccttgagcagcaggcatagtttttttgatagactgagatgggaatggagctgcgaccagttatatcggggagtatgagggaacacacacagagaacctgtctgccaaatgaagtcctttctgcgcctactcatgtttctatgacaagaattaattcacatagaattgacaagtggggggatgctattgagttaatgtggtcgtctctttggtttattaagtggtttttcttgatgtattaatggttttcttcatcaagtggtagcagctaaacccaaagtgcagtaaacgccagcacagcccagcaaggtggaggaatggagaaacagtgagcccgagacctcttgtctctcgcttggtttggccatagtattcccagtctttgtgcattttcagaatttagatacctttcttacagccttctttcaagctactttaacctttaaatgtatggttggctgggcatggtggctcacacctgtagtcccagcactttgggaggctgaggtgggtagatcactttagccccagagtttgagacaagcctgggcaacatagggagatgccgcctctgcagaaaaataaaaaaactttgggaggccgaggtgggtggatcacgaggtcaggagatcgagaccatcctggctaacacagtgaaaccctgtctctactaaaaatacaaaaaattaaccaggcgtggtggcaggcctctgtagtcccagctgctcaggaggctgaggcaggagaatggcgtgaacccaggaggcagagcttgcagtgagccgagatcgcaccactgcactccagcctgggcgacagagtgagactccatctcaaaaaataaataaattaattaattaaataaaaaaagttagccaggtgtggtgggatgtgtctataatcccagctactgggaggctgaggcgggaggattgcctgagcccaggaggttgaggctgcagtgagctattattgcgccacggcatgccagcctcggcaacattgtgagaccctgtcattcatttcattcattcatttatccataaataaataattaaatgtatacttatttatcataatatttctttattaagaattaaatgtcttttaaaaatcacgctagttttaaaagttgggattcttactttttagggatttggttataatactgtatagagtttgagtgttctgccttatgagccctcaagttataatattttatataccacatttttcaggaatgtatatatccaattataataagtctttactctgtagagtagtgctttctgtgatgatggaaatgttttatatcttgtttctagtattgtagtcattagccatatgtggctgtttaagttcattaaattaaataaaaaattcagtttctcagttgcactagccatatttcaagtgcccagtagccactcagtggctcatgatttccatattggacagcacagctgtagagagagcttagagcttgtagggtcagtgaaccccttgaaaagaccccaagggctctttccccagccctccccttcctagaggagaggctaggaatttgctctagaagaaaaattcaaatagaggttctagcataatgtggggcatgcggaatgctgcggaggggaaggtctgttttgagttggtactactgtgagtctgatactgcctgtgagctggaggtggctcaccatacatgtctttttgtctgtctacctacctgtctatctagacatcctgcagagcctgactgttgcccagctgagacccacaactgtgtttatttttatagttaggtattcctaaccagattataagtaatttgagagtcgggttgtattttataattctgcattctccacaatgaataacacttttgcaacatattcaggaaggacgtaattatctggctagaagctgatgtgttatttatattccagtagaaattgagactaattcttcaattttggggcactggaatgactaaatatagggaggttaggtgagaaactaatgtaggatttatgacactttccagttacagtggggaaagcggtattaactcctgtcttttcttctatgattgtatatcttctgcctcaaccttatacttagaggcaggtctattagtgaaatgtttgacttttagtttttactaagttagtagctcaaaggacctcctagttttgatactaggagcataggaacctaatgcaaagtaaaacgtgattccatgttgtaagatttgatttaacgccacattccacttttcagtaatctgtgcattttcacacctactcctgctttctctttttgaactgaagcaatctcatgggtaatgacctgattttccttcttcagtacaggttttagtctctctatgttgcttttgaattggtttaaagagatacatttaaatataatatataattctagttccaaattgtgtagtcaaagaggtttcttgtctaagctgtaactgatttgtatatattatttttaaattaacatttacagtgcaccatggtttgttatgctaggtgtttagcctttcttgcaagttaaatgcaatattctattatatgaaatattttaagatactaaaatgtaaactacatagtggcatggataggccaatagccatcacagtgtgaattgaaggagtgcttctcccctatacggtatatattcatcacagtgtgaattgaaggagtgcttctcctctatacggtgtatattcatcacagtgtgaactgaaggagtgcttctctgtacagtatatagtcatcatggtgttaacggaaggagtacttctctgcatggtatatgttcatcacagtgtgaatggaagaagtgcttctcctctgtgtggtatatgttcatcacagtatgaactgaaggagtgcttctcctccatgtggtacatgttcatcacagtgtgagtggaaggagcacttctcctctggtgtatgttcatcacagtgtgaattgaggagtgcttctcctctgtgtggtatatgttcatcacagtgtgaattgaaggagcgcttctcctctgtgtggtatatgttcatcacagtgtgaattgaggagtgcttctcctctgtgtggtatatattcatcacagtgtggattgaaggagtgcttctcctctgtgtggtatatgttcatcacagtgtgaattgaaggagtgcttctcctctgtgtggtatatgttcatcacagtgtggattgaaggagtgcttctcctctgtgtggtatatgttcatcacagtgtgaattgaaggagtgcttctcctctgtgtggtatatgttcatcacagtgtgaattgaaggagcgtttctcctctgcgtggtatatgttcatcacagtgtgaattgaggagtgcttctcctctgtgtggtatatgttcatcactgtgtggattgaaggagtgcttctcctctgtgtggtatatgttcatcacagtgtgaattgaaggagcgtttctcctctgcgtggtatatgttcatcacagtgtgaattgaggagtgcttctcctctgtgtggtatatgttcatcacagtgtgaattgaaggagtgcttctcctctgtgtggtatatgttcatcacagtgtgaattgaggagtgcttctcctctgtgtggtatatgttcatcacagtgtgaattgaggagtgcttctcctctgtgtggtatatgttcatcactgtgtggattgaaggagtgcttctcctctgtgtggtatatgttcatcacagtgtgaattgaggagtgcttctcctctgtgtggtatatgttcatcacagtgtggattgaaggagtgcttctcctctgtgtggtatatgttcatcacagtgtgaattggggagtgcttctcctctgtgtggtatatgttcatcacagtgtgaattggggagcgcttctcctctgtgtggtatatgttcatcacagtgtgaattgaggagcgcttctcctctgtgtggtatatattcatcacagtgtggattgaaggagtgcttctcctctgtgtggtatatgttcatcacagtgtgaattgaaggagtgcttctcctctgtgtggtatatgttcatcacagtgtgaattgaaggagcgtttctcctctgtgtggaatatgttcatcacagtgtggattgaaggagtgcttctcctctgtgtggtatatgttcatcacagtgtgaattgaaggagtgcttctcccctgtgtggtatatgttcatcacagtgtgaattgaaggagcgcttctcctctgcgtggtatatgttcatcacagtgtgaattgaggagtgcttctcctctgtgtggtatatgttcatcacagtgtgaattgaggagtgcttctcctctgtgtggtatatgttcatcacagtgtgaattgaggagcgcttctcccctgtgtggtatatgttcatcacagtgtgaattgaaggagcgcttcttctctgtgtggtatatattcatcacagtgtggattgaaggagtgcttctcctctgtgtggaatatgttcatcactgtgtgaattgaaggagtgcttctcctctgtgtggtatatgttcatcacagtgtggattgaaggagtgcttctcctctgtgtggaatatgttcatcactgtgtgaattgaaggagtgcttctcctctgtgtggtatatgttcatcacagtgtgaattgaggagcgcttctcctctgtgtggtatatgttcatcacagtgtggattgaaggagtgcttctcctctctgtggaatatgttcatcactgtgtgaattgaaggagtgcttctcctctctgtggtatatggtatatgttctttcctctgtgtggtatatgttctttaaagggagcagccactgtttcccacctcattgaaattcacactgcatccagcactactggaaaagtaatgaaaatgctgggactacagggctttattttactgttgagaattctccgtggttacagtattatgtagtgcctaattctcctggtgtcgccttcgttttaaatagtgatttttattttcagtccagtgatccatttcattcattaaccccctaaccactgagtaagcttcatgtcacaaaagagcttccattggatttattacaaatataaatattctaattattcccgaatctcaatgtatgtattctcatttgcattaaaaactatggcttttaagttagactcggaaaggatcaaagtgctgcaataagagaataaatgctgcgcttctcctggactgtggtctcaagtgttataactgttgccatagcaaaattaggctaaatttcctaaaatctgttcagtgctcccaaggaaaaactcaactggagcataagaattttcatctcactttttccccttttgtttgatttcctctccttaacataaaataaacattggttgtacccttccttttgaaaaattgattgctgtgagaagttgacttatattggatcttgcatgtaatgtgtgcagatttgtacccaaagcagtaattatcattcatgccatgcctttttgtatcaagtcctgtttctgatgaactggagccccatatgagttaaagcagttttgaaatgtaagagatactatctctaggatattatgaaatgtttcgtgatgttattttgatatttcccttgcagtttaaagaaagtaacttcttttttctgtgtgtcaattggaatgtgtgtgtacattatagcaatgaccagaaaacaatttttaatatgtagtttatagttactatgtagaaacttttctgaatactgtaaaaaattattggtgcataaaatttgttatattacatgcttttatgtattatactcttccatatagtggggatatatatttacttattttattaaatagatctattgctgatgctgatatctactgcccagtgactacagaagctcctttctggacaacccgtttattacactctccatgtatccacagctatatcagaaaagcaggaaaccagagaaaatatacctatttgaaagtggcatgtcagctgggatgagagagaagagtaagaatgatggatagttttagagaataagactgctttcaggaatgaatgaagacaagcatccgagcacgtccaatgccatgcttagcaataacccacacaactcactggccaaaagtacactaagtctgtaatcggaaaaattctctggaataaaatagagactcatatggaagtattcaggtgaaaatatacatcatatgataaatagttctgtcaaagttaggaaactgagtaactgagagagatactactgtgagagaaattgatttgctgtgatttgctgtacatatgtatcagaactgcactatgaaatatggtaaccagtagccacatttgactacttaagtaattaaaatcaaattaaaaattaagtctttctcttgcactaaacacatttcaactgctcaacagccacgtgtggccagtggctaccatattaaatggtgctgatagaaaagattgtatcattgcagaaagttctataggacagttctgctctgggagaatttcttctcaatcaagagaggcacaaagattatgatactattctttgacaaaaataagtccaacaagctagttctgactgtgtgcgactgtagtcctagttacttggaggcttaggcaggaggatagcttgagcccaggagttcaggtctagcctgtgtggtaccttggactgattattggatctctccagagttggcaatgcacaagataggacagcattctagcctaactcctggttctctcttccctttcccattttccttacgttgtcatttcctatgtacttcttttaaaatttattttcgcttattttcttgaatgtgtttatgcaaactaaatctttctggtgagcgattgcagattaaagggaaatggcctattctttctctttctgcctttgtttctttacatgtgaaaaaaagattgatgtcatttgtttgagaattaatgaattgatcacttggagcaattgtaaacatgtggagcattatatacagaatagcatgtagttcagaagaaaaccaggtcatggctttaggaaaagtcatggttcctaaaagttcggtgaattaccagattagaaaatcttcacacattcattagagtagcatttaaatactgtgatattaaacgttgtcatgtgtttggataatgtgaagtttgtgcctcacttttggggtccacctgcttaacacttggaaaaatcttgaaggcccagatttttagagctgaaggtagatataagtctgttttaggtttaatgttttaggaacacattaaaatacttctagtatcttgccattttctgaatacctcaaaacgcttgaaaggcacgtgctatgatttgaatgtttgtccctccaaaatgcgtgttgaaatttaattgccactatatcagtattaacaggtggaaactttaagaagtgatgaggctatgagagttccaccctcatgggtgggattggtgtcaatataaaaggtgaattcggccccctcttgctgtatctcgccccttgccttctgtcacgagatgacgcagtcagaggtcctttgctggatattagcaccttcccagcctccagaactgtgaactgtttatcctaaattacccagtctgaggtatttcattataactgcgaaaacagactatggtagtgcataatttaactttgcatcatctctataagatggataaagggcaattgtaaactttatccttctataaagagagttgcaaaatttaaatttcaataggattaagtaaattattggcattattttgttcaatggcaggtagactgaaacaatgtaacaccttctatcacaaacttattcaataggttattactaattatttgatttaaatagacactaatcccttttttttaaaattagtaagataaatggatttcaaagaattattgcaggatgataagatgaggaacaaaaaccaaatgtagaatttctcaagagaacggtaatgtagaatttttgaaggtgagcaaagaaaatttattggataatattctaacattatttttataatgaatttaattttaaaataaatgaagaactaattgaacatttagagtaatagtcatccttagtgaatgtgaaacaaatagtgtagctttatttgtggaaattgttacagccccattaggttgctattcatggtctaaatgaagttaattgtagcttcgaaatttgtatgaaaatgtaaaaaaagttggctcaaaaattccactttatctatttattcatttttagttttgtcatcccaaagatgttttgatttttgtctcaaagatcatgggaacttcttaaagcaatggaagtatctaaaaataatatacatactaaaaaaaagaaggcttcttttagaaaaaacattatatttagatgatggaggtttaatttttttcataaagtgatggtgctgctggaaacaccttgttttctctgagaaacttatacagaaaggaatagcagtagaataaagattttgaacttcttaaccaaaggaacctagattgtcacttcagccaccataaaatgtatctattaatagatactaaaaagttatggctgtttagggttttatgctgctgtcagcttgacctataggcaatggaccaggaaagagatcaggtcaagtgccatcaactgttgctaaaaatggcaacaaagtagagtggaaatcagaaccagatacttgattttcttatgcctcaaaatgttggagcctcgggtaggagtaccacacagtccattactctatgaactttgtgttgtcttaaaaaggacacaatcccaagagtcctgtaagataacttttaatgataagtaaacatggaagccagttgaattgccctgctttagggccttctgaagtaaacattgaaataaggaaatgtgaggccgggcgcagtggctcacgtctgcaatcccagtactttgggaggctgaggcaggtggatcactcaaggtcaggagtttcagaccagcctggccaacatggtgaaaacccatctctactaaaaatacaaaaattagccggtcatggtagcatgcgcctgtaatcccaactactcgggagactgaggcaggagaattgcctgaacccgggaggcggaggttgcagtcagtggagatctgccactgcactctgtagtttggagtttgggtgatggagtgagactttgtctccaaaaaaaaaaaaaaaaaaaaaaggaataaaaataaggaaatgtggtgttaggtaaatataaataacatagcatatgatgccaaatctattttatgaaaatatttatcacagatttttagagatcggtgagaccttaggaaattatttgaatacttatgtgtaaactaatattattttcattttatgcataaaggtagagtggctggagaggttaagtgatctcttcaagttcaaactgttaataagatggctaaaaggacccagttctccagcctggaatctttaggacggagtttcatccaccactcaaagttgtcttcttcttccttcttccttcttcttctttcttctcttctttttttttgagatggagtctcactctgtcacccaggctggagtgcagttgtgcaatctcagctcactgcaacctccgcctcccacgttcaagtgattctcctgcctcagcctcctgagtagttgggacttcaggcgcccgccaccacacccggttaattttttgtatttttaatagagacagggtttcaccatgttagccaggatggtctcgatctcttgacctcttgattcacctgccttggcctcccaaagtgctgggattacaggcgtgagccgccgcacccggccaaagttgtcttctttaatcctcctgagggcgccccagtgcatgagctgaaattaaagcataaacgggcagaacacaaagccagcacttcccaaaacagaaacttagttttctagtagaagaaaaagtggaaagtacatctaaccatgtactgtgatgtgttctcatgaaattattgccccacttcacctcagggtctaccattttactacaaagtatatgggacgttggacttggttaatattcttcatgatctaagactgtttgaaatgttgaggtttagaatttaatatgtcaaaaatcacaagcatttattaaagattaattatcaatattaaaattagggagaataaataacctcatctaataatctcataatgctaaataaattcaagagtagattttgaaaccaaggaagatgaactagatgatttataaggtcttcttgagctttaaagttcattaatgaagattattaaacacttttggttttaatatctttcatagaaaatatatttaattctgttgccttcttggagtacttgcatatctccactttattcagaggttagtatgagattcttatagcagagtttctctttattccaaatgtaaatttaaaaatcaaaataacaaagctgtaaaaagactagaaatggttctgtttcccagttccactctaacccatatttgaaggaaagtggacgcatcaaatgtgtgtgatctttatgtgtaaacactaacacaaatggtggcagacgctgcagtgactcgagtgaagaagttttagtcagttaatgggttatataatcagcatcaaaaaatcaattctaggcaaactataccactaactgaatgttttattttctgtaatttataattattctagcacagccattgatgaaaatatatcttaggtctcatgtagattaaataaatctgtagtacatggcctcatctttaacttgtctttatgtaaatttaaaagaatgatatttaactcatgcaaagtgtgcttagtggaaaagaaagtcctctgacatgttaatggaatgctgtgaaatgcatttataatacatttagaaattcggtatcagtatgaagcaactaacaggggctttcacaggtcatttagttcctcttcttcttctgtcagcatagtgtccaaaacatttatggaggtaaaaatgctacactttgagttcgggtttatagagcaggtgtgtggaagtttattttaggcaagaagaaacttcaaagaacagattgggagacagtgtgaaaaaaagcaagtaaacatattatggaaaccgatcttgtcaaaggtgactagatcatacattggccttcattattggaaataatttggaaattggattcataatgaagtttccaccatttccagttagaagagcatcttacatcttttgtattgtgttctttgagatacatctagccttgcaatcttgtaatatttaccgaatgctactattttgcacacatttttaaaaatgaagaatatagttgttacgaatccctccgcaaaacctctgattagatttggcagaaaaatatggagagattgaacaaaagagatactaggtctgagatgtatgtatgttgtagatccgtatggtttattcaggaacttcagcagaatgactcgaagaggaaaacaaagaaggagatgattacagatgctccagagacactgtctttccgtaacttctgttgtcacctgtgttaagtgtgtgctggtgcgggctcgctctcctgtgctctagctctctcacacacttgtgcacaacttctgaaaagactgctatgtagttattgtctcttccttctcccctgttcctcaccttccattctcttttcagcccattctaatgggactttcttttctgacacttcattacagttgttctaataaggttaccaaagacctttagtcttgccaaatctggtgtcttttctgttttttttttttttttttttttttttttttttttttgacttttcagcagtcttccacataactgacccctatcttggctcctagtactcaacactcttcttgtttttccctctgtttagccatttcttttcaacatcttttgacggctgttgatgctctgtttaacctttaaatactggaattatgaaaggctgagtcctgagctttcttctcctttctttctcgttaaataaaccctctccttaaaggattctaatttatttctatgactttaaataccctctttgatgccaatatactaaaaaaaaaattgtatctccagccttgattgctatactgagctcccgttcgtatgtccagccatctactggtttcatcctcacttggatatttgaaaagcatctcaaactcaacatagccagagcagaactcttgattcctcggctccctctgccaccttcctttttctgcttctgtttttcccacctcaataattacccccagtcaagtgctcagtacaaaaatctagtcattactcttaattttttttctgtcacttacccccatcaccactgaattcattagcaagtcctattaacattttctttaaaatatgtctaaagtctgtttcccctgctttctttgccaccagtatagtctaacgtaacatcatatcttgcctgagcaatcatagtagtcttccttctgtccttcctcctcctccttcctttcctgctcctctatattctttctcagtggcgcccacaatgaccttttaaaatatgaattaggtaatccctgcaccttcccttaaaaccttccatcgacttccattacacctagaatacagtgtgaatcccttatgctatttcagtactaatatatctgcccctgggtttcctctctgatgtattgctatactttggatacatccccttgaccacacctcagccacactggctttctttctgtccctttaacctaccaagttcattatcaaacagagcccttgcagttgctaattcctgtgcttgtactgcttcggtcttcagggcacagttcaaatgccacaccccaccccagaaaggtcctctctgaccactcagtctaaaggagcttcccattacatctactgtatcatattctccttggaggatttagcattatctgaagtatttttgttcacttacttgtttatctgttcatcgtctctgagctttatgaggacagagtccttttgccagtcttgttctctctggtaggcagtgtatgaaaaaagataaaacagaacccccaaagaaacctgtgtgtagaatgaaagattctcagaagaatgcttgtaaatagaagaatctaaatcctcttacagatgagaagtcttgaaaatgaaaagaatccttcagttctttttagtttataaacgaagctgattttgaaaataagccaaattgaatgctatgatgtgattaagttcatccaaatgaaattatagaatttagcaattccagcatattgtaattactgaagtattccgtattgtaaaggaccatttagtgtacacaattccagtcagctgtgcttgtcaggtaagggaagagttaatgaagaaggaggaaaacagagaaggggtagtagtcctacaaagtgactctaaggttaggtcaaatctttgtgtcccttcaataccaatagtataggtataggtaccttcagcacctatagtatagtcgtaggtccataagaaaagcaaggagtattaggtgtcctttctggtgacactgactccattttcagtatatacataagatgacaaaatgagcaaatactttgtaaagtgctatatgcctccctaaagcaagaggtccaggaacaagaaactagaattatggagattggaaggtgtctgaattttacaggagactcaggctgcctctatcttttccagttcagtagttactcccagtcaggtgctcaggaccaaaatcaaggcatcgctcttgattaattctttctgtcatcccctaccaccatccccttcatcagcaagtcctgttagcattctgagaacaccttccatctctggcaacactgctgtcttcttggctcactgaatcagttgtgagtggtcatacatctgtggccccacggcttccttatgaccacttttctcctcaccctgggtacaggagactctctttcctgaggagacctctgttcccctccctgtcttgaatcaaaggagttgggcagatgggtaaaagctctttgctggaaccttcaggaaggaatctacaaattactgatctcagaaacaggaaatgtgtgacaatgaatgtcaagggctatctttatgctataggaaataaactatttaacttcatctatcttcatgctatagggaataaactaacttcattggaaagattttcatgtattagatgtgaaattacaatattagagcacatacgatttagcatcaaatgtaccgtgattattactgtaggacaactctgccccttctaaaccgcatggtgacccactcattatattctgtatatttcttcaggagacaatgagaggccactgaagtatgattgtagaacattgagttctttgcatccttcagtttatattaatgttttaggtctaaacttttctttttccctaaattgaaatcacctttgactcctttgtgaaaagagtaatgataaaagttttgacttcttcttatcaaggaggatttcataaattaaggaaggatatattcatgaagaatctactctatgacaggagctcttgctgataacttttatatattttatataattctcaggaggaccttgtgagttaggtctcactgtgcttgcgtgttcaaatgaggcaatggaggctgtgagaaattaagttacttgtttaagtttacacagctaatgaggcacagatcggctcaaatcctgttcttatttctgagttcagtccattttctgtaatatggatctctctgtgctttgttccttgtcgataataaagtccgtaataatacctgtaatatctatttcttagagctatgataatcagatgaatgtgaacacaatacctatacaaatttccagttctattatgattattagtagcattcatttaaccacattaccaaagtgttcttttaattcactggcactttatacaggatttctgaatacaacagtggatattttatctgttagactccttgtagttatgtttgggttgctctgagaatgagttttacacccttccaattgttggcaaatagtcatactgaagaaaaactgcccatctgttcagatgctagccaaaacatcacaaacagtcaaaatagcagattcaaccctatgtgaattgtgatgagacaatataacaggatataagtcatactgtcatggggtctttggggtgtcacttttctggccggaaacatgtgactggtggtgcccttgcctgagttttgcttggacctgctgggcttgttccacccactcgccctggcaggctgcgctcagctcatgctaccagcctggatcccgtgcttcaaagggagtctggagtcaggcatggagtggtgaggggtgtgtgtcagcaaacgtggggtccgcccactgtgcggtcagacacaccagctgctgctatggtgtgggcagctccaggtgctggcgtgagcaccagctctctgtgaggctgtggctggaccgggttcactgcaagcggctttcccgtctggcaccggggaatgtggtgacatcccggaaacttggagatgccaggaaccacagggccccaaagaagggctcacagccctggctcagggagctcccaggtctgggctacccgaagggttgcagctcctttctccttctctttgcccacaacgtggcgagcaaggggcatgttttagccctgtttgtgttacagtagctcttttagcctcaccattcggtgggtcctgagttcttgtcctgtgaccaggaagaatgaggtatgcaatgtggagggtgagcaggatgaagaggagctttactgagcaatagaacaactcagagaaaacccacagtgggcaggtcctctccgtagccaggatgtcccaatgagcgttcagctccttagcagagagacttgctcccctctgctggtaggtcatcccaacgagtgttcagttctcagcagagagggtagcttctctgtttggctagttgttccgttgtctccagctcttggcagagaggaggccctagagtaagagactgttctctgcaggcaggtcgtcccatcatctgcagctctaggcagagagggtagctcctctctgcagctggtcgtcccatcatctgtctgttctctcagcagagaggaggccccagagtgggttgctcccctctgcagctggtagtaccatctctgcagctctcagtctagagaggagaccctggagtgggtagctcctctctgcagctggttgtcccagtctgctcagctctgactgagcctggggcatttacaggcctcagaggggaggaagtttgcactgattggtccataggtggccatgggtgggccggaaaaggcaccacaagtttccactccatgccccggaactggcagcccagcccccagccttcaggcccttcctggcttgacaatggggcctcactggtgaccaggccccatccgcccaggaacctgcctgcctcctgctgctgttcatggtgcccggactcagccctgactttgctcccaggtcggagtgggcatcgatagcagagagaagccaggcagctgaagcaggcatttctgagactgtgagtgcagtcaggggccttcctgggccccccaaagtgcagggatgtctggatccacagctgtggtttggtcagctgcagctgtgcccaggcaggtggggctcccacctgcttcgtggagcaggagtcccaggtctgcagccatggtttgggaggctgcaggtgcctgggtctgcagctgcatggtgggttggggagagcatggcgggtggggcgggtggggtcttctccctgctctgtggagtgtgcaggcccggccattcctcctcactgcagctggtgtgatggtagcagtgggtcgtctggaatggccactaccatcaatatcctagtcaacagatgtggaaggaggtagtgtccatttgggacaatttaagattttcatcatctaaatttaaggctgggcttagaggaacgtaaatgccaaaaaattgcgtttagatatcattatatttgaaatcaaatgaacagcaataatgaagcagtatatttccctgacaccctcgtgggacttgcaacaggggtgttctgtttactcacctgcagctctcagctcctcacaggagggagtgcatgagtcaacaaggtgggaggtggagtacatggtcgctggagtcagccagccactacggcaccagcagtgaaccccactcagtcggatctgctgcgttccacccctcatgaaaggaggcatgcaggtgtgtgagtgcaggagcctgggtgagtgttttttggttgctggcaggagccaactctgtgcttgcctgcagctgcatctgggggctgggagtgcctgtgaccacgaaagccccagagggagtgttacagtgaccttttagctctgctctctgcagacggcttatgcgttaacagctcaatgggccctctgccttttcgcatgaggcagctgccttctgctaacgagggcaaagggtcagtgtgacaacctttttgtcttcacactcatggctccagaatcttgtctggcatctgggagaaatgaagtcacacgaatgaattgaaggatgataaatgcagggagttttattgccaatggaagtggctctcagtggcaaggtgagctgaaaaggggatggggcaggaaggtaatcttcctgtgaaatgcggtcatctctggccagattcttctccagagttaccccgtcaggctgtccctctgaagtcaagctgcttctctccgacatccagctgcagtctttgatgtccagctgcttctcttctctctgctggctggatctggggtttttataggcacagggtggggtgggatagggccacaggtggttttggaaaaggcagcattcaagcagggaaacagggatgtaagttctactttgggccatggtttgaggcttgaaggtggggttttgttggggaccaccattttctgcctagaatttctctgccccctgtccctatcaatagttggaggggaaaatcaggagttttagttaaattaagcccaacctatataaaagagaggcttgacaactcccaggcatacagataaagctattggtgctctgtgaaatggagatctacatccctggaaaggggacagaattgacaacgttggtcatttccttaccacagtatcctgtattttccagaagcatgtgattgtcttgctatgatattcctgaatgttactggtttcctctttttctaaagcatgtttgttgtgtgcagaactagtatagcttcaggcttttggctaagatacccgtgagtattattgcttttttgttttgttaaataatttttattgaacacacacaaaataccttaaatataaggtacaaataacagtaaacaaacaacttgcatagcagtcagccagtcttaagaaatacagtgttgccactacttttttttttttttgagacggagtctcgctctgtcacccaggctggagtgcagtggcgccatctcggtttactgcaagctccgtctcctgggttcaggccattctcctgcctcagcctccagagtagctgggactacagccgcccgccaccccctggctaattttttgtatttttagtagagacggggtttcaccgtgttagccaggatggtctcgatctcctgacctcgtgatccgcctgcctcggcctcccaaagtgctgggattacaggcgtgagccaccgcgcccggcctgttgccactacttttaaagctgcacaactgcttctctctcttatctccctctccaccccacgaaataatcactatcttgaatcttatgttcctttcactggctttttttttaacaggttttcttgtatgtattgaaatcagttttttatgtgttataatttggtatgtttttaactttactcatgtcagagtgtacgtattcttgtctactttctttttttgacctagtattctgagatttattcgtgatggtcatgtaactgcaactcattcagttttatcgctgtattgttttctatgaatgtaccatagtttatttattttctgtttttaactgttacacatatcattgccatgaacattcatgtatttatcttccattgaacatgtacaggagtttttcttggatatataacttgtaatggaattgttgggccatgagtatgcttattgcaacttcactagataatgtcaaattgtttctgaaagttgacttcattcgtactgaaccatcttcaccagcatttgacattgtgggatttaaaaactgttgccaatttttacattagcactttaattacaattatatttatcatttctagatggtattttttttcctagctagacattaaaaaattttctttatccttcctcatattttcaatctcttattcctttaaacatcttaaacatatttactttaaattctgataataccaaattagaaactctttgtgagttgattcagcaatataatacttctgctgagtcttgttcactgatctttgtttctttgttttctttgtgagaatttttagtttatttatattttgagacagggtcttggtctattacccaggctggagtgcagttgtacaatctcggctcagtgcaacctctgcctcccgggctcgagcgatcctcccatcccagccttccaagtagctgggaccataggcacacatcaccacgcccagttaatttttcgtagagacagggtctccctacgttaccctggcttgtgattttgttttttaagctgtaagttcacactctttagaaattctttgaggcctggattgaaggtgtattcaccctgagtgaatttgccttttgttttgatggataactaaggcattaacaaccttggatcctgctcaggttaatttctgggcttgaggtttcttctcccacaaagataatataaatttaggctacaagcttggttagatgccaacttctgcttatgagtctagaaaaaaattatccccctctgtccagtatttagggtctagattgagaacttctttgctctcccttgtgtggaatagattttttgtaatttacagtgattctaactcacagcatatagtccttggaaaatcctaggtctgttcaggagtttggttttagactttccagtctggatgaggcccacacacagcctccagtgctttgtgcccacgtctccgtcaaggggaaagttcaggatcctcaggttagctaaatgtttctagtgagaaagctagcttcagagtttacttactggcctggtatctttacttgactgtaatactctaaggatatttctttcttatcacttaaatcatgaattttattttaatgttctctttttaaatacaacttcttttatgcctttatttttcttcattttttattatattttcaataatgcagaaaaggtgaaggaatacaaccagaaatttagcacctagattcatcaattgttagcattctaaaaacaaagacgttctcttttataacaatgccatagcacgtcttagacaattagtaacaattctctaatattttctgtaatacctaatccatatcagattttcccacttgttcctaggtatcttttttgcatatttttccccaaatgagggtacaaacaatgtactgatgcatttagaagatatttgtcagtgcgtctatctgggttgttggggtcaccatattgtccaatatggagatgtattttattgtttggcattttcctgaagtctgcttatgagtttttttttttttttgaaatggagtcttactctactgcccaggcaggagtgccatggcgctatctcggctcactgcaacctctgcctcccgggttcaagcgattctcctgcctcagcctcctgagtagctgggattgcaggtgtgcaccatcacgcttggctaattttgtatttttagtagagacggggtttcaccatgttggccaggctggtcttgaactgctgacctcatgacctgcccctgttggcctcccaaagtgctgggattacaagtgtgagccaccgtgcccggccttgagtttgtttttcacattagtccagagtgctccatctttcgctctctattcggtttccttgtgagttattgactgttagagtatacaatagaaaaaatatttttatgtcccttttaaggaattatacctttcaagtggaagatacacactgactttcctccaaatagttacacattttagatttttgtcgtgtcagtggactcatctcaggcaggattacaccccagggcttcctttaaaaaaggaaagtgacattggctttacgtaacagaagcagtttggacatttctttggacagttgagttccgctggcccctttctgtggcatgctgctgctcagcccagctgcatgaagacaggacagagaacgatggccactgagagtgatccaaagtactctgtgggagaaggcagatggataaatattttttcttaaatgcaaagctaacttaatgttactgcccattactggtaactttctttagggcttaagacttgaagaatttaatgttgcctgacaaagttttaagatggctcagcattaaaaaaaaatggtgtctttgaacagtaatgagcgccaagtaagaaatatgggtgtgctgactctttttgatgatctcaaagttatttatttaactacatgcatgaagccccagcgtgtgtgtgtttttctttgtcactgacttcacagcagctcagtaggattttaaatatgtatattttatattttcctgcacctgccccatgacaatatacatagaccatgcaaacaaagatgtatttagtgaagagattgcgaaactgttttattactgtccggatctccattggaagtgaagctgctgtttcacatcctctttaggcatatctagccgccagcaactgtgcagattagaatcatgagcttctcttccacatgcgtgtggccattgtggtgatgaccgatgaatcatcgcatttcaactggaatgaacaaaaatagaaagctcagcagcagcattttttagagaggtaaaaatctgcataaataaagaaaattaagtgtttccatgaattttacctactagaaagtggaaaaatgtatttgataatagagcatatatataagttttatagtactgctaacataaacatgagtggataattttggggctcagcaagtttagctgcaaaatggctttgctattctccattcctctttgttttaatgatcattcctccatattcagaagattctgtttcttgatttttaggactgttcctaaatattccggtagctgtctttggaagactgaaaaaatattttctcttgtccttatagaaaatgctggatagggcagaaccttctctcttcctgaaagaggccactgatctaaattggtttctctcttagccttacttcttggaggcatacttattatgtatttacttactttggcatgctattttaaaaattccttggtttttattttaaacaattccttcatatatttcacttaaataaatgagctgatactatgagcttcaacatattggtttcaaaactcatctctttgtcttttttcctttgttttacctcatatacagttaattgacagttctgttcatttttcctttgagatatcttgccatgcttggtttaccattccagcacagagtacacaactcatagctggattgctatgacatttgtctcctctttggttatcttgcattcttttaccaaataaagctttcacaaatgtattatctccctaccattttgtgacctgggatgtgaaatctaatctctgactggatttctagactcctctcttgtctttttcaaccttatcatccacaacttgccattgtaaagaccaagttccagtgttccattagatcaataccaccatttctgtaaacaaacagatgcaaacattaagaaccacagtctggctaattctggaacagtacctaaaatattaaaccatgaccatcttttgcctgttggtgttagaagggagcttttggtgttacgagagagtcaccaaagaggacaggttatggaagctagctctgcagagctcttgatagcaggagttcacagagattataaactaggaaattcaaggtgcttcagaaaggttcttcttgaaggaagagaaagaactgtgttcaatgagagaaagcagcagaaaagcacactaagttcgttctttataggcaagtttaaaactgggatttactcaatggccgatggccattacagatgctaagatattctcagggaccatgagaagatcatcatgctgaagtgagaatggagccagggaggggagcatcagagtgggactggttttgacctttgaacagggccactgtcctggcgtggaagtgcagtagacagggcaggttgggtgaacaaaccaggtagctgagtgttcccctgcccttgttctagcaaacttgggtgtgcagggcctgagaatgttctgttgacttctgctgctctgttttgctcatgttattcctttgcaatgggtgcctttctcctatccattttctcaaagatcatatgtgctataatggtggaaacacggacttaggagataacctgactcaaaactcactggagttttgtcttcttgcggatgagctggaccctagccaatgtacttcaccattccaaatcttcagtttcctcctttgataatgcaggtattaacatacatgctgctgtgtaagcattggaaagtctggcccttggtgtttgggtttagaaaagtgcttttgtcagcatccatagtcacaggtaactgacaaaaagagcatgtgatatcctgtgtatctgtgtcgacatcatatgagattgaggaaggttgaaagaatactaatttcccttgacagaattcttttaattttattcatttctctgcatccttcactctttagtttatctgatggtagagggttagcagttgtagacagtgtcatcacctgccctggatgatactagagctccttttgtagacagactatatattctgacaccagagaaatgctgtacctgaaggccccatatcttctggaaggacactgaagggagagcaagttactgaaatccatttctcataacccaagaacgtcctgtctacatttgtatgccttgtgcttggtacatatttgttgtttagattaacttaaattttatgctttcattacagctattctctgtggaaaatattaaccaaatttattagatctttatggaaatgaaaaactgctggtctaaaaatgcttgggaaacttaagagtactatcattcaacttggcagtacttgataccagtgagggttgaagttctaagttgaaataaaacagatcggttaataggaagtcaaatgagactgatagattttatttgttgggacatttttcggtgaccaaatatgcagtagacagtcaatacaaaaaacctagaaacgcatagaaaaaataaagagaggaaaataaaaatcaccaaaaatcattagcattttcatttgttccactattttatctatgcatttatgtattggctgcttttatgtttttcctgttaacattataggaattatttcctttcataaaatattcttgaataccctaatggtactcatttatcatataattattaccattatgcatttaatcattcttctaatattgaacattttagtatttattattttaaatgtagcagaaataaatatcttttgttggcatctttatttccttgaaataattgactagatatacaattactgtgtcagcattttaaatttgcatatttaaaagttttgttgcatattgctaactatctttgaaaaagttgatttagtttaccagccctgtgtcttttctggcacatgatgcatttttatgtcgctacatccttaccagtattgagtgttttaaaaaaataaaagcttttgattccgatttactcattttgtctgttgtagatataatccaccttaagtggaatatttgttgttactaaatacttgagtgattatctgaggtaatatgtattcttctgtatttatttatgtgactttttttttttttaccacaatcttgtacagggattacattttactcatctttatgctacccatagaatttttacacagtagatattcaataaacatgaaaaataaatatcacacaatatccaccttgttggattccaccacttactaacatatctgcacgtatatacttcaagcaagtatcaagtttctttattggaagatgtcatgtaaagttcccaagtctcatttttggttttatatgaagaatctattcattggtaggacatattgataaaaattactacctcttcccccttttatttgtctccctcttgtgtactttctctgcctttttcctaaggtaaatattggtattgtctatatgctttcatcacaggtacaattaatttagtagaaacattgcccatctgaaagaattatatattgtggtatcagtggagagatgtttatttttttttaacattttgttgttattggttaataagaacatgaccaagacaagagctttaacagagatgtgagatgtgtattcaaccagtctctgaaaatcatttgctttttgtgttttatggcagtaccttgtggatctgcatttagaatgataattcatgctaacgactttcatatcccatgaggtagcagaaatcaatgctaaaatggcagaatgaaacggtatagcaaataaagtcaatgagctgtcaaagaatttttcttcatcaaacaaatcccaaagcactggtgttatactgaccttccctcactcctctttcctggattcttagaccaatttggttcatgatttttttttcctataatagaaaaattaacaaacatgtttggtcagtgaaacagaaggtatttgaaaatgataccttggagcagtgtctcaatcttcaggaaaatggtgaagaggaaatacagcattgattgctgttgctaagcaacggctttcacagcagacgcgcctgggacagtggtggtgtctgccagcacaccatgcggggccgaaagcagtgcagcactcatgtttctgcgaaatcagaattgaagccctgcatttcctccttcctctcgactttctctgatcaatacctgagaagttaagatcgtacggtcaaatatatagactgtgagaaatttggagcaccttggggatttttggagagctgcgaatggatttgtagagccaattctgttttttttgtttttgtttttttttttttagtttcgcccttgttgcccaggctggagtgcagtggcacaatgtcggctcactgcaacctccgcttcccgggttcaagtgattctcctgcctcagcctcctgagtagctgagattacaggtgcccgcaaccacgcccagctaatttttgcatttttagtagagacggggtttcgccatgttggtgaggctggtcttgaactcctgacctcaggtgaaccacccacctcggcctcccaaagtgctgtagagccaattctaaaggaatcagaattcctattttatatcagaagtactgttagttttctccttcatgcatttatccatccagtcatgcctatgttctcacatatttagggaatattcaaggcaccctgttacacttaagagcttggcatctcttacgttgctgacatgtgcactatgcgtgtgatggtaggcaccattgctgcagggtggtgtaatggagagcatcctcttaggactgtgactctcaaactttagggcacattggaatatcctgggcagatcattaaaagctttctcagccccacacttggtgaggtctgttacctatttccagacctctggaatatgtcctgttacctgaggtctggaaagtaacttaggaatatgcattttaaacaggctctctaggtgattctgatattggtagtagaagagccattcttgagaaatactgaagtcgaagaattagtgaagatttgacagagttaccagataagatgtcatttgtcagttgtaattcatgaacggggaggctactaactgtagttttacctgttcagtctgttccctcccaggttgcctctcctgtgtttccatcttggacttgctcttgattcactagagtcagactaatttgagttctttccagaaactggaatgtgattattccttagtggggaggggtagccccccatcactgcttgggactcatgcaagagcaagaaatgcaagtatacaaaagtacccaagtcttgatctcagtgttctgcagtacaaaccactaagacggaaatttcaaactgcctttcactgaaaacaaaaagcaaaagaacaaggaaacatctaaatcaaccagttacctttttttttttttaccccaatgctgataatatttcagtggtctgtcagttatgaatctgaccagtcctttaataaaatcttctatgcttataaagcttaagtgatttttgcttatacagtcttctaatagataactctttttttccccctcttgttatatataccctgaatcccagttttggtcttaatgcagaccatgtttaagatcttggccttatgccattttgtagtacagataaataattaatggtttttattagtttgtataattcattaaccattcatctatcaagctgaatgacttatagatggcttttacatttcaaattgttcagaagttattaaggtctgtaatttatcatcacagccatttctgacctcgttcttggtccctcactggaatgatgttcattgaatgtgtatgacacaatatgaagaaaattaagttgcactaaagacattaccaatatgagtagggaggcttaaaatgttggcagtaatcaatagtgggacttaatttgtatattctgtgatggagacatttttattacatttatatttttaaaattgattccatttttaaattagttgccctcatttcagactatactcaacagcgaaataatatattttctgaatctaaatcatcatatattatttgacctttagctgaatccagtagtaaagatcaaaatgaattatgcttgagtggaaagaggttttaatgttgctttacacttggttttcccccattccacatgctgtttaatattattgattcagcttgaatgatcatgagcccaaaaactactttagttggttttggctaatgcattcttggatgctatggaagtgcctgtaacacctgaatggttctgcgtaaatagtcacgcatttttataccgtccacgagaggacatgcaacgtgattgcctatgagcagcagagaacagttttctagacgtatgtttttcccttggtacaaacatgtagcttccgttagccctaataggagctgcgtgtttgcatctaagaattcagtatttagaatatgacaagcagtgagtatttgaggagttattactgaacctttcaaataagttgaaaggcagacatgattttgagtactggggaagtgtattaatcccttagaagtgaactattcagaatatttaactctattatcatgaagtgttagtgagtagggaactatccacatgtctagattcctttcagcttaatagtgtctccatacattttacagtcatatcagctcctcgtaatgcacttcaccacgtgaagtgaatgaaatagcctcagtcttgttcacaatgactgggcctttcaaactctccttatttaatttgctggcattatgatggctcttgcaggacctctgttgcagaatcaaaatgtgcatgcagagagacagctgtgctttgatttagcctatgagataataactatcattctaaaattgtcttacatcatatagacacaaatttcaaatctcacctattttcccagctctctcttcagatatgactttgctagaatgaggcatattcttccttgtcactcttcatttttaaaaaaattttgagaatgtagatttacttctactctggcagtttgcacatcttggttaactagaccaattaatgcaaaagaataacccccaaatttactgctccccaggttattgtccagtccctgtctcttattaatgtgattcctgtgaaaacttgagattgaagaatatagtgaaaaagtaccatctaccccaaaagcaaatctaaaatgagaaaactttcttaagcaaattctcccctaccaggcacatgtgatttatttttcttccttccacttagaattgaaaaaacatgattcatatcccatcgttgttataattttgtagacttcagagcttttcttttttcttttctgttttagttaagttgtacgtttctttgtatgtccttttgtcttttactgtttgtaagtgtccttgatagatattaccataatggccctttcctttagcttatactcctatgttatgatttgttttccacatcacctttatttagtaactcccagtccattgacctttttcactccttatgctgtatttagatggaaataagatgacacgtaccagttccatcttggagcgctaagagatcttcaggctcacaaactaagattaacctactaacatgggccactgataacgatgaaaacgtggaaggagaggcagtgtaagtaaaagagaaacctgcatccagacaataagtaatgaggatctgatggtgataaagatgaatttaaaagacaggagtaaacatatgaatgacctacacacaagaattcagattttctgatgttttatgtgtggtacagcctattcatagagaataggtgtgtcaaataacacatatttaatttttatatccaatatccagtatctttatagaagtgactactcattattatgttcattttaggtaatctgaagtcctaaaacctgccttatacgtttggcatagaattgtgttccctggtaatgcccactaatgaaatgtttagggaactcaactgtgttccttcagaagcttctgagtctgccatcactttcggtgaatcagtgcttctgaaaagtgaattcaataattaatacgagttatttttctgtgaatttagctttttacagttgttaaatcagctgagctgttatacagtttataaaactatattaaaatttaatatgattactctaaagtggctaaggttttaaagttttcccaactttttcagagctttattaaagcattaaatataaagtgctctcttagccacagtatgactagttatttattggttagaatgacaaatctacttgtctgagaagatgctgagttagaagttctgttcagacagtccccaaattgcctttatgcagcacagtggataaaaatctgaaaacagaattggttattgatttttgttttgcattggtagcaagagaagaataatactgtaacttttttttcaagcatacaagttctgtacataatttttctctgtcatttttgtgtggcttttggtaccactagaacattccatatgaccctaactctatttcttatatttctgtgagattctttgagtctaaatacctctttattacaagtttctttacccatgggattcctgttgcttttacttaagagatagcccagaactcctcttacattcttttcagaagtgttcatgttggtttatggtagaatagatttcaatgtaggtttcccttccttccttccttccccattttgatgtttagttatatgtcatctggattaatttgtttttctttttttaaatttattttaggcttaagttgtatctagatttttataaaatacattttaagactactcttttttccctagtatttccacatctaattgaagttgtcctaaaaacagtggaggaatattattttattcaatattttctatagaaagcccgatccttgccacacatgcagcatcagggaaagcctcagctgagacgtggaaattgaagacagcatgatgggtaattcatcacaccagtgaatttagtatttgttcacccttttataggctttaatattgtgatccccactttacatatgaggaagtgaagatttagaaaagtttagtaacttgccttaagagtgtagcagaactgggaagtttgctcttgttgttgttgtctttgttgttttttgaggtggcatctctctctgtcacccaggctggagtgcagtggcacgatctcagctcaatgcaacctcgcctcctgggttcaagcgattctcctgcctcagcttcccgagtagctgggactacaggcgctcgccaccatgcccagctaatttttgtatttttagtagagacggggtttcaccatattggccagactggtctcaaactcctgacctcacgatctgtctgccttggcctcccaaagtgctgggattccaggcgtgagccaccacgctgggccggaactgggaacttttaatctagtcctgtctaattcctgttatgcctggattgaacaaaagcagagatgtatgagagtgaacactgtccctcatattgtgcttttcctgtggcgagttgtggctagactgcgcatgactgtactggatatttcatgggaaaggactccaggagggagaccatgcccacatttatagtgaaagaaaagagggtttggagcacttcattggaacactggaagcttcctggtcaagaaaataactttgttagaaagagatgacacctaagtattttcttgagctaatttgtgatagctgaactgtatctccttgtaaggaccaccctaggtttctgtcttcttacgtctaaattccatgcctccttttaagtacaaaacttcttttattgtcatcttcatagactccacccttctggagtaattttgacagttcataagtgaagtgacagatgagaagaggctaaattcagtgtagttcggagtgggttcaaaggaaccccctccgcagagcagcacactggtatctcaggaattaagtctggctctcaggctaacagatgtaaaagatagttctggcctgatgtatttctcctgcaaatgaagttatgttagaatagtttaaaaattaaaagccaggagattctgagtcaaggcctgaagagtttgcttatgagtgaaattaatgaatgaacattaatcacctattttgacaattcatagaatttttttcttaccttctgatgattgactgtgttctaaaatgttaagcatgcagataaatggaccttttgggtaaatgacagaatgatatcagcatttgtctctttggaagctcaattgtgccatttgaaggaaaagtggggattttaagctgtcgtgccatgtaagagtatatatgtgacatgatggtccagaatcttgctaaaccagtgaagcaaataggtaaattaagtggtgagctttgacaaaggtaagattctttgatttatcattcctccatttcattgggttgttctaaagaaagagttaagccaatttatttagtaatcatttactgagcccacattctatgctggacacagtgctcagcactggaaatatagagacacaggatctgctttcaaggagctcacacttgagaagggaagcatggcaggtaagatatgggggcttcagcattagctgtttaagtggggtctgggaaaaggaattggtacaaagaagcctgttttcattaatgtgaggatgagtgacaggtcaggaaatggggaaagtaaatttaagagattatagggaaaaaataggggaaaaatagattataaacctattttatttggcccacttacagtttttggggggagtttctgtttttattatcagcatataaaacttgggaaattacatataaatatatttctgggttctcttacaaaacacagtagataccctgggctctgttttcacacctgactgaagttagctggcaatggatagtgatctccacctttagcaggcactggtactctcttgttctccatccggtccacttaggattctcctggctcctctatatttgagtttgagacttctagtttagggtattttcacatcttggcagtgatgggaagcagctagataggacagggggaagatctggactaggagtgggttgttggtgcattaaatatgaaaaagatttgaggatgttattgactgaggtagaagagccaggagcaagtgagaaacccaggagaaggagagtgtgttctgggctgaactgtgtccccgcaaattcatatgttgatgttctaaccaccggtacttcagaatgtgaccatatttggagagaaggtctttgaagaggtgatttaacatgaggcctttagggttgaccctagtccagtatgactggtgtccttgtaggaagaggaagagacaccaacagcacatgtgcgcagagggactgccgtgtcaggaggcagcaagacagtggctcctccagccagagagggctcggaggaaaccaaacctatagatactttcatcttgaacttccagactccagaactgtgagaatcagttgctgttgtttcagccaccagtctgtagtattctgttatggcagctctagcgaacaaccatggggaggtgctggcgtccagaagcgggagagaattgatggagcagagattgtgtctgatggtggctgaacaaatccccaatatcttgcacacatctggattaaagctctgtggatatttattgaattaatttcactgaaggaccagtgagagggaaacaaagccctggggtcagagggatttgctgtggaccagggaaggaaactggagaaagttcttaagtctccagcctttattttctttttctttttcttttcttttattttttgagacggagtcttgctctggagtgcagtggtgcgatctcagctcagtgcaacctcaccctcccaggttgaagtgattctcctgtctcagcctcctgagtagctgggattataggcgcccaccaccacgaccagctaaattttgtatttttagtagagacgggttttcccatattggccaggctggtctcgaactcctgacctcaagtgatccactatcttggcctcccaaagtgctgggattaaagcgtgagccacctcacccagcctccagactttattttctgggcgaagaggtggaggagtgattgggttggatttgttactgtggtatcaccatattctctcactagccatggaggctttaggcttatgcataagcaggtatcataatgtattgaatggaaaaggatttggagtatattttgttagctagcgtgataccaggaagtccttgttgtcaagaactgttgttttcaaggaggaattgcatttctgagactgtgcgtggatttaatacgtcacatttcgatgatttgagggagatggtgatgggttggggaactgaggaaagggagaagtctctggaaaagcctctgaggaaagggggaaggagttgactcggttccagctgaattcttgcaggcagagtcaaggcccagcctggggtttgcagtagcaggagtcctctgacttggttggaaaaagaacttgggctaagagattggaaagcttcataggccaatgatagggcggtcagatatgaaaaatgtaaaggtggtcatgtagaaatgagaaaggatcaaatgtgttcaaatttatttatgagaaaaatggatttttaaggcagtgtttcaggaactacagtactaaataaaaggactgatatgtatatgtcactgtttttttaaattaaaaatatttcaaatcataaaagtacattatagaaaatatcgttaagtaaaagtattaaataaaaatcacccattagctcaccatctagaaataataattattattttgcagtacatatttccagtttttctatgtatgtatcagtataaatcatttaaaaatggcttttttttgttttttttttttaaattgagacagagtctctgttgcccaggctggagtgcaatggcatgatctcagctcactgcaacctccacctcccgggtgcaagcgattctcctgcctcagcctcctgagtagctgggattataggcatgagccaccacgcccagctaatttttatacttttagtagagacagggtttctccaagttgcccaggctggtctcaaactcctgacttcaagtgatccacttgcctcggcctcccaaagtgttgggattactggcgtgagccaccgcgcctggcctgaaaatagtttttaataaacccagtggacctgtaggtgattgatgtgaaccggatcattatgcttccgtgacatttcttggtttgaagtgtggtaagttagagcaactgagattttcataaacacttcatttctgggtttcatctgaacattgtcatcctcattttgctgatacttcctcctttcccaaggtcagcaggccgtgacagctggtactgccatgtttttgatggcctaattaaatatttcatataaaatgcatattaccatctgcttaggttacagatatagtgacccaaataataaacaaaatagcatgcgtgtgcttaagctgatccagagagatgaacacccattttctgcatggtagaaaagtgctgggcttgcgctggtttaaaaaatgctcctgctttaaccccctattaataaggttgactgccattagggattagcaatttttgtggatgtgtccatattctcatctggtatctcttattactgctaccatatataaggactgatagacttacttagaggggaatcttgagcttgtagggatgagcagattattaatttgtctgtaagaattgtacttgtcacgttggtatcaccattttctgtcaatagccatggaaacttaggtttatataaaagcaaataacatattttgattgaatgaaaaagatttgctgaatatgttgtgagaaaaccttgttaatatgggggcaagaaatcctcgttgtcaagaaacattgttttcaaagatgacttgcatttctgagacttcatggatttaatgtttcacatgatgctttgataagaaactttttttttggttgggaggtagaagaggttagaaagacctaggtttgatatcatgactttagctaagtaacttaaatttggtgaacttcattttcggctctagaaagatggggttgataatacccacgtcaaaaggttgtttggagaatcaaatcatatatatgaaaagcaaaatgcctactgtagttcctggggaattgttagttgttcccatcccgtgcatcttctctattacagtgggcgtctgtgtacattcttgctcagtgtctacgctgttctcctctatcttctctattatagtgacgtctgtgtacattctacctcagcgtctacgctgttctcctctatcttctctattacagtgggtgtctgtgtacattctttctcagcgtctacactattctctatcttctctattacagtgggcgtctgtgtacattcttgctcagcatctacgctgttctccatcttctctatcacagtgggcgtctgtttacattcttgctcagcgtctgcgctgttctccatcctctgtatcacagtggacgtttgtgtacattcttgctcagcgtctacgctgttctcctctatcttctctattacagtgggcgtctgtgtacattctcgctcagcgtctacactgttctctactctattacagtgggcatctgtgtacattcttgctcagcgtctacactgttctcctctgtcttctctatcacagtggacatctgtgtacatacttgctcagcgtctacactgttctctatcttctctattacagtggacgtctgtgtacattctacctcagcgtctatgctgttctcctctactctatcacagtgggtgtttgtgtacattcttgctcagagtctacactgttctcttctatcttctctattacagtgggcgtctgtgtacattctacctcagcgtctacgctgttctcctctatcttctctattacagtggacatctgtgtacattcttgctcagagtctacactgttctctatcttctctattacagtgggcgtctgtgtacattcttgttcagcatctacgctgttctccatcttctctgttacagtggctgtctgtgtacattctcgctcagcatctatgctgttctcttctaggaatagcatctccgtgtttactttgtttaacttccaccttggataaagccttggtgtcattgtcaatcaagatctcctggtaagcatccaccccaccaagccagcgaatcaggtgtgctcttctgaattttgtacgtgacaagatattggaaatgtgtcaaacgttgtcctgaagggagggagtatccagtaatttctgtttagagccctgtaactgctctaagccctcacagtaaatacttttttcaaaacaaaacaaaacttaaaatagcctggttggctgtataccaaagttccctgtttggtgcactgaattggaaataattccacaagcagatgcattcatttgtttaatccaagaattattaagtgatttccttattctttatatatccagtgtgaggtgctgagtgcattcatagaagagaaatatcaggttccctgtccctggggtgtgctcagctcagtgacttcacagagggcacgtgatcttagagtagtagcagacgtggagcatagcctgaggcacaatcccagactgaattttgtattaggtatagtgacagttaatctaactctaaaaacatcagttatggacataaggatgggaacagtaggtactgggactactagagggggaagaggggatgggggcaagggctgaaaaactacccattgggtactaggctcaccccctgggtgatggagtcatttctaccccaagcctcagcgccacactacatacccatgtatcgagcctgtggatgtacccccgaatctaaaatagaagttgaaattataagcaaaaatttacattaaaaaaccctttaatgcccattagttacttataatctgtttaaagaatagccagttgctctcagccttttcatttgtttcattaattgcatctgtttatttactcagtctggtcaagaaaaatacccttaatcgtttatattaaaaagtaggtgccactataaaattctaagcttttgctgaaaatcgtgacctttgattgttcatactggtaatttatttctcatttttatgttgcaattacaacattcaaagcagtagactaagatctaatgatttagaagcaccagaggcattgctgggccaggatgacaagcctttaatgactctcttaggcagtaaaaaagccactgcaattgctgtatgaatattcatttaagaagcattcattggttgtaaatcttttaacatgtagactttaaaaaagatgaataacatactatgtaccccggtcattcttattgaatgtgtcttcagatattttttatcaaattcattttactgctctttttgcttatgaaaataaaatagtatttcattagttgagctcatttgaatattagaaataaacagagttcatatcatgtgaaattgctgacagctcttaaaatcagtcctgcactttgcccagaggcattattcacattgctggttacatctgttcttgggaaagagaacctgccttgactgtgaatgggggtccagtttgccccaggtttagtccctgtgatactcagcaaatgttgcctggttctttactaaatatggctaccctgtgatgagaagctttgggctgattgggccttatttgtcttcttttctcttactgggaaagcaaagactgctgaacataactgatgtcagaatgggcccgtgttagctatatactgtgtacaggtcaagcacataactattaatagtaaaaatcaacttagacaggggaacgggattcagatccagcagttttatcctagcccacactcttaaccacaattacaatggcaaacaaataaatatttttaattgtatgcagtatgatttagtattggaaagactgtttaaattttttaaatagactttaaattttagaaagtgtagatatacagcaaaattgtgaatagtacagagtgttcccctatatattctgtacccagttttccctattgacaccttatattagtatggtgcattattacaattaatgaaccaatattgatatactggtactaactaaagtccatactttattcagattcccttggattttacccagtgtctgtaccagtatgccacacaggataccacgttatttttggtccttgtgttgctttaggcttctcttggtacagtttttcatactttctttgtttttgatgatccttgacagtttggaggaatattattggtcaggtattttgtagaacgtaccttacgtggaaagaaggtaatacctgtctgaattttttttcatgattagagtggagttacggattttggggaggaagaccacagagataaagtgccgttttcattacatcctacctggaatatgctctattgacttgacttgttgattttgaccttgatcacctagctgaggtcgcgtttgtcagccttcgccactgcagagctcctccttttcccttccacactgtcctcgtcacagggacgtcactaggcaccacccagacctaaggagaggggagccacgttccacctccttgaaggaggagtatttaatatgtaaattatttggaattcctctgaacaggagatttgtcttttatttatatcagtatgtattcgtacacaatttattttatatctctagttataatccaatactactttatgttcttgcccaaaatattctaacttttggccgcagggaactttttcagttgatttctgtgtccgtttgacatatcctcatcattgcagagttgtttttttttttctttagcacctcctcactttctggcactacaagatgcttcaggcttattttttatgtttcctgctcatatcctagaagcagccatttcttcaatgtgccctgttttcttttattggagaatagttttagaaattggagaatttagaaattggagaatagttttagaaaacaagattgggcactatttatgtttattgctaatgagttttctttgcttctaggccctatgaaagttttaacttttaaattttttaagctgcttgagctgctatactaagcaactatttctgtaaatgttggtggccaaaagtgttaaataaatagtttaaaatttgtttttcattggggaaagaatgttgtattgtagttacagttgagaattgccaaaaataaaatttaaaaagaacaatacttagaagaacatttctaaaaacatttcttagaattgtataattgtctcagtcaacttgcttttattatttttcaagataatttttaatgattttatacaaagcagtgattccctgggtaatgattgtgaagattttgccttttgtgcttctcttttacagtggatttttcatttatttaacttggattagaattagaaatgcaaatacgtcagcaattgaatttaccccttggaatcttgctttttgctggacatttactatctgaattacacaaaggaaaaaagacaaggagcagtgtctgtacccaggagttattgtctagtagttaataacaagcactgtacaagcattgatcagtcaaaacaggaaatttagaaacaaccaggagaccatatcagatgtattctgggcaaatatcacccctgcccaggcctaaagaactgccaaaaatctttaaaatattggcttataaataatgtgaagtagaaaaaaaatttaaacatgacatctcagtgatatttctgcaaagggaggtttttttttaaataaagaagtgacagtaaaattgattttcactagctttaaagacagtatcatcctctgtatcgtaagatattactctgagaaacaccccttcattctttcaggtgaaaggcagcctattatcacaggcagccaaccactgcaacagctggtattgacaaaggctctgaccccttttggttaaaaatgaagcaaaaatctgagtgttcgtagggcttcctaacctccggttgagctatatgtaagaacccttcacccattataataatccaggtatgcgatgttgtattacagtgacctgcagggtcatgacttagtgagaggcattctttgtcaacacagggaaagttaacacagaaggtaaaatttagaagaaaggtgaatggttataatattctttcagtgcgtgtgtgtgtgtgtgtgtgcgcgcgtgcacgcacatttgtgtgtatatatttgtatattccttcagcaacatgtcatatggtctaggaatccctgggcgatttctggttttggagaataggatgtgaatgtacctctgaaactgacagaatgatgtattaccttgtaggtcactggagtagagtccagatgtgcttaagcatttatgaaaagttacctattgtcacagaggccccgtaccacatgagtcctgtgagactttaaaggaaatctaaccaaaattgaactctatttcaggtatagcattttctgtggtttgataatgacattatacctattaaaataattttttgccctcattattaaaaccattagtttatttagtgacttcacagtcacaagttttttatatttcctgggcaagcaaaacctcagtagcataaacttagttttgtcactgccccggggatcccacttcatatgggccaataaatttccaggcaactacaagtattatgtcatatgtgcaaaaatgtgatgtcttttttgatccaaacctttgccagacattcaagagaggttaggatgtagtaagtgtttgtaaaagactggagctctcagtaggccaagtatagcgtagaaactggcagtggtgaaaacctggctgcaggtacaagagaacacacgtatatggattgtagttacagctttagtgtgagcgaattaatcttcattgtacgagggacccaatgtaattcttcagacgtttttgtggaaaatcttcgtgaaggagacttagatcattgttgtgccgtagaatttctctgataatggaaatgttctctctttgttgtgcaatatggcaatcagtagccgttttcatgtatcaaacacttgaaatgcgttgaatgtgactgaggaattgaatttcaaatttaattttaatgatgttttaaatttaaatagctacatgtggttagtgactaccttttggatagcacagctctagatggctaggtttggcatgtctactcgtgagataatgtctgtgaaaaactgtggcatgcagccgggtgcagtggctgacgcctgtaatcccagcactttcggaggcctaagcaggcggaacacgaggtcgggagttcgagaccagcctggccgatatagtgaaaccctgtctctactaaagatacaaaaattagccgggcatgatggcacatgcccgtagtcccagctactcgggaggctgaggcaggagaaccgcttgaacccaggaggtgggaggttgtggtgagctgagatcgcactactgcactccagcctgggtgactgggcgagcctccatgtcaaaaaaaaaaaaacaaaaaaaccccacaagaactgtagtatatgaagtgttcaaaaaaatgtttacttttccccttaggaagtgtgtagacccccttgatacttttttaaaacaacaacccacaggttaataaatcttttgttttaactttcccagtatagtgccattgctcatgtacctcttaaatttcatgatggtatgaggaacctttagagctgcagttatagagaagtacataaaaacagcgtacctctcttaattgtgcgccacccccaaatgaaagagaacataatgaccaatttgtatccattttgttccccagcactggcttgcgtgaacatgatttagaatgctttgctgcttttgccattttggtgtacgtttgaataaaagggaaagcttgaaaggggacacaaaggtaagaaagaaaagaaggcctagaattaaagagggagaaaaagaagcgtgagtacccggagagctgcgaggacgatagcagccgtctgcggctcggaagaactgattgtagatctacaggaagtgtgctgttgtgctgctggcggaggccgtccctgaggaagtaggagaagaccactagggctgtgtctaaggtaactgtaaggcctctccatcctttctgctgattatgactagcagctaatttggatctgatttatactgtggggaagaagcttggagagaaacgtggggtgccagtgtgatgggggtgggtcagtgaatggcggcttgctgtctctgtagatcaggccacaaggccactgctggggctgcctcttttgtcgtagggacttagtctagagttttattgaagggtacgtaaaagatcatacaaataaacatattctgaagaatacattcatcagtacagtctaatttaaatctccagatagttggtaattttgctttttatggacaagtcttttcatcgaactatttctatttctatgtgatcttgttgtattttaaatgttaatttattcttccaatctcttcttccttactttcatcccagaattttttcagatctgtatgtttctaccaatgtggctctcaggttgtccctaatttgtcagaggctgtagtaccatattttcttaactggtagtaaacaagatatgacgataaatgggacctaaggatacttctaatgaggaatacttttgtcttcacatgttttattgggtttaactagaatgtagaatgaaaaacaatatgacttctctgttttcttagcatattttgttcttaatttggctgtacttattagaactcctccaagatttcctataatcattacattaaaagccttcattatcaattgaaatgcatcttttgtaactacatttcttttttttttttgactttaccttttacctttttaaaagcaatgaatgcattactcttgccaagaaaatgtaaagatcccaggaggacttactgttctcctttttccctagagagagctaatctcaagttcactctttttttattaatagttggattgagatacatttagtctcatatttactctttaaagaatatgtaatcattacaatcattactaattttatttcttttcccttaacccttttaaagttataaggaaataatactgcattttaacattgataggtaccgtaattttggattttattttattgtagcatttacattaactgcgaatcttggctttaaaaaagccacacataggttaggcacagtggctcacgcctgtaattccagcactttgggaggctgaggtaggaggatcgcttcggcccaggagttcgacaccagcctgggcaacacagcaagacttcatcactacaaaagaaaaattaaaaatgagccaggttattttggagctttaacatttaacaactgccctgctgggttccaaagttgcaggagttctgtagcccctttctttttgccaatttcttcaattaaacctcttttcttataaattaaaaaagtaaataagtaaataaaataaaaaatagctgagcatgatggcacatgcctgtggttccagctgcttgggaggctgaggaaggaggatcgcttgagctcaggtattcaaggctacagtgagctataataataccactgcactccagcctgggtgacagagtgacaccttgtttcaacaacagcaacaaaaacaacaacaaaagccacacatagcctcttctgtatccaacttttaagtgaaagttcttaagatcttcaatgtatgattcttaattttttccgtaataacaacactccagtgttttcagatgtttcagattgtatctgtttttgtgcagtggttctcaaacttcaaggtgcatcagaataaccgattgctgaagtttctcatttattaggactgggtgggactcaactgcatttgaacaagttcctgacttactgatgctgttggtccgtggccatacttcaggaatgactgtgttatcatatttgattcttcgagaatccagtgagatcttgggcagatacagatagggaaaatgaagcttgaagacatttgtgatctttttccagcgacacatcatgaattaatggttgaacaggtaccagaacccatgaagacctttctggttttctcctgctcatggcaagagttcagttcccaaaagacatctctctgatttcaaatatgtttgatctttttgtcttattcttttaagagctattcatgtgtttggatacacacccctaatattcacatttatttataatatatgcttaaaattttcttgtctttcagttacatgactaatttttgtgcctagagatgttctaaaaatgcagtgtctttctgaagaaacaaaaccttacataacttgtcaaggccacccaaggttaatcatgaggaaaaacgttgaatttttttacccaccagcctagtcttctggcattttttcactctagcttgcggtgatggttctaggcaggaccattatttgtgggtccaccaaacgaggaatgatccaaaacaaagaatctcaaaaccacatcaccagaccctcgcagaagggccctgtactgatttcaaggatacttttatattttgctgcttccatggagaactgatagttggtctttaattggtaccaaaacattgaaactcctgcgtgtaaggcagtgacatacagaatgcaccgtgaggtgcgttttctccgtcttcccctcagtttctctctgaactaccttagggtattcagtatgtggagcatgtggactagtgtcttgaacccggtgtcagccatccatcaggatttacctgttgaatattgcatggtaagctttgctagtatagtgaggaagtgctgtatgcttttctgatactggcttttctagttcctacctctcattttctcttgctttccttcttctgttctactttgatgttggggcccctgaaataccttaatccaaaatagaagtcgggagggaaaaaatgatagctggagaacaaggtgaaaatcttgacctcgactatcttctattatttagtatagtgttggctttttgtgtgtgagttggggagggggacaaagaaaatcatgatttttaaaaaatttagtctaattgagtagtaatttaaatcagtgagctttagcgactcccctacttcccatgcttccttttttttttttttttttttttttgagacagagtcttactctgtcacctaggttggagtgcaatggcacgatcttggcccactgcaacctctgcctcccgggttcaagcgattctcctgcctcagcctcccgagtagctgggactacaggtgcctgccaccacgcctggctaatttttgtattcttagtagagacggggtttcaccatattggccagactggtctcgaactcctgaccttgtgatccaccctccttggcctcccagagtgttgggattacaggcgtgagccaccgcgcccggcctcccatgctttctaatgctgaaataaaactcttaagtatacgctacggtctgtgtgtggtgctttatacgcaccattttacttaatcctttgttaagcagtattattttgaggaaacagattgagagcgattatgtaacatggccaaggtctgacacttagtaagtgataaacttgggtcttaaatactagtcttttggacttgggcatttaaggacgactagcctgtattacctttcctttgagatccttcctcagataggaggtgaatttaataatctggatttcttgaaataaattagactccacaaaaacaaatcctgcctttaaaactgatctccatatttccccttgtttgttacggtgccagttctttaaacatttgcttgaaaagagaaatgtacatgttgcttttagagacacgtgtctcctaagcacatacaaatgacagtattttgccgttgctgtgcctgggagtttttattttagttatttgggctttaaaagcagcatatgatggagtttcaatatgtcttaaaaccacggagtgctaccatgatacgtacataaataaaccgtagggggtctctttctttattttgcccatggagatgtctgatagctttcagaaaaaaggcagccaccctaagtgactaatgtcacccatttgtagggaaatagttgagaatttctcccagagtatatccattaaaaatcacttctttagcctctcctgtgtctttaaaaccttttcatctttcctattttgtcttatatgtcccttcttgttataggagtatgtattttaataacaaatttaatacagtattcagtcttagaaccagttaatgttagctgtatagcaaaaacaaacatatattcatccagtcagtcatgctccaatatggaataactgttaccgacacttgcgttgttcccttgcttcctgagtagctttgagaaatatcattcctgtgagtctcagcttccttatgtctaaaaagctgatgatagcatctctttagatatttgtaagagttggatgaaatagtgtgcattgtagaagaaagcgcctctgtgtagtggggtgggagggaggacatggcaacaaggtacctttctctttaagaagttagaagtttgccttctggaaaacagttataaaatcaaaacccaatggctagttcgtgcttcagcagcacatatactaaaaaattagaatgagacagagaagattagtatggctcctgtacaagggtgacatgcaaatttgtgaaacacttcatatttttaacataaacacacacaatggctaatgaaacatacagacctttttttttttttttgagacagggtcttgctctgtcacgcaggctggagtgcagtggtgcgatcttggctcattgcagcttttgccctgcaggctccagtgatcctcctcactagcctcccgagtagctgggaccacaaatgtgcaccaccatgcctggctcttttttgtgtttttagtagcgatagggtctcaccatgttgcccaggctgatctcaaactcctgagttcaagcaatccacccactttggccccccaaagtgttgggattacaggcatgagccaccacgcctggccccagacctcttaaagaagcatattatgggtaggcctataatcgagttcttaacatagatattaaaaaaaaaaatgtcaaccacaaatgttagtaacttgtgccacttttaaaaagcaaacttgttcagagtttctgtttgggatgacaaaaatcttttggaaatagtggtcatggttacacaacattttgaatttaatgccattgaagtgtacacttaaaatggttaaagtgaaaattttatgttatataaaaatatttttaaaaaagtcagtgaagtgaatctttgcagggctccattaggcattgtctaggccagagaaagctagaactggggccatactgcacagctcctggggcaaggagatcctcttttcagagtccaatctggactctgatcgctcctgttcgctgctgtatttctagctctaggccaggacgtgctggatgaatgaacagtctgtttgcttcatggtttgtgcaactcattgctcttgctgtagtgccagacacgacaacattctgatagtagtttgacttcctatgcagggagaaaacatgaaggtcagaggctgagtgtccagtcctttcacccattagtttttttattgtaaattaataaatcgatatttattatacattcttaaaaatcccaaaacaagttcgagctttacaacttgacaccaagaggtctactagatactttttatcaagacggccctcagtgcacgtgaggaatgtgagccaccaagaccattgatacgacaatgaagagaactgttcttagggggacttcttgtaatatttccgtcaacaagtgctcacatgaaactaatgcttcaaaatgggtttcttgtactttgcattgtcattatctccaaggaatgggttccattattgtggggttgtttgcttgtttgtttaattcatagttttctattcaaacaatgacttgttaatcatgtttgtttcaaaaaagatgaataaaaatttactggtctctttagggctgcagtcttgcttagaaatgaacggaatctagaaatattttaattaagaaatttaaaagtttcaaagcttgtagttttaagatgtgcttgttttttcacagtggagctattgaaaaatccctcagcagcttgctttaccactgtgttttctgcaatgatcctcttgagcattttaaaagaaaaaaaattgtgccaaattagttttaaacattattccttgctttctgttctcttcatgtctatgtcttgtgtttctttgcctgaacacaggacataagaaccttattgttttctcagagtgcttttgggtccttatttgatatcttttccactcttcattcctatttgtttctcctttcttttcttttcttttttttttttttgagacagagtctcactctgttgcctaggctggagtgcagtggcacgatctctgctcaatgcaggctctgcctccgggttcacaccattctcctgcctcagcctcccgagtagctgggaatataggcgtgcgccaccgcaccaaagtgctgggattacaggcatgagccaccttgtttctcctttcttaaacgcagatcttttgactggagctgtggaactggggtcagagttgagctccatcagcacatcacctcgttatctagcacatcacacctactttgtatgtttgtgtagcagaccatttcttctttcgtgtttcctcattttacatttcatctcttcagtcacagcgaaaagttgttccgtgagacctcttgcataatgactctaaggggcttcagagacattctcctgcgaggtaactgtgcctgtgatgtggggagagtgtgagactgggaagcagaagaccggaatgtgatacagcctttcccacgacttggctgaggaactgctgttgtgaaccttttgccctggtgggattattgtaagtattcagagggatcattttgagagaagtgctgtggacattgacagtgccagactctcacaggtcaagttttcattgtctcttagttttggggctgatatgaaatgaacttgggtctttttctgagggctttcagaaagttagcaattaaacaagaattctaaattctgttttttgaattcacccaccgtgctgttctctggtttcagagtacttgtgcatggtaagggactgtgaggaaagactttgaaatgattaaaaaaaaaagagcatgttttgtctactcaaccatcaggtcagctctgcctttcactgtctttgagctgtactagaattgtgtgtgctgcagaaaatagacagtaaagcgcctggttcttgtccataaaatgcagttgtgtttggagaatgcaatagattattttcctatgcatattgactagttttgcacattttacatcttgctggcatttctgatgcttatgtatttgtgtcttctttgaattcttttaaaaatcagacttagcatcttactcattttctagtgagttaaatcttttatatgtgttttattaattttgagaatcattattttgctttacagaaaattatttcttaacaatacagtaaaaaaccacaattctgggaattaagggaactatttatgttactttgagcaaggtactgagctctggttttcctcatttaaaaaaaatggtgagatttgaccgagacaaacctctagtctgtgattctatgattttatgattctgttattctacaatttaatattctgtaagcccaaggtccactgtcctaagtttgttaatatttaggtgaattggcatagaatcaaggaactaaagtatgttatgtatgtaaaaattgtgtaagttctttttggcatttttagcatacgtgtgcacataaattaccattgtacaagatactttggtgtttgtaattcttgaaaaggaattaccagccaggcacggtggctcatgcctgtaatcccagcactttgggaggccgaggcgggtgatcacgaaatcaggagatcgagaccatcctggctaacatggtgaaaccccatgtctactaaacatacaaaaaattagccgggcgtggtggcgggcgcctgtagtttcagctactcgtgaggctgaggcaggagaatggcttgaacccgggaggcggagcttgcagtgagccgagatcgcgccactgcactccacactccagcctgggcgacagagcaaaactccgtctcaaaaaaaaaaaaaaaaaaaaaaagaatcactaacatggcaaaaccctgtctctactaaaagtacaaaaattagccgggcgtgttggcgggcacctgcagtcccagctactcaggagaatgaggcaggagaatcgcttgaacccgggaggcggaggttgcagtagccgagatcgcgccactgcactccagcctgggggatagagcaagactctgcctccaaaaaaaaggaattatattacttgaattgctattgacagttttcagtagtgagtaaaggaagggtgagcattctccaggcagctttttagataagaagaaaaatttatttgcctttaaaaattcttggcatataacaccattagtgcttatagaaaatgatggctgttattgaagtctgtgactttttaaaaccattattaagttcaaaaagcatttctaaaacatctagccttacagagcattgcattaggaaatgtaagaaacaaattgaaacttttattcctgctgtttgggtagtcactattaagcatcaatgtggtaggtatgtctgagccacctcagggtactgtaacaaaactccacagactgggtggcttaaaaaacagaaatttataattcctcacagttctcaacactagaagcctaagacaaggttctggcccactaggtttctggtgaggtctctcttcctggcttgcagatggtgcctccttgctaagtcctcacatggcccttcctcatgcaagcacacagggaggaagggagcaggtcaatgagctctctggtctctacctgtgaggacactaatcctattgtgtcaggtccccacctgtatgacctcatttaaccttaattactgtctgagaagccccttctccaaatagaatcagagggttagggctgcaacgtaagaattttgggaggacacaaacatttagtccataatctgtgatattgttagaagcaagaagtcacacatctgaggtacagattgaggatggcaagaagtagtctccccagaggaggcctggtcattgttgaagacagccaagagttggtgagtttgatgccaatctgggtgcttctataattagaagatactaattatactgacccattcctatttatctgttctaatttttcagtggttacaaggttttcccaataggaaaaaagggcaatatacttgcttttctttctttttggattttaagcctgagacctctttgggtcatgatatatatatttagattctttcagcatgtgtaacaatatcccagaaaggactagtgttttatattcttttaactcctggtttttctacctactgcctttactgctttggtgctcatgggaatactgccacttagggaaaaatacaacctgatcttttgtggatcttggagtggcttacttggtttaaaataatctgggacgtggataggtggagttatttcaagcccttcggctttacttccatgcctaatgtcttttctcatcatttattaaagcgctttgactttgatatgtatcctgttaccaccttgtaaatccttttagtaatacctttctatgatgaaggtgtaaacactgctgtttctaccgcatttacttctccctccgtgtcatttttataggactttaaacctgctaatgttccaggttattaatttaaaacagccagccaaatagtagaagcttctttctcatctgtaatgtcctgacctcattttacctgtttccttttcaaattcagtttggaaatctcaattttcataatcttttgagctactacttcacttccctgatatttgcaatttagcagccttattattttcaagactttatatcaggaccacacatgaaataattactttttttttttggtgctggacatactcccctagctagtcaggatttttatttatctttctttatcttgtaggaaatggaattcttatttgcattttccctgatttctcaccttgcttcttcttaaccttgttctgacagtatttaagtgatgtagcttggacattgtttgcttttttatctcttatgccaaccttcttgtatttagctacatgcttagagctgcccaattaaatggcatccagtaaactgtattagggtttgtgcttgaaaatgctttgaagacgcagttgatgttttctttgtagtttctcgttattcctcaagtttgtaagttagtctaattgaaaagtattgtctggaaaactgcctcgtttacatgcagatttcattgattgccctgggcttgtacagacttcgcaatacttttgttgatggagtttctcttatgtgaaacactttagctacctgtccttggttctggactctagctttccaaaagcaacatggagaatttaaaggggccttagataaaagccaaaaatagacttagaagataaagttaaaggggttacaattatttaatctgctaaaaataagggtgtggagaaatttagcaatgtgctaactgtgtcttctctatgttaagtatgctcatttgtacttaggggctcagttagtgtcttctcagccgggtctggaaaacctggtattgtgattttgcttcagtatcatcattaggaaggatttaggtttgagcaatggaagtgatgttgaacataggaatgagtgtctggggaggagaggcattgtggaaatggcctcctgagtcttacttcctggataagatggattatgggtaaaggtgtcttccagatacaggattctaatctgattgctgtcatcagttttatttttctaattgtgactcaaagtgctttatatggtggaagaacaacaaagtgcacctaactgtttcagaaatggatctcttggataaggctggtgaacaggtccaggtagactgttgtgtggggtactggaaagagtactgtactgggagtcatatatctaggtgaggacccagctttgcatgaaagtggctacctgaccctgagcctgtgacgttatcacttcagtctccagttgtcctttttactgtgtgggagattggttagaataattcttaggtcccctttggatcagttctatgtgtgacagtgggagtgaggtcataactatcagggaggaagaggtgatagagaagtcgagagatgggaagattaagtggagtgaaggctgaggtaataggagaaaggggaaggaagggagatggcgaggaggggttttcagtggggaactgataagagtgtttgtggccaccagggatggagttttacaagttttaaaagttgatctctttctctctctctttaatgtgctggatttcagttacgatgagaacaacagtggtgaggttttacttggtctctctttttaaaaattagattaatttggcagaatttaagactgttaactcaattttctctttctgttccttatataagtaggttaaaatagtgctctttctttgaagatttcaaataattctttttattattacaaatgccccctgtgaaataagcaaaggtaattatctctacgtgatcattggggaaatgtaggtacaatgtaattaaacaatttatttgggaatttagtatgctagtgttagaattcatttttcaaatctctctacctggcttctctgctttaagttgtgtctatgtatctggaggatatgttagcccactggtgcttggcacacgggttgtagaagtactaatatatctcagagatggacatccttcatcctcttgaacgcatcttaaggactagatcccaaaggggacccctatgtgtctgtttcataattcagtaactgaatttatttcttataaataaaaccatacaagttaagaaaaatcacatacctatggggtattctgacatttcctgtgtttttgtgtagaggagatctttggttgcatgaagtgtgaatcatgaaatgatagaatttatagtattttctttgaatttcctgagtcctctagatgtcagacaggatgtcagatgtactgccattactgaatagtctcagctgtggggagtggcagggatgtcagctgacagcctgaaatgctttgcattagttttgtaagtacacagattccttacatcacagctgagtataatgtcaaggatgcctcctacttccactagagctgagactagtgtatctgtttgaaggttggatggaggaagagtacaggaaaacctttgtccttcagtgcaatcatttgtattagaaatttgtaaaatatactctaggcgagacattgatttgccttgctctcttgagacactgctttgcatggccatttctctcagtggaatgaaacctctgttcacaagagcacttgtttccacatcccagaggcgcatggttcctaccacttctcaaggatgggaatgcatgtggagagatgaatgatagtaattttcatagttaaatgatcactttatctgtaggaaacaaatagaacccctatgatggacatattagagtagagtatgttcctccctgatattttgttgcttttaaagcacgtcacatctctttatggctccttacgcctctttctctgtttctgtcagttctggggagtgtttctaaagggaggaatctcttgctggaaactaggtatagtgattacccattctcttctgccctcctgagttgttttttttttttttttttttttttttttttttttttttgagacagagtcttgctctgttgcccaggcttggagtgtggtggtgcgatctcagctcactgcaagcactgcctcccaggttcaagctgttctcctgcgttagcctctcaagtagctgggactacaggcatccaccaccactcccagctaactttttttgtatttttagtagagatggagtttcaccatgttaaccaggatggtcttgatctcctgacttcatgatccacctgcctcggcctcctaaagtgctgggattacaggcatgaaccaccacacccggcctaaccctcctgagttttaaaatcaggtggcaaacatttgcatcagtctccaaaatcaaatcttcatgaccttgagtggaaggtataagatagaataggtagtttatatatatacttatatatatataagtagtttatatatatacttatatatataagtagtttatatatatacttatatatatataagtagtttatatatacacatatatatagagagagattatgttttctaatatacatatatgtatatatattttctaatatatgtgtatatatatttttctactatatgtagatatatattttctaatatatctatattagatatattagatatgggatcttgctatattgcccagggtggtcttgaactctgtggctcaagtgatcctcctgccttgacctcccaaagtgctggggttattggcatgagccaccacacctggtctcatgtttccttttaactgagtacttaattcacaccttttcctcttttggctgctactctgataacaagtaggtccccacctttgaagaacattgcatctgaccagactgagagccagggtgaacatgggccccagaccagagcttttggaataacaaggaacagcaaaaaccaatcttccccttcacttagaaagagactgtggatggagggtccaaatctccgctatcaacacatagaaagcctggagctcaatgccaacatggaaaccaaaatttatcaggaatgaaatgtagtatcccttcatatactcaaggttaagatgggttttgagaaatatatatctgaccatctggcttcttctaggagaagtggcctcactccagcacttttaaaagatgtttttcttgctattacatttcccaaagggggattaaatctactaaaagggatctagtgaatccgaataaatcagctgtctcataagaaacattcctggatgatgatttctggttgctgagattattcagcacattatttcagagtggcaaaattgagggcaatctgagaaaatagaattcagtggtggcaatatttgctgacagatttatatgtaggacacacatacaacccccattttttcagtctgtatgtcaagagatcaggacccctcatcaccaaaataaattattttgtgcattacagtgaagaggacaacagagggaaagacgctttcttggagggcaattgaaaggccttttgcgaaggtccatatcactctgaagtggaaggactggagcccagtgccatgtggctttcgttagcttgactgctcctcttctttgggtgcagtgacctcactggaagctgtttcttccacttgttctgctggctacttctcctcctcctcctcttcctcttcctgttggggttagaggtttgagtatttctgtatacattcttgcatggccttgaacttgtttatataatctgagcccttgaatcctccatcctacaatggaagcaggaaaagtttgacttaaactgttccctacaggggcctctggccattcccctaaggcctgggtagtttcagttaatgtgttcatttggcagtatcaatccgtgctcctcatagggatcgctgcagtcatcagccacctgctctgcattgattggagtctaatgggtttttttttttggtcacaaatatgattcagtctttcccttctggctagcgtagaacatggctacaggctggcacttagacctcacagaagaagcagtggcagctcagtttaattaaagacaaagaaatttctgttgattgaaactcgctcactttggggaccttcaaattaagaaaaaaggtctgcttgctgaggaggccgtaatgagagagatggagtgggtgtgcctgtttttatgctgtagccatgcatgcacttgtccattcattcatttgcttgtttcagtaaatattgatcgagcaggtatgatgtggcaagcgtgaaaatacttccacaaagcaagtaactcgagtggagcctctcccacttcagtggtgtttttggcttatactctgtctacggcatttctcaactgtatgtaaatgactcccggtctaggagatttaaaatggtgttgtgtggtattgttccttggttcattcaagttcagtctttaatcttttcagagtagctccaaccatcttttggggctttaccttcctcttgaatcatcaaattcttgaaggtgatgggtgccacctgcttgattccagaaggaccgtctctgatccctggcattgttcattcaggtgactggcaattgaacatccatcccagatttacagttgcgatcctatgggaaagctccctcctcctgccatttcacctttggaactgttgctacactctggaagattttccagtaactacatctaattagaagggtgaataaattaccaaagcaagttaaattaccttgtgtgtcataacaataattaacattcaaataggaaaccactgccatttttataaacatcactaaatggaggcagcaccctttttgaaagcaggaaccaagagagtagcacctccctaagcctgctgtaaggatggcctgggggagttgctaggcgaaatgttgagaacatccgtctggttgagattgatgtcattggagaaattctttaattgctctacttaatatctgaatccttcgaagtagcaacttttctatgtactaatcattatccactctgtcctcatagctctatgtgttttgcttatgtcttccatctttcgagaaggaatggaaattgatctggtcacaagacatttttggactaggctttacttagaaagcaggtcacagcctttttagaccccacctttcaacagttccactccttccttgctcatttaatatacctacctttgttcttttttgctgttcttcttaaacattttctgtcctgaaaatgtttattcttctccatgatgctacttcggtgtggtctcttgattttatgtttgtgcttttttgcttttctatagagtgggattatcaattgcttttatttattcagtaggctgccatgtctagaatttatttagacaattgaaggggtaacttggtgcaactctggcttaaataataatgagttgttaaaggtttttgttttgtcctccttttaaacttataaactcttaaatgatgtttggattgtaagtgatggcatgtaatttaagaagacagcattgaagttgtaaatttgctcataattgagagattgtccctaacatactcctacatgtttctactgaagagaacagtatattagcagagtgtagtaaggtttaaatcacctgatttcttaatattatgaataggtggctcttgtgttttgaaaagatttaaccaagccataaataaaatcatagatctttataccctcaggccaaatataaatcacagtggttcctgtaatatccaaacagcaggcctaaaaacaatttaaagtttcttttccttttcctttgtgtttcaccaatttgggttaaagtctatagtttggggattcagacattatgtttgtatgttatacgtgcattcttttagttcaagagtggctagcctcatgagccgtctaaggggaagagccaatattaccagtgccattaacaaacggccagtataggctggtgtggtggctcacatctgtaatcccaacactttgggaggccgaggtgagcaggttgcttgagctcaggagtttcagaccagcctggacaacatggcaaaaccctgtctctgcaaaaaatacagtaatttgccaggcatgttggcacgcacctgtgggcccagctactcaggaggctgtggtaggagagttgcctgagcccgggaggtcaaggctgcagtgagctgtgatcttgcgccactgcattccagtctgggccacagcaagaccttgtctcaaaacaaacaaaagcctatataagcattaatctcattgcttcgaatatgttttcgtgttgctgagggtcagaccatgtaagtgttttccaatgttttaaagagtcaaatgttacttttttgttacggtatcaattcagttcaaaataatgttttgttttttaatgtttatctctttctgccaagggctctgaagagctaaatatagtccttcttaagagccggacagtggtgaatggatgtaggaatggcctggatccactggtacttatgggtgtagttgaggaaggctaattttgtcagctgacctgattttgggactccacagtttgtttctgagactaagtagcagataaaaaagaattattattttgtggttactggtgagggggtttgggttgaggcctggaggactcaatggaaaggagagtactggaacgaaataaaaaattatcttagtgattttgtgtaacattagcttagagtaaaacacttggtttccattatctttctgcttttgaataaatatctcttctaaaaggaccatggaagatgtggtaacttgagtcagtacaaattgcttttcatagagaatgtatttaagaaaggaaactccttcaagtaaattatgtattttgaaaaaagtttttattctgtgtctgcacagtataatatacttggaattcatggctactttacacatgtttcatttacaatgtatttgaaagccctccttaatgaataatgataattaggtgattgacatattctcccacttgacaatcacacatgccagtaaattaccctctattttcctggagtgtcggcaataaatgtttaaaactttcccctagcaaatgtcattcagcaaaatcctaacagattagaagatactctgtttccccaaattgagtgaatgaccaccctgtgaatggccctgtcttcctcgatagttcacagactacttccagatctgtgatggaaagtatagttcaaacttaagaagttagatttgaatatttaaagtgttttaatcctcaggtggtagagggattttcaagtctggagtacttctgtactgtaaaggttatgcataggaaaaaataacctttttgtttaataagcagacagttattactccagatctcaaagaacaaagcatttattttacctgaattgtaaacctctcccagtggtgctttttgttttatctcctatcagttggataatactaagtttattataataaggtatgtaaaaatcatcttgaagcctgactctaatttttggtgcaatataaagggatatttaccatgttacaaaatacgatgacacaatattttctactcaaatacgattttgtaaataaatgaatgtttgtctgtatcaccagtgcgttttctacatagggcacaggcgcagttactccttgagctatacttagtttttcccccaataatttctgaactttgaggtgtattgtataaatgataaaatgtgtatatttaaggatataatttgatgatatttgagtatagataaatgcatattcatgtaacccacactctcattaatacctaaaagattttcatgaccttagaaagtattgtaatattttagatatttctaaaagcagcagagattcatcgactggtgatcagagcaaacgttatttcagtttatcaggtgcttaccagatgaaagtgtgaagaagaaaggcagatatattataactaataattagtaattgttgagactccactctcctggaatagatccactgttaagaaacaaatgtagtcatgcagcggtgtgtacctgtaattccagcattttgggaggccaaggcgggagggtcacctgaactcaggagtttgagaccagcctggccaacatagtgaaaccccatctctactaaaaatacaaaaattagtcaggcgtggtggcatgtgcctgtagtcccagctactcaagaggctgaggtaggagaatttcttgagcctgggaggcagaggctgcagtgggctttaattgtgccactgcactccaacctgggcgacagggccagacctggtcttaaaaacaaacaacaaacaagaaaaccaaacaaatgttgtcatggcagcataatgatgttttggttaaggatggactgtgtatacaatgctggtcccataatattataatagagcggggaactttctaccacctgtcataactccacagacaacacattactcgtgtttgtggtgaacctggtattaaaaaccctacggtactgccagttctatcaaagtgtagcacatgtaattctgtgccatatataatacttgatagtgataagaaatgactgtgttgctcgtttatatatttactatattatacttttatccttagagcacactccttctacttattaaaaaaaataaagttggccagatgcagtggctcatgcctgtagtcccagccctttgggagcctgaggtagaaggattgcttgacataaggagtttgagaccaatctgagtagcataatgagaccctgtgtctgcaaaaataaaaataaaaaatagtcaggtgtggtgacacgcacctgtagtcctgggtactcaggaggccgaggtgggaggatagcttgagcccaggagtttgaggtttatgtgagctatgatcccgctactgcacttcagccagggcaggaaagcaagaccctgtctcagaaaaaaaaagcattaaaaaattaactgtaaacagcctcaggtagttcctttaggaggtattccagagaaggcattgttatcataagagctgacagctccatgcctttattgaccctgaatactttccagtgagatctgatatggaggtggaagacagtgctattcatgaccccgaccctgtgtaggcatagactaatgtgtgtgtttgtgtcgtcgtttttaacaaaaagtttaaaaagtaaaaaaaatttaaaaatagttcaaagcttatagaataaggttataaaaaaggaaatgttttcatacagctgaacaatgtgttagtgttttaaggtaagtattattacaagagtcaaaaggttaaaaaaagtttataaagtaaaaagttacagtaagctaagcttaatttattactgaagaaagaaaaagatttttaataaatgtagtgtagcctaagtgtacagcgttgataaagtctagagtagaatacagtgagtgttctaggcctgtgtagcctaagtgtgtagtgttgataaagtctacagtagagtacagtgagtgttctaggccggtgtagcctaagtgtgtagtgttgatgaagtctacagtagagtacagtgagtgttctaggcctgtgtagcctaagcgtacagtgtggatagtctgcagtagagaacagtgagtgttctaggcctgtgtagcctaagtgtgtagtgttgataaagtctacagtagagtacagtgagtgttctaggcctgtgtagcctaagtgtgcggtgttgataaagtctacagtagagtacagtgagtgttctaggcctgtgtagcctaagcgtacagtgttgataaagtctacagtagagtacagtgagtgttctaggcctgtgtagcataagtgtgtagtgttgataaagtctacagtacagtacagtgagtgttctaggcctgtgtagcctaagtgtgtagtgttgataaagtctacagtagagtacagtgagtgttctaggcctgtgtagcctaagtgtacagtgttgataaagtctacagtagagtacagtgagtgttctaggcctgtgtagcctaagcgtacagtgtggatagtctgcagtagagaacagtgagtgttctaggcctgtgtagcctaagtgtgtagtgttgataaagtctacagtagagtacagtgagtgttctaggcctgtgtagcctaagtgtgtagtgttgataaagtctacagtagagtacagtgagtgttctaggcctgtgtagcctaagtgtgcagtgttgataaagtctacagtagagaacagtgagtgttctaggcctgtgtagcctaagcatacagtgtggatagtctgcagtagagaacagtgagtgttctaggcctgtgtagcctaagtgtgtagtgttgataaagtctacagtacagtgagtgttctaggcctgtgtagcctaagtgtgcagtgttgataaagtctacagtagagtacagtgagtgttctaggcctgtgtagcctaagcgtacagtgtggatagtctgcagtagagaacagtgagtgttctaggcctgtgtagcctaagtgtgtggtgttgataaagtctacagtagagaacagtgagtgttctaggcctgtgtagcctaagcgtgcagtgtggatagtctacagtagagtacagtgagtgttctaggccttcacattcacctgccactcgctcattcacggagagcaacttgtagtcctgcaagctccattcatggtcagtgctctacataggtataccatttttatctttcataactttcttttccttcatgagataaagtcatagtctgtcacccaggatggaatgcagtgatgtgatcttggctcactgtagcctcgaactcctgggctcaagcaattctcttgcctcagcctgctgagtagctatgattacagatgtttgccaacatgctgggttaattttttaagtttttctagagttgaggtcttgctatgttgcccagtctggtctcaaactcccggcctcaagcaattcccccaccttggcctcccaaagcattggaatcataggcatgagccaccatgcccaaccttatactgtatttttattgtacctcttctatgtttagataagtgtagatacataaatacctaccattgtattacaactgcctatagtattcagtacaagaacatactgtacaggtttgtagcctaggagcaataggcaatatcatgtagcccaggtgtgtagtagactgtctcatctaggtttgcgttagtgtgtctatgatgttgacacaaggacaaaatcacctaacaatgaatttcttggcaggtgtctctgttaagaagacatgactccagtactctcaggtgtaagctcttttccagtgatgacaccggcactccctacccccatccctctggaaaaagaatgatctaaaatgttatgatttaaagcaaaaggatatgcaaaggtgaatcagagaaattcaaagaaaggagggattatattaatgtcatataaaaataatttaagataaaaaacaattgataggataaacttgatatcttttataaaagaaatatacctttttttcagttatctttgaaacgtttaccaaaatcaattcttgattgtacacagacagcattggttctacctcacccaatgcgtgggagcacagaaactctattagaccaaagtagaaatcaaaaccacttagaaaactagaatagagaaccataacatgtactgaaagaaacaaagtatactcagaaattgataatctgaaagtagtaatttgtagactatgaaaccatagaaaataatcttctggtttaaaaaaaattagagggttgtttgaaaaataacatgaattttgcatataaaaaaactgaaaggttttgcaaaatacagtatttagcggtcacaaacagtgcaggaaaataagaagtctacgagctttaagaaatgtagaagattacttggaaagacatagtatgtttgtagatgataagactgagcattataacgtgtcagtctttctcgactacgtttcttgaaagcagttttccaggtaattttttagtgttcatttggaagaatgaaaggtaaatagtgaaatgccatttgacaaaaatgaacaagaaatgttaatgcccaaatcttagggagagtttaagacaggcagtcttgtattactaccgtttttgtgtaaattgatttatattttgagacaagcaaatttagaaatatttatcgagtcaaaaattactcatagtagaattcctaagtaggccaataaaaaaagaaaaattaaaattaagaaaaaattattcatagcaatccttgtttggtgaaagcagtaattatacttttttttaatagcaaaaaaaaaaaaaagtaatgagtgtgggagtggttaaatgaattataaataaatgtaaagggaagctacatgcaaccatgaggcatatttagtaatatggaaactaaccatgctgcagtattagttggattatatttcatacataatatatatcacactattctgatatttttaattgagcatatttctaggagggggagaaaatcattgtgttaaattcttcattttaggttaatgaaaaatatattatttaattattgtttttgatagtgaggaaataacacccaaattattttttcttaagttgtactatgtcacattctcttttttccttattctgtgttttctgtattttctataatgatcaaaaaccaagaacgatgcagactcagaattaaactgtaacacattctagttttgttatcaaaacttgaaaatcaaaaatatttccataatctgtgaaaaatgagtttataggtacattttagactgaagatttcttgctgtatcttttttttttttttggcagagtcttgctctgttgcctaggctggagtgcagtggcacaatcttggctctctgcaaccttcacctcctgggttcaagcgattctcctgcctcagcttctcgggtagctggggttataggcttgtgccacaatgccctgctaatttttgtagttttagtagacatggggtttcaccgtgttggccaggctggtctcaaactcctgacctaaggtgatccgcctgccttggccgaatgctgggattacaggcccgagccaccgcacccggccttgctgtatctttagagctggaactcaaacttgagactcccagtgctatccattgttattctgcctggaagtatcttttttcacctgtgatctgggacaagcaagagcatttgtcccaagaagagcaaacaggacttctgtttgctactccaggaacattattttgtttcttagatagtccagctttttaagctttgcccttttcacatatattgttagaggtttttttttttttttttttttttgaaagaaagtcttttgccctgtaactgactttgaccaattttccttctctatatttgttaaattaactttggcgtttttcatcttggcttactaatttctgactacctcttccatcctatctattcgttgcagtgtggaagataaacgtgagcttacccgtgactcctgggccttggcatctgtcttttgcagactgcctggattgctatccaatgtattagtctgtcaaggtttaaatttggtgtaggtgggagggatgtagggacggacacacaagcttttagaaaagccaggctctctaaggaattcaagtgaagcagagacttcttttcatattaaagcaatgtaaaatgacagaaagaattataggtataaaattgtgtattacaaatgggaaatttaattggaccagagtacatagcaggtgatattgaaccccctaccctgaaagagcctttgtttttcaagtatgggatagaactggaacacaggggcctttgtacatggacactgtataggcatcatttgttttactaaacactcctttctaaagacggcaaaagcatattggcagcaaggtagacttgtcagaacaatatacatgacttttagacccaagcaggtggactgcttgacatgattcctccgggtgcaacgaatttttgtgtgtgggcagaaaggaatgagtcttaatacttctcagcaatatactgtggtttattttcctctcacaaagaaaaagaatcatttcaaagaaataacaattataaagtacagcagcttgtaaacgttctccattctttttaattcccaggaatgtgtgatggggcaggagatttggtccctgtggagtgtctgtatagccaaaggttcttcacagattttggttctgcctcctttgcaaaagtagaagaatgcctttcctatgttgttaaaaagatatttaaaaattaatattttgcacagtgcttttcattatggggccatttttgtcttaacatggaggcaaaaaacctgtgacttcctccctgaagttccttctacccttacatggctgaatctgggagaggttcgtgcatttttcccatccttatggaagtacacaagtaattacatgaacgtgctacctgtgcatacttttattggcttttgaaacattttatagcttttctatgtgtcacatgccatgatatgtatattacattgattatttaatatttactacatatccacgaggtttactcttaagatattttggctcagagagataattttgtcaaggtctcatagtgactaagttgcaggacagacccaagcagtctggtttcatagcacagcttcctaaccaccgcactgttttgcgttttgtctgtttaaaggagtatgcatagagaagaatattggagtaccttgcttaaaaatgaccaaaggacagataaccctaaatataaaagagcaaaggagttgaatagacctttctccaaagaagatatacaaatggccgacaagcacgtgaaaagatgctcctcatcatcagttattaaggaaatgcaaatcaaaaccacaatgaggctgggcgtggtggctcacgcctgtaatcccagcactttgggaggccaaggtgggaagatcacctgaggtcaggagtttgagaccagcctggccaacgtggagaaaccctgtctctcctaaaaatacaaaaattagccaggcctggtggggtgtgcctataatcccagctactcgggaggtcgaggcaggagaatcgcttgaacccgggaggcagaggttgccgtgagctgagatcatgccactgcactccagcctgggccacagagcgagactccgtcttcaaaaaaaaaaaaaaagaaaaaaaaaccgtaatgaggtgccacttcacatttactattaaatgtaatagaatgaaatgtagtaggatggccgtgatcagtaaaatggaaaatagtaaggatgtgaagaaactggaaccctgtacattgctgataggaatgtacagtgtggtagccactgtggaatccacttccttaaaaagttgatgtatgacccaggaattccactgccatatacacacacaaaagaatggaaaactgatacttaatttcacatacatatattataaatagtattagtatttacaatagtgaaaaggtagcaacagccaaaatgctcgttgttagttgaatgaatacaccaattgtgatctatccatacaatcgagtatcattcagccatcaaatgaatgaagtacccatacatgctccagcacgggtgaacccggaatacattatgcttaatgaagggagccagacacaagacgccacatgctctgtgattccgtttgtatgaaatgttcaaagtagatgaatccatagagacggagtgcagattgatggtcgctagggcttgtgggaaggggcacccgagagcagctgccttcagtgggtatcgagttttcctctgtagtgatacaaatgttttggagctggataggttggtggtcgtttatcattgtgaatgcactcaatgttactgaattgttcttaaaatagttaattttatgtttcacctcaagaaaaaacaataatgactaagttatcccgcggcccctagctctcaggtattacagtcagttgcagcttttatggagcacatatttgcatgttattgggccaatagcaagttaaacaaacactgtgataggcaaacattatcttgagcactttacatgtgtggacaagcacaatgactgacgtggttcccagactccagccgagactccaggaaccaacagcctttaagaattaacaggggaacagacaaaatatgaaggctgtatgttgatttagcagacactcagcaaataaagggcttacattttggtgacgccaacagctaaaatgctttttcacacagtgagtagggtgttaccagacttacatgtgtgctcaggcagcatgatcttatcctcctcctaatcagggtaggtttcagtcatgcatgctggagcaaatgattccggtgagagaatctgaaagaaccctatacaaacatgtacctttttttctttaggactgtgaagggaacgtggcagtgtgtggcctggtgcagcctgtgcccagagggtttttcacgttcagtatagacctttgatgttctcaggttattttccaagttgcccagaagcatgacacatacactgcactaaatccttgaggagttgcaagaaaacagatagtgcttttcttcttcttttttttttaaaaaagggaggggaacctagtccacagtgcagcaaagcagtttgtctggtgtaggtaatgggggtgtgggtcaccgaggatgacccttgttgacctacattcctgatctctcccattcagatgtgcacatgtagatccatttacttctagacagccctcttaggttactgaaattattgattcagcattgtctgcattgccagggcctcctctcaccctaatgtagagtgggaagtggacatttttacttaaaaatgtgtgaatttttcttacccaaatattactttattgtctcattgtaaaaatttcatatatctatataacagatatatatatctgtaagtaactttaataatcagacaagccaccttctccactccccgacctttattcacttttaccatttgcatctaagctcaccttaaaaacctgtgactggtacatggtggcctcttcagctgcacacaatcttgcctgggagttttcctggcctgaggctataaggtggaagattgtttcgacgacttttaacccttcacctctcctcacccctgaaagcatcagcaaacctccctctttctgtcccgaaatccccaaaggcaaggatgtcttttcctgttttctagagctcactcttttattatttgatggacctcactctactagttatctagtctcaattattttcaccttttttagcctttaaatgtgcctgtcttcctcttaggaaggaagaaagcgagggaggggaaaaaaagaagtaatgcctttgctccacctcttcctctacttatctttgaatcatctctcctttcacaattacaactgaaattatttacatttttagtcttcactttcttacttcttgtcacctccgctgtagtctggcgttcaggtccttaactcaattgaaactgctgtagttgcgatgagcagcaatctccatgttgctcaatcctccggatactctaacttcatgtgtcctgtggaccgctccctttcgggaacgcttttccctgggcttcggtgacaccatactctcctagttttcttcctgcactactgtcttcccagtcggtggggttctttcgccaccttgtttgttctctgcacactgtctgtgggttaccttactgattcctgtagcttcattcaccgtctctgtgtggctgactcccaaagttagcttgtgttttagttacctttgtatacttccagcagccaacatgggacctgttgcacaacagtagcctatgttaagtaaatgaacggactgataaatagatgttttccatgattgatactcttcccaaaatctttcattattaccatttgtcacccatcacaagaacataaactccatgagagcagagacgttatcagtcttgttcaggactgtgtgcctggcacgtggcacacgtatccagtatgagcaaaaaacaagtggctcacccaaaatgatcctggcaccaggaagtttctctttgggcctggcttccttggttactcacatgcccccgtccatgtgttgtaggaagaggaaagatgtaagcattaaggatttggctcactggggctggtcctggtggtttggaaatagcagatctctaaggcattccatcacctcatgagagaagtcttatttatttatttatttatctatttatttatttatttcttgagacggagtctcgctctgtcgcccaggctggagtgcagtggcatgatcgcagctcactgcaacctccgcctcccgggttcaagtgattctcctgcctcagcctcctgagtagctgggacaggcacccgccaccacgcccagctaatttttttgtatttttagtagagacagggtttcaccatattggccagtctggtctggaactcctgacctcaggcaatctgcctgccttggcctcccaagaagccttatttttatatagctcgttttctctcacctgggatcccaggtcaaccccttttcaagttgggagaaaccagctaaacattttgtgttttaatttaaattttgtggtctgagttgactcttgctagggtgggggtagaggaggaaacccagcagagaacttgaactaagtcaaaatggcaccttccctcctgaatattccttttattaagatgtctgcagatctccgagcattaggtcttccattcttggagattctgactttcctctgtcattatttctctgcggaaggttctaacatttggccagttgtgatttctctgagccctttgcaacactgcagggagcacactcagttgtatgcagtggggctgatagcatccaggtctcagaagcactttccttccatatcattgccgatttcctgtttcttttttaattgcacttgttccttttataaagtgacagtagctaaatttatttctcaagatgcttacatgctcttttaaagagtatctaaattaataaacattgagtacagaaacctaatctgaatttgtgtttttattgagagcactctcattaaacacaggctggaaaaaaaaagaatcaaccagaccctgatgcctcttgcaaaatctgatctgttccaagtctagcaggtagagtcctgattgcctttatttgcaagttcagaagaatgcaggtaggtgaagattagaatggcctcgtagtgaatatgtataagcctataaaattaaagtagaacttggttaaagagcaatacaatctcttgctatttcatgaatgcttagcagtgttataaagacgtgaacatattgctgtgtttcagtgagctacagccttaccctttgatatgcttaattattttcaaggtcatttctttttataaaatcaaggcaagctggaaaatgtcaaacagcctacaagtatagaataaactattttcattgtcattttatagtcatatatagttgtggttttgagtttcccagttacaaccagtcactgagtgtaagagtcacaataaattctcttaggaacatggtatcctttatctcttcaaccattaatgttccaaggatattttcaaatgaaagaatgataaaaattagttgatgcgttctgggaatatgcacatttaaaatttcaagttaacaatacagatgaaggtggttaaatgtgcaagagctagctacaataagagaaatgtagttgaggctactgctgaagggattatgtacttagcctctaagccacttaggatatatattaagttggttgtgctctaccattttggctgaagataattttcccttacataaagcaaatatttagtaacaagtgaggtaagtctgagttgttcattatgcaggttatatggtacggttgaaatcctgaccataccactagtctctgtacctctgagtaaccctcacattgtattgtacttaaaggtttgaggtgattcttaagtaggcattgtaactgagaaatataagtttcagatttttgctgccaccagctgttaggaagtgctggttattttgtaatgatgcctgaaaaccatggactcctcagcattgtgaaatttggatttaggggtaacacaaacaaaaattccagattcttgaggagataagaattttaaatgattcaagaacatgcacaccaattctattagtttaaaaataattaatatgccttacgtggcagtagagttcagatcagttggctgcaatcttcagaaatatttatttatatggtgtcaacttaggttgtctctgagacacattccaattgatacttctgcctgcctctgacagacttcttttcccagaaacaccctccacatatgcttattcctgttagcttaacctagttctagaatgttcttttagggtaattgaggtaagactctcttttcacttagccaacttggagttgttggcatttcaattagtggtcattgcgggatagcattacttcactcattctcactttagatacattgctcccaccgacttatgttgtatagtagtccttctctgatagattcaccaagaaactactgttgcttagccggccaggtacacgtccacacgctttgacctcacttactgaacccacagctctgccacgctgtcctcttctgttcctgaaactctccaagcttgcacccaggctgttatctttgtaatattttttttaccctcttgcaaccaacacacatgcactattgcctggcaaactcctacttctaggagtttttggcttgaagcctgctattggcttaactagagaagagtcatatgaaggtctggagagaggccagataagtcagagctgtgcattcaaagaaaaatcaggacttgggaagacatgttcctgcctgtcatttgaaatatactgtcattggccagacctgtatttgattctctttttacattttagaagaacaatacttttaagccatacatttgataagaatgatcaaaccaccactttgttgcaggtttactgctaggctctgtgggtacatctattcgcggagaaagaaaagtaaattaataattacaatagagcatgatataccaaggtggaggcatagacgggggctggggaacatgaaggagaccatcgaaatcaaaggtggaggccagagaaggcttcctggagaaacgaggcctgaattgctttctgaagaactggtaaaagataatctgatgaaaacgggttcagcctggaagagaggatgcctgaaatggagggaacagcctgtgtaaagatggaaacaatctaacagcttagcacacagagaaaactgtaagtcactcagtcctcagtgagtttgaagtgcacgctgaaagctgtagggccccggagaagaagcctcttgggaaaataggcctttacaaccacagcaaagacagtctgtcatgcttggcggcatgcaggtgagctgtgccaggtgtgccaggcaggctgcatgttcatttgtagaggactctgcaaatgaggcgcagggtggagcggggtggtgctgccagtgaacaaagagaatgaggcttacctagagcaatcgctggaacacctgtcttgtctgatggcatcgtctcgcttgtctgatggcgttgtctcacagtcccagcctgcatgttggtaatgttcagggcgagaggagtaagcaaacagccccagcttctgtctgctgctgctctggagaatatcagagttgctctgccaggtcccacaggttcttttacattcaccatctctatttaatcttcccagatttgaaaataatggtttatcctggatgtgatctgaaagtatttccccaatgcttacccacaggagtcacccacagaatcctcactcactgctgtcccccatgtgagagcttgctatagctctgtgtcaggaatttgggaacagtgttgctggtaatgtggaaatcatgagagacgtcatgtggggttagacagcagccaccttcatagctccctgcctttctcacttctcctagacctcttgattctctgattcctcgggaaactcaattacctttccttgattatgcagagcaatttaactctcaaacatccttcggctctgggcccacctttgcacattcagaagctcattaatgtttcagcaccgaggaactggcaggagctttgacatttcagtgttgtcttttctccctccccaggtatctcagagtgagaaggagcagtatagagatctgctttcccactaatatgaattttcaccccaaacctcagcatcagatgaagatagtcattttcagttttaatatttttttcttctatgcatattaggtaggcaaagaaagacatagagttctctctatctagaactttgaaataaatgaaaatattagaacaaataaacacttcctataaatgtgagtgaataggacagtaggtaataaccggaatggatttggaagaatggattctgtcagctcatactcagaggcatattgttaaagcagggatatgaagacagcagcagagtacaggggttacaggcatgaatttaggagtcagatcaagctgggttataattgtgtctcctctcattcctaatctgtgaatttagctgagtcaacttaacctactgagtttacttcattatttgtaaaataaaggtaatatcaccaggtaaagtggtgcactcctgtaatcccagctcctcaggaggctgaggcaggaagatctcttgggcctagtagttgaagaccagcctgggcagcatagcaagaccacatctgggaggtggtgtggagaaaaaaaaaagtactccccccactccaggacctggcgagccctcagtaccggtggctcccatttcactcacagtcttcctgggctgtgcttccgtcgtgttccctgcactcctacaccctggtcttctgttttacaagctggacctattatcccacaagggacttcgcacttgccatggccctgcctaggatgcttcagcagacatggcttatcacaggccagtgcccattcttgctttcttcctgctaacagagtttcaatttttttttttttcggggctacaaaaggcccattcatgccagttaaaagcaagaaacttccttagctttactgtatctgtgggacagtttagagcagatgtaagtgaacacttatgggcagggcttctggggaaggtactatttgcggataggaagggactgactaggctggctagacacaccctgcccttcagccttccccattcttcatcactggaaggctgagttactgctcagtagtagagcagcccccggtgagctacacaccaggaggggcaaagaaaaaggtataaggagcttggctccctaatggcattgtgggaatccagtgagaaaagggaccctttctgtgggtaaatcattttatttggtattctgttgaaagcagtgaatttaactccggctattacacgtgctttccccccagcactttagaaaaaccttttttaatggttggcgctctcattcttcaggactccattgaatgtgactgcctcaaagatgccttccttggtcattccctctaaagtagctcttcttccacacgctcgtggtgtattctgttttattgtcgccacatcatgaacattatctgaaaatatcttctcatttatttacttctcggtactgcatatctcacgctgggtagaattaagctccattggaataaggacctggtgtatcttgttcattgctctatctgtactgagaactatgctgatgtaaagcaggtgctcagtaaatgtttcttaaatgcatacaaaacgtgttatctagattaaagagcaactttttacatttaatcagtagtttgtcaaggagaggaaaattaaggtggaattcatggtgttggagtgattatatccctttatatttatatattctggtttgtctgtatatttatgtgtaaatataattcacatcaataaattgagcacgtattatgtgctaggaattctaagcaccttctaccttttcatatttttcaatcaatagttttataaaaaagagtaaatataaaaaggtatgctttactctacggggtagttctcaaaaaaacaaagccaatttcctcttttaatcattgcgtatttatttatttatctgaaagtgtttcttcaaagtgaaagttgaaatgtgtagtaaactttcaaatagaactgcattttgtctcagtagaaaattctccatcacatatatctcaatgactttgtgtcaaaacctactattttacctgtcaagatgatcttcttcccttactgtgcatttcagaggatggaagtacatagaatgaaattttagtgtcagatacatcaattacaaaccaacggagctgtttcattttgcaccaatgatggagaaagagagtcaggggaagaatgagtctatttttaccttaaagtagcagcattcaggataagatgtcttcacttagaaatcagtcataccctcgactgtggatcagtgcaggctttaataattcattctgaaacctgtgcttccccagctagtgctccctggctctttacttatttaaaggtctgtttacctctcagtttgcacctgcaactgtccattcaatctgctgtgcataaccagtggggaataagcccattaattagaataatttaagcatctcagcttcctgcaatcttcaacctagtggggtctcactggcaacatacttctttatgaagctcatctctcatctgaaccacaggtctagatccttaatgcagtgatcagaagcttgcgattctgtggcacttgaaaatttggaagccccataatatatggtctggtttgcagattctcaacgcagttccactagggattgacacacccatgctagtctcttgtgtaattaaccacaacaacagattgtagcagaatataaaagaaggaagctgacctatgggggggaaaaaagacaaagcttattgttgtggcaaggagggacttcattcttttaggacaggctatccaggtgacctgataatggatatagaggaattccagtattgaattaggccttttgcatctgacaaaggacaggattaaaaggaataacttgggagggaatgtctgttggcatctgtttgcttgatgatccacccatgatgcctgaccggatgagagcctgtctttgggaagctcatgagtttataagaaacagaattgctgctgtttcttaaactaggcagtgttctggtgaagaacgtgggctctgggacaagagggccatttgctggttgttttctcttgtcgagttaattatcgctctgcctcagtgttctcatctataaactgtgagtagccagacctccctgaaggacacttgctggcaaggccaaaacacaagctacaaacagaggccaagcagtggaggcagggggcgccccgaagggacaggtgacaggcagtgatgccaagggcagctcttgtcctcgtcccagacttcgctactcattggctttggtgatgtaagcgctaagtaaaaagctactgctgttccaaacagatgtgaggcgaaggtttaagctttgcggtctgcgtatgaccttttcatctttgccctcgtacctcctagcatccctttctttgtgaatggtgcctacgttggattgtttatccaaaccagacacctgagtcattctagggtcctttgtgtcacccacctccatgattcagcaaatcactaaatacggtttgttcgacctttttacctgtgatttcctttttagtgtaggtaattcctcatcagccttcaaattcagctcaaatatgacctcttaagggaaagcattctgtgactctccctttcgtagtctgattaaggtgcccgttttctttgctccccaaaacaccttgtagatattttaggaaacacagcatttcttgcaaatgttaatttagtttcctccactagactcttaagctcctgtgggcagagactgagtcctatttggttttatatccctaatggttggcatagtgcctcacaaataacaggcttttaatgtttattgaaggaaccaaagaaagtaggtttctgtgagttcaccttggatcataaccatgatatagaacttatttttatggggaaaatatgttcttaccttcccaataactcagagttataagctttagagtattagcagatgtcattctaaaagttcctttctttagaatctaaattatttaaaaaacttaattttgtgtgcaggtaaattgcttgtctctgccctcatcaacatcccaggggcaggatttaaaaaaatcttcacgttgttgttttattttgtttcacttttttcttgcccatttctgatacaaaaatgggacaaagagctttctgatggaaagttattattagctccatttactagaaatgattcataggcccaaggaagtctttttgcatgtagtaaacacatagtaaccaaattaggtatgtgagccaaaggttaagagccaaagtcaaacttccagaccttaacattaattgaaaaaaaaaaattctgtccttcgaactctgtagctcaagataaatgtgattcttagaggtcgatatatttttttttttttgaagacatagtctcgctctgtcacccaggctggagtacagtggcacaatcttggctcattgcaacctcagcctctgagattcaagcgattctcctgcctcagcctctgagtagccaggactacaggtgcgtgccaccacactaggctatttttttttattttttatttttagtagagatgggattttcccatattggccaggctggtctcgaactcctgacctcaagtgatccacctgcctcggcctcccaaagtgccgggattacaggcacgagcccctgtacctggcgagatgtgtagttcttggtgctaactatgagcatctttagggcatgaagcagatcttcacttctgtattgccagcatttagtacaataagtgtttggtgaaagatgaaccaataagtgaatgattgtatttccttttcagctttcatgagaaattatgtgatgatcagactgtttggtttgataaccttttattgtaaaggtagtttttgattattatagagcagcactggttgatgggcttgaaattttatatttttctttaatcagcatatctacaaacaatcagtggagtattccttttgggttgccattttgaaacaagaaacgtatggaaataagggacgaacattatctgctttctcttggctgtgtcctgaaagaattggaatttgctgtggagcaaaagctaaagattaagcaatatttttttctttttaaagtaataccagtataattgctggaattattagtaatagtattactattattcattattaaatttctcattttatttcaatctctccatcaggaatgacttgtgtagagtaagggagtttgggagggaagaaagctaattcataaattcatttttcttgtttaatatactgtttgttttgggccaggcacggtggctcatgcctgtaatcccagcactttgggaggccgaggcgggcagatcacaaggtcaggagctcgagaccatcctggctaacacggtgaaaccctgtctctactaaaaatacaaaaaattagccaggcgtggtggtaggcgcctgtagtcccagcttcttatgaagctgaggcaggagaatcacatgaacccgggaggcggagcttagagtgagccaaaattgcaccagtgcactccagcctgggcgacagagtgagactccatctcaaaaaaaaaacaaaaaacaaaaaacaaaacaaaaaaaaaacattgtttgttttgatggtaacttcatgtatttcatacattgtcattgtaacacattaactaagtgtggggaacaatgaacaataaaccaagagctgtttctctgttgtgatacttcttgttgccaaatttgtgggctttcatagttcaggaaatcttcctgcacaactgctttgaaaattactaaatgttaattactattctactgtttttaaaggaaagcagaaaacactgcatctgaaagtctattaaaagaaactaggagggctattggtttcaatttctaatagctttatagtgtgtcctgggcatccttctgtgccgtgagcgggggtcaaattctgaagacttaagccctgaagcactttgccggtataaacagatctctcactggggcagattacttacctggagctgtatggagcaggatcagctagaacattacaccttttatatcttactttgccaaaggtatcattcacttagtaagagaaatgttaactttttccatagttagtagcgatagaagcagagcggatggcacaatgaagccatcggagcctttaaggcccttattatttccattgattcgttcagtgaatgtaggctgcgtgcaataccacatgagtggatatagccaaagctatgccagattgattgatggattgcctttagtaaacttgcagtgtaatgaggccacagtaatgtagaagagggagtgactcatgtatggggcagtaagcagaaaggattaaagtcttctgcactttgcatttaagaggtcattagaacccacccaaagcaagggtagatttagtgcctaatgatgtcacagtacatattatgagaggttggaaatttggggaaatggagatgatagcaagtataaagggttttttttctagcaacctggctattaagggataaataaagtgttgtagctagaggtgaatgaggttaaaggtgggattgtttaaaatagaagacttaggccaggagtggtggctcacacttgtaatcccaggctttgggaggccaaggcaggaggattgcttgaggctaggagtttgagaccagcttgggaaacatattgataccctgtctgtattaaaaaacaaacaaaacaaaacaaaaaagtaattagccaggcatggtggcgcagcttctggggaggctaaggcaagaggatttgttgaacccaggagttcaaggctgtagtgagctatgatcataccactgcactccagcctgggtgacagagtgaaaccctgaaaagcaatcggccaatcaaaatataaataaaatatatttccctccctccctccccctctccctccctccctccctccttccctatctccagcagggttttaggctgaggggaagtgatgagtgggaagtaaatgagactgaagataaggaagtccaggttatgactgtaggagacagagaggatgtggaacacaggagaatggatggtctgtgtaggaggactgttcctctcaaaagtggggagagtttaaaggagaaggataatgctgtttatgggggttgggtaggaagttggtagcagggctgtggcttctgttttctttgtgaatttggaagcaagatcatctgagggagacgcacacacgcagaggcttggtgcttgagtagacagttggaaatttgagagaacttctgcaccatgtgatacggttctgggccccatgcagctacaagagaaaattggacatcagatatgttgaggaaacactccccagaatttgttgcatgatttcctccatcaaagcttagcagcctagtgttataaaacataaaaattgctaacatttattgagtgcttactttgtgccaggcaccttactgtgtagtaacacagtcctcaaaacagtgtgaaatagctcctatcattacctatttttaccatccccattttgcagatgtggctgagaaaggttaaatctgggtgacaggatgagactctgtctttgaaaacaacaacaaaaatacgtaatgttaattccaggttaatttatttctataaggacacactcacgtagtgtagcctgatcagcaaaatgaaatttgctttcattcaaaagcctttattgaggaagtatatctaatcgaatgaaattgtttgtctgctctttagaatgaaattacatgcaattaaatgagaaaaatcttcactcagtgcgtaaaacatagcaagtgtatggagaatattggttcccttgccttcctctgcacttgctctgagtgagcagctagactgaggtggcattagtttcaaggcacataactcttgctttaccaacttataattgctcaggatgaaaatagcaacaacatggtacttccatgctcggtcttcacatagccaatgacaagctcctccaagtcagttctgagtgtccttgtggctgatctgtggactacacccttgtccccaggatgtgttaacaaacactctcttccctccacttctctacatcgtcatccctgctctccagacgccaggtgtcccaggctgccttttctctcctctggatgtgggctgcctgccgggagcctctcttattttgtcacccaggcactttcatgtttgttttctgctccagcagccactgggctgaacccttcacttccagggagcttgttttgtttcacagactccagaggaagtagttcctccttgagctcccagaaacagcgttctcagtgaagtagtttttcatttattgttgttttggcccccacatcccacagtgctgacctctgactcaggggttggagttgtccacttgaaatttccttcttctatttctccattttcttttgaccaagtctgtaagcatttgcttcttcccattactttctccagaagatctcggctcctgccacaggaaggtcactggaaagcaggcctagtagaatgccagacaggcctacatacgcctgaatccttgggaatgcacagctaggctctgaaaatacctctgtatggtattgaatctacttctggggttgaaacgggccttaaagatacttgggtagttaaagaaaattatttgctcatctaatcaagtgatgtttgaatctgtctgctggtggagtgaggactgtggaggaaggatcgacaaatatttattgagtagatgctgaatgtgacactataggctaggtccttttcaaagagttttttattttttctttgttccagtagtctttcaacataggtttgttatcctcatttcacagatgggaaaactgaaggtcaaagaaattaaagttacttggttcattgcactaagtagcagagccaggattttaaacaccttggccatgaaccccatactttttgtaccatatcaaaaaaaaagggagttagattcattatctaacaggaagtccatctatcctgcttgtagaaggacaaaatgatattgaaagtagggggctgtggggctattttttcccctcaaggaatttttttttttttttttgagacagagtcttactctgttacccaggctggagtgcagtggcacggtcttggctcactgcaacctctgtcccctgaattcaagcaattctcctgactcagccttctgagtagctgggattacaggtgcccgccaccgcgcctggctaatttttggatttttagtagagacagggtttcaccatcttggccaggctggtcttgaactcctgacctcgtgatccacccgcctcgacctcccaaagtgctgggattacaggcgtgagccactgcgcccagccaaggaatattttatgagtaataacttctctagagtatcatttcaacctggagccagccatctgaacaagccttcctccatctcttttaggatggtaagctggggcatgatgtttaagacttcttggctctttggcagggctctggaggggaagtgagtaagccattgggatgtcactgtggtaatgtggacagggttttctggttttgtctccttccctgtggcctttttccatgtccccccaacccctggacttccacggctgggccagacatttcccttcttagacaaatagactcgcttcatcccctccatagctgcagaggagaaatccttggtttgggtcccagtttttccatataggctattcttgtgctttatgcagacagaaacattagtacagtatgtacagaattagcagtatagtaataagtcattttaaccaacagatgtaaaaaatgcttcagcatacctttgtaatactaggcctgattacagaatgggagtggtctgtataagtgagctgtggtagaaaatacaacccttcagaataagttaaatgtaattaacttcactttaccagagtcatttttgttcccacagttacccgagtactaatttctaaacttgatgtgtcaagaatgtggcagaatggtgtcaacttaatggccaagaaatgtgatctgttttgaaagagaatggaatattatagtctatagtacacaagaatggaatattatagtttatagtatactttctttgagtaacatttctgtgaacattgaaattgggaaagaagattctgttattttcttctgagacttaagagagtatcacattaaagtggcaaatttgtgtttatgccaaatgttactgtgatgttttcttctatagaatcaatccctgtaaggtaagttaaaaaaacagaatttctttctctatagctgcggatgcaaaagaacagagagattaaattaacttgcttgtacatatagaagttaatggttgtttcagataaagaatgtgtagaatcataaatttcttaggacatgggttaaatggcagacagaggaatctttgggttacattgtagacagaggggtgatctttgcatatgagcaagttttgtgtcttataggtggtgctttcaaggatgctccttagaatcgtgatctctattttgaaagggatgaggatttgatgttaatttaatattctgtctacttggcatattttggggttttgtctgatgtagcagaaaagttcctacccagaataatttttaaaacatggtaacattggattagggcagtaacacactgctcatctcaataatgcttccggcttttgaattcattaaaataataaaagcttttttttatctgcctcattatttttaatgcagttccatcatagagcagacttaatccctttgttggtgaaggtagttaaaattttccttttgaaaggaaaaaaaattatcacttctgctagttaatctgatacctttctctttagggtattttgaaacatattaataaagacaaaactaaaactaaaattgaggatcagtcacagcagagtgagaaacatggcatggcattgtggtagatggagtagaggcccagtgatggggacaggaatcctaaattctaagtcgagccctgctcttcattagctaggtgtctcagacaagcagtcactcaacatttctgcatctcagtttcttcgtagagaaaagaagggttttgatatagatctccatggttctttttagtgctaatttttaatcatttaattgaaatgcaaaaagaggtattttaaaaatcaggccttgcatatttttcatctctactgaccccacatcctcctccagctactgtcacatttctagaattttctttcgagaaatgattctcaaatgaggcgtctactccttgtctctaactgcattgccaaacatagttttctgacatcagctgcatttgtcctgggacccaccctgagttgtagggttttcctgccactcacctgagaactccaggctgagccttcaagtgcactaagctaattaagtgctgcagtaactctgccctggtgtcctctgatggcacagttgcaacagatgcattgtcttcttgcttattaacaagtaaagggctgatccctggaaaatgttggggagggggttaggatggcagttgtgcttttcgttccagaagtcacttagtcatcttttcttggagatggcctgtataccttgcctagcacagtgtttgttgaacagcaggcatgtatgcctaagagatttttctccatcttttcttcctccctccattttcctccattctttgcctccaaatcatagtgttatgtgatcttcggggtgtcgcttttctggccggaaacctctgtggctggtggcacctttgcccgtttttgtcctgtgtccaggaagaatgaggtactcagagaagtggaaggtgaagaagatgaagaggagctttattgagtgtcagaacagctcagaggaagcccactgtgggtagttcctctctgtaggcaggtcatctagtggagtgttgagctctcagcagagaggaggccctggagatggtggctcctcttcacaagcaggccgttcagacatctctgcaggtctctgaagctctcagcagagggcagctcctctctgtagctggttcgcccattgtctccacgtgccctgctctggctgagcctgaggcttttatggacctcagaggggaggaagttcctgccgattggcccatggtcctccatgtgcacccagacgaggcaccacaagtccccactccggtcccggactggcatcctggcccccagccttcaggccctccctggtctgaaggaggggccttacggggactgccgccttccacccaggaatctctctgcctcctgctgccccgggctcggccccaaccccggtcggagatcagagcaggcatctggagaggagaggggctgggaagcgggagcagacacccccgagcctgcagggatgaagtggggggcgggtcttcccgggccctccagggtgcaggctgcagagatgccaggtctgcacctgcggagttcacgctccaccaactcagtaaaggtggggctccctcttgtccctggctcctgcctgctcgattgagcgcgaagcccaggtctgcagccgcagcagggaggctgcagctctaccctggagggcagatcctgtctgctcccggcccccaccaagagcacagggaagctccgatctccagcatcagtttgggcagctgtagccccacccaggaaggcggggcgcctgcctgctccatagagcaggaagcctggtctgcagccacgatttgggtggctgcagtggcacccacggagcccctgccccaacccagaatgggtgaggctcccaccgcctccatggagtgtgcagccctagccggcctccctgttgcagcagcagctgccatcaatagatggaattacaaccaccgagcacgtcctgattcacgtgactttcaacatgttataaaggcatactcttcatgggggctgttttctagcttctttgtctcacatcaaatgagggctgctcccctggctggacctatggctcctgacatgactccccggaggtgtggcctttctccagcaataaatatcgaagctgctgccgttcctgaaggcgagcctttccttggactgggaaattaagagggcaagatcgcctcccttcccctagggtttgccggggcagcgttgtttacagtgaaaaatgtgccatgcagcctcagttttaacctgaccagcgaacatatggactcggatggaagcaaaatggtgtattgtaaatactccgggtgcttccgccaccaacgcaagaagcgagggggaatctaattattctcgaacagattgtcctctgccgaacactgtcacgcctgcctgccgattaacaagaaaacggcctgtctctaactccaaaagccacacacaaccgtctgcaggcccctgtgtcagtttgctgcagtgattggacgacaccatcaaccttcaccaagggaggaacagtttggagagttcttgaaattttcagctgctgctttctttcttctcttctgccatccttccccttcctcctctcagaattggtgctgttgtgccaattctaggtgaattggagtatgtggctctggctagcatgggtgtgtaggccccattattagattcctgggcagtttgcctcctttctagtctctgcttcccagactggttctccacactccgcttcacttctagtttattctgtcttcctcaaaactcacccccaggacggtcttctgttagtcttttatgccttaccctgcaccgggtctgcataccctccattctgagaaagccaattgtgtttactgtctcctctttaactgctgaaggaaggatgggtgttggcacttggcggagaaggaggtttgtttggacagaggtctctttcccaaacccttgtcgttaactcacatgtgcaggtacgtgttctactgaggtcaggccataagcattttcttctttttggtccatttacagttctgtagtttgattctttgatatacaaatgtcctgggttgctggaaatccctagaaattttagttttaagaaaaggtcataagctgttttagtacctggattcttctaaaaagttcatgtttattcacttccctgttcttcctgcatggtgcacctttaggctggtgtattttccttatcggagaacatggcatgctttcttgtcttgccctttatctatttctcccagataggtaagctccctgagggcagggataccctctaccttcttgcgattatatcctcaacaattggcacttcgatcagcctgtgaatactcaataactgtatattagaaaataatgactgagcctgctttaagagtgctttaaaagcattagggttgaatatgagttttgaagtcagacagacctggaataaaattccttcctctactccttaatatcggtaagactctttgacctttctaagtctcacttcctcatttgtatcagattcgatcttggattgtcactaattcaataatagctactaacatatattgaccacttagtttgtgccaggcattatgcttagcagtctacatggatggtttcatttaaccttcgtgatgtctgtgagatgaatgctgtttttttaattagctgcttttctcaggtcggaaagtcaatttaagaggcttacgctacttactgaatgttacacagctagaaagtgggctgagttcacactcggtcacctgattgccaagcctgtgctcttaagatctcaggttcattgaaggcagcaacatttggtgagtatatagcagttaatcaataatcaaaacaagtaaaatgtaagaacagcactttaaaacttgtctttaatccagtgaagctcagatgcctatattgccttttaattgtctaagcacttgcacaaaattatctaatatgatcccaacaattcagtattattagtcaaatttaatatgtaataattgggagaataaaagctatttattgagctattcgctgctgacactacatacattataactaatattcctgacagccttttgagttagatgttataccgctttcattttgcaaataagaaccagaagctcagagaagtttctgaacttgatcaaggtcacattgtagctcagattaaaatttgcatctgagccaggcatgtgtagtctcagtaactcaggaggctaaagcagaaggatcccatgagcccaggaggtcaaggctatagtttactatgattgagtgtgtgaatagccactgtactccagcctgagcaacacagtgagaccttgtctaaagaaagaagaaagacaaattcagattttcaagcctgtgttctttccactatacaaaactattaggatgctttcgtgaggcggtggggaagttgactttctggaagttttttgctatccagatccgggaaacccgattcgtgcttcctgaattagctctgttatatacattgcagagtaaattctgtgtccctagtcttctgtgaagtgggaacatggtgcctgtgtccaagtgttttatctctttccattaaagtcagcagttttccaaaggtcttgtttatgaaggttattagttatgcaaaatgggcctttatggatagttctatgaaatgattccaattaaaaagaagtgggtagattgccagttggtgtcagctaattaaattatgatatgctcctgtcattaacaaggactctgactggaggaaaaataaaaagataaaagcaagtttctgaaatttgttgacagggagggtatattactttgcccattctcatataattagaagaataaaacaggagcttcccattttgtatttgaaatagggaaatctgttattactttcttctagggtataattaatcaagttcagctgcagtattttagatgttatggtgaaatggagttttattaaaaactgtagtttaataataatggatcagttgtactgacattattgcaaacataaaaatgagcttcgaataccaaaaacacattcaataaatttaattgagaaggggctgtgttagaatttttaggctggttccacgtcagtgtttgccatgagtaagagaagacattggtacccaggcttgccctgaagagtgccagggacatggcggtagcagcatcccgatctttagtagtcctctggcgggtgtatccgtcagctcttgtcagctcgacagggaggctgtccgtccaggtgaggagagccttgccgggctgcagtaagtagcttataagtacagtcagggaatggagaagaaaatctccagcttttcctccagctaaagttatcaatctttacaggtacttctggaagctgttggttagccatgctgctgttgtgtgaggaaacgagtgcctggctggaaagcacaaggctttgggaaagttactttttctgcattaaatcaaatgttcaatatcttgatcctgtgcccttctgtgaggtgatgtagtggagcattcttctagacatataggtaaatggtgttgacctaacagatgggaggatccagaagcatagaggctgggatcccaaagcatgaataagcagaatctagaatttagaccttactaatttgacatttatgatgattcatatagtgctgctttgattgattgattgattgatttgagatagggtctcgctctgttgcccaggctgaaatgcagtgacacaatcatggatcactgcagccttgacctcgtgggctcaagtgatcctcccacctcagcctcccaagtagctgggaccgtagccacatgcctctatagccggctgattttttgtatttttagtggagatgggattttgccacattgccccggttggtcttgaacaagctatccacctgccttggcctcccacagtgctgggattacaggtgtgagcaccatgcctgtcctgctttgactttttttctttcaaaatgtgttatggagagaactgacttagaatcctattgtatacccaagactgcaaggacactgtttaaacttacaaagaaaggcacctgttttgaagcctttgggaagacgtatttcttgcagtaatgcatgattcactaagagtccctatcctttaagcaggtcccaagaccctctacactgttagtctaattggaggatgcatgtttgtgtgtgtgtgtgtgtgtgtgtgtgtgtgtgtgtgtgtattaaatatacaactgtatttccattaaaaaagataatgtaatccaggttagcttttttgcctgttaattcacattagtgagattttgttgtccattgtggtggcaattatttcttaccattccatgtgggtcttacacaattaagagaggctggttgcacagccagacttgcacagaactttctaccctcgtgtttatctccatgaagaagctgccaaaggttggaactaagatcaccaagcccttcttacttgtcttcacactaaacatgcttcatgatgttctggccaatttgtgtttgtaggtgtccagaaaagagcaatatacttacgagaactctctactgaaagtacagcagtgccccccttatctgaggtttcattttctgtgcttttagttacctttggtcaactacagtctaaaaatattacatggaaaattccagaaataaacagttcataggtttacagtcgtgcactgttctgagaagcatgatggaatcccgtatcccccgggacatgaatcattctttcatcaagcgtatccatgcgtatacacgacctacccattagtcacctagcagtcaccctcagttatcagatggagtattgcagtctcacagtgcttgtgttcaagtaacccttatttgacttaataatgctcccaaagtgcaagactagcgctgtcaatttggatatgccaaaaagaagctgtaaagtgcttccttcagtgaaaaggtgaaagttcccgacttaataaggaaagaaaaaaaaaatacgctgaggttgctaagatctacaggaagaaagaatctatccatgagactgtgaatagtatattattataattgttttattagtaattatttttgttaatctctgtgcctaatttataaattaagctttatcataggtatgtatgtataagaaaaagcatagagtatagagggtacagtactatctgtggtttcaggcacccactgagggtcttgaaatgtatcccctaagggtaagggggactactgaatcgagaagagaggtatccttctggtgctaaagaaagaaaaaagaatgtggtatactgaggttcaaggccggtgatgcctgattcttagtgactgctatcttctgagcaagttctttttgcttaaaggtaatttcttaaatgtgagagtaaggaagaggaaaactttgaaaaagagaatgaacccaaacataatttgacttctttataggaaacttaactttgtttcaaaataagtctttcattgcttccagctcgactctgcttccactgaacatagaactcaatcaccagggtttaaacagcaactagtgctgtattccaggagatgtgtttactaaatggaatcttgaatgtttttacattgctttatgaattctggactgtttaataaatttaaatgaagattttttttaaatgtgtttacgttggcatgttagtcatttactgcagaattttgagtacattcaggggggctgtggttctgtaaaggacttaccacagtttctagcacactgtacatgtttaatagacattatgctgctgttgcttttgttggctaccataactgtgaaggagagaattgaggacagtaaaatgaaagtaagtaatcataggaatgcaccatctgtcaaggtgtgcttaagacattaaaattcctttgaatatccgtacaaatgataaaatttgagaaataattgtttgtctttgttttaccattaggctttttggtagctgtatcctgtcgccctgttcaacatttgctcatatcgtgtggaattcaaatcctgctagatcttttgcagagtttccagttctgttgtgtgtatacagtgacagctgagttcagtatgggttgttagagagagttgatttccaagccagatacttttgggttcaagtgactgctcccttatgtattagctccatgtgaccctaagacatttagtgtcctatgaacctttctgagaattgttctgagttttcctgacagagtcaccagcttcaagaaaaacatagcagttgaacggataggtcacctgaatgaagcctgcccacttgggtagcccctgacaatacctctactgtcataagttatataagatagtaagtattgatcctaaagatggtcctgaattgccaaggaagatagactccactctgctaagccagtgaccgtgatgtgcatttgaaacgcatttccttccagctgggcttggtggctcagttctgtgatcccagcaactcaggaggcggagaggggaggatggcttaaggccaggagttcaagagcagcctgggcaacatagtgagactccatctctaacggggcatgatggcatgtgcttatagtccctactacttgggaggctgaggcaggaggatcactttaacacaagagtttgaggctgcagtaagctgtgattgtgccactgtaccccagcctgggtgacagattgagacccctatctctaaaaaataataaataaataaatagcatttccttccaaatgggcgggataaaaaggtttgatgctttaaagtataaactttaataggaaaataatccaccacggagcagttccttcaatgaagatggtggacacttccgttctctgttgcacagctgcagtaactgctagcggtactaatactactggtgctagtactaatactaaagctaacatttgttgaccttatattgttgctagaaagtgtaagtctttcattttttcttagtcccaaagaatacgtgtacaagatgaataccactaataattttccagaggaggaaataggcttagagaaaagtgtctgggccaaaataatgcacatccaaagcggtggagctggaatttgaagcgaaaggtcctgatccccagaacccatcatccttttacctgttttaccaagcatttcagcagaaacctggcacttgtacctcattgaccattactggcaagtcttctcatttgtatatatgtgcattcttcatgatccttttgaaagagatcttggtttagataatattcttatgtaactaaagaatgatttgtccattcttatgttttgtcttcgatcaaccaatacatgatgaaaagaatatcttgatgaaagggagaactgtgtcattgcagagtgaaatatgggtgattcatatcttaatgaaagggagagctgtgtcattgtagagtgaaacacaggtgattcatatctttgtgcggactatccatggcatatttaaaagcttagatcagctgctctttcctttccagcaggattctttgctgtcttctcagagtgtgatgaaatattcaattcttttaacattagcttgaacaaaacaaaattggagaaatagcctgtcattaaggccttctataacccaccattgttaaccatcttggattttctgtgtaatattagcacatatcaacaatttttaatttaaaattctacatgtgtaactataaaatcagaatttttcatttttgttaaagaaatgtgtttcaaactcagcttcttgaatgcttatggcatgcagtttgttttgctgtgaattgacaaagggaattactagaaaaagagaaaaagagtgcagagtttgctaaattcctttcctggaaaatagggaattgatagttgagaaatgaaagtgtgttataaagctcttataacacccactggaaaataatcattaaatattagacaatatgattggattaggaatgttttaggtagaatgaagtcaaccaagttctgtttttctgtgtggtcttgagaaaatctatgtattgaaatactcatgttagcctcccattttcattagatatattttataaacattttttggtccattgagaaagaccctttataacagaaggttaaaaggttaattttaggtctttggtctatgaacaattaaaatttcccaggaagcttaatcagacattaatgtaacactcaatcagtcccctgaacctgctgtgagtttcgccattactccttattgattagactgtattctttttgctgctaatgaattatttatggaggattccttgagagtattcaggcattgtgaaggaagaagataaaaaccccttcctctgtatagctcaggccaggggtttggtggctgctgtgactgattgtgaaggctctgtcccctgggtccctgttgtcttaactgtcctgcagctttacaaagtcttgagttactgagagaagatacaaaagggattagattatgtctagcaaacttgacagacctgagcatttagaaaatattttccacatgatttgtttatagagagcggtacaaagaaatttaggtactgtgcaaagtatttaaactttttttaaaaataaatttttggctgggcgcggtgactcatgcctgtaatcccagcactttgggaggccgaggcgggcggatcacgaggtcaggagatcgagaccatcctggctaacacggtgaaaccccgtctctactaaaaatacaaaaaattagccgggcgtggtggcgggagcctgcagtcccagctactcgggaggctgaggcaggagaatggtgtgaacctgggaggcggagcttgcagtgagctgagatcgcgccactgcactccagcctgggcgacagagcgagactccgtctcagaaaaaaaataaataaataaataaatttttaaaatagtttataggaagagatgaactgaccaaaatgcagtcaggttttttgttttttgttttcagttcgggctttattttgttttaaatcctagaagcttagtattatgaaaacaactgttttaatgcaaatatctttcataagtagtgagcgaatatatacgaagagggtgtcttgttctcacagtgcagcactcggggcggagtgaggatgggacagaggaggactgtgcacagcctcggtgctatgtgtaaatttagtcccttggccctatgcacagaatgaggaaaatgagtaagacatacatactatatttttattcagctggatttaattatcttaaggaatatctttttatcattaaaggtattttacatttttaacagaaataagaaaaaaaattatgtgtttgtgtgtgtaatgggggatgacatacaaagcctaaatgaaatttgttctaaaattcagggtaataatctctgagaggaatttggagatttcctttttttttaaatgtgtgctcccaaataccaaagagccattccaaaactcagtagtagaattatatacaaaatgtaatggaaataccttcttagatgactttaaaatggaaaaagaaatcggcttatcctataacccgctacttccgcccagggacttgcagagaaacacctgtgcgttctcagaacttgtttcactctgtagggtggagggaaaaatcgatcatgatctaaggctgtggttgctgaattgggttattagttgtgcaccatctacttttaccgtcttttgatctggccactatatttaggttgttatggtatccagtggggagaaaaacaacttaaacttttgcaattgggaaaccaagtgatactttaaaaaacttaatgaaccttgaaaattgctactcaccgtgtgagagtaaaaatgtcgcatcaggtgggtagcaaagaaaattgtcttgatacttcctgcattctgacaatatttctttggcagataatcatgtatcttttactgagagtctgctttgtgcagatacccttatattgtccttgtatgcactttggggagatacataaaggagaaattaatattaagattaaaacatgtgaatcccatggactcaggtgaggagaaatggcgagtaaccactaataggtccagagtttccttatggagtgatgaaatattctggaattacatagtggtgatgagtgtacagttttgcaaatatatgagaaacaactgaattgtatactttagaagcatgaatattacagcacgtgacttatataacaattaaaaaaacccaaatccaaaattctagtatatgcatgatcagaaaaacaacaacccaattgcttagctcgtagtccttggacctgttgtaagacttctgtttcttatcctctgcctactgttccctgaatgatcttccacagtgactgatttaatagagttaaaaactttccgtgaactctcattgcttttagttaggtctgtgcatacagttgggcagactgtgctctgcagaagtctaagaaatgtctttctcattctgcttttttggatgaattcagactcattacatgacatttaggactgtctgcatcttagttccagcctaccattcagcaacttcattcatttatatgcccactcattcacttattcattcattttatttgtatgttcattggttcctatgttggttcattcattcatttactcactcattgattcatttaactgtattccttatcttgcctactggttgttatgttctccctgcccagtctgcagagcccatgctgtacattgtctcagcctttttcccaccttcttcctccaactcccagatatattctcaaggccctgcttctatcctgcatttttttgcacctttcttttgccattacagagttgtactttttttctttaagtgcccagtacataacaaaagaaggttctatctcagatggggcagcattattcacaactgtctccgggctcctccatgaggtgtctaaggtgtctacctttctttcaactttaaaatctgaacatgatggacctatgcttttggaattgggggtgggtagccaactaaaaaatggagagccactctttacctggatagctaatttttatgttattgtaggataataaccacaaatcaaggcacagctacctattagagctggcctgaaagctttaaattctgcagaatgtgttatatgtgccattaactccaatctgttggtgctaatttgaaatggtggtttgggaacatgtgcagttcctggtgtacttgaagatttcaggacatgaatgacaaacagtaccaataactctctgatctaacagtgagaagttatcagcaggcactgccagatttgagaatattcatcttttctcacattgttttctttcttattttgcataagtgaataaaggatgattttggaaagccttacacttgatatacattatacaatcctagaggcctttaaaaaacaggacagaaaacttacttgaatgcttgaaaggtaatggaccagattagagtttgaactagatgactcttagcagttccttctacttggatgatgtcatatgcttctcttttatttaaaatgtcattttggtttgtatattaaaacaattttagctgtatatttctactctgttcatatataatatgtatacattatgcatatataatatgtatacattgtatacatacacgtatgtgtgtgtgtgtgtgtctgagacaattgccagactcattttaattatgaagctttaaggtgattgatattgggatcacttttgcctctgcatcttaagcaaatttatgttctttgcctaatgacttctatatttgccagcatggacttatcttgagatgactcaggaatgttactggaagtgatagttgtttggaataatttgacgcatgtccctaagatggcttacttttgcccctctgtcattttagaacatacttaagctgtgcacactgggatagcttccagaagcttaaattttaggatttaattaggtcatacaatattaattaataaaaaactttttgaattgctttgtgttcgcaggtactgtgtctgatgctccacatagaaggatgaatgggaccaaaggtcctactctaaaccattcacagaggagtagtgagacctattagaaaggatttgaaacaaaagctttcaggtagatgactgaatcactgtagctcttcagcatattgtaacagaaaaagagccagtttttgaatttttatgagcatgttatagttttaaataatgtgattttcctgaactgtaatattgatgtaattctaagtcagagaagctgttttgcatttccagctcttcctgcctacttcagcactaaccaaggtaccaaacagcagcctcttcagcatatatgctaagttttttttttttttttagcttgactgggaacattttcttggggatgtaattttagtttggtgtgatatgcaaacaagcacactttaaaaatagatattatttagcattgaagtggaaattaaaaatgagtcattaaaagcggcaggggggggaagaaaatgtggtcaatcaatttcagttgcatataggtgtagatgcaaatggaaagctgcatggttatttaaccctctaaaagtcagagggtcttatgtctcctgttcagagatgctgcttatatttaaataatatgatggacatttgggaatagactagtggttcttaacttcttttgattcacagattcttttgagaaactgtggaaagctaagcacatgtatgtacagatataaaatttgcatattatttcaatggattcatggattctgaagcatattctgctaggggcatataaatagtatgtgttaatttatgtgatgaaaatcatgggtatataatttaaatttagtgtataaaatttataaattatctagattacttatgaatcatatacatgatctagctgaattgaatacataagtgtttattataaggcatttaataaacatatataaaatgccttatatagaaagctgcattttaaattatgttgaagtggagcttaggttggaatagactttgggagtactatttataaaagagaatatttccaagtaaggctattcctcctgaaatgtcagtcataggccacttctagaagaaaaggtgggaaaataaaaacattttcttaatgtaatacagcaggtgacaaagtgagctgacatgcttatgaagctaggtgtaggcgatgtgatatataaaggaaaattaaaatgtcatcttatctgaaggttcactagtcatttccccgggctgtctttagcctgtgcatggaaataggttcttctggtccagatacaatgcacttttaattagttgaccataacaagaatacatttcttttgaagtgcttttagcttaaagatggaagtggtttaatatggagttctaaaatgaaatgttagggtataattttaattatataaatagtagctacaacagtgtcatttgctggctcagctgtggctattataaaatagtgaaatgttttcaagcttttttttgacagtagttgagttcattgagcgtgtgtgcattcagctcgcttgcacatgtgttctccctctttctccttcttcttataaaataatataaaagctggcatttccttaagaagatgtttctcctgatgcactttaataaagccacacccctgcttccgttagtatcagccaatcgtgatgacatatatcaagaagatagttgctggtgaggtaagcagtgcaacaggcccctttggcccttcttttcctgtacattcttaactaaggaaaactatattaaaaactgaaggaacaatgagatactatcattagataataagtttaacaacactcaggtctttagaagtatttatttatttactttttcaggtttttcattgagtaaagtgtggagatttgttatgggaaacattctcatcctttcccaacttggtgggaattggaccaatagatgttttcagtaacttcacgagcctgggagtggaatcttatgatgttctgcttttccctcagtcatgccgtgggttcatttaaatgacaagctttgggaaagttattcaatcaaatgttcagttgttcaaacttgagttttgagagttctttatatattctagatactatactagatactattcagttcttttggatgcatacccataaatgggattgctggataatatggtaattatttttatgtttttttaagaaatgccatactgttttttgtagtttttattatagcacctttcatatttccaccagcagtacccaagggtttcagtttctctgcatccttgccgccatttcttcttttctgtttatttgatagtagccatcctagtgaatgtgaagtggcaacctcattatggcttcaatatgcatttccctaatgactaatgatggtgaacatcatttcatgtgattgttggcaatttgtaattcttctttggagaaatatctgtttgagtcctttccccattttaaaaattgggtttttccttttttgttgttgagttttggagttatccatatattctggatattataccctgaccagataaatgatttgcaagtattttctcccattctatggattgctttttcacaatgttgattgtgttctttgatacatagcagttttaattttgatgtagcccactttttctacttttacttttgttgcctgtgttttgtatcatacctgagtaatcattgctcaagccaatgccatgaagacttcctttatgtttctcctgagagttttatagttttaggtcttttgtttaggtgctttaatttttgtatatggtgtaacgtaagcatccaacttcattcttttgcatgtagataaacagttttaacaagagcatttgtcaaaaagactgtcctttcctccattgaatggtcttagcactcttgttaaagattatttgaccatatagttttctaatccatgtacatggattgtttttttcataacccaattaattttttaaaaacataaattcagaacctggaatttaatctggatgaatgtaatcttgtttgtttaggcccgtcttccaatctgatgagtttcttgtaaagcttttttaaatatataaatttaatatatacactacttctcccaattttttgtcatctctaaatttggtaagcatgccttttatgatctcagccaagtcgccgatgggcatgtttagtagaattgtcccaattccaggacttaataacagcccattagagatagtgctaaaaattgaatttcaacattcatttttcagtctatactgtttgggtgtgttgcaaacataactgatatcattcccctgtgcttcttcattgtgctcagaaggacatcaagaatttctcatttaaacattatagtctttttctgaccttcagccttataaccatataaaaaagggaaaatatttagtttcatataaagtattttaatgaaaatgttctgtctttaattggtcattgtcttcatatgtgttcatcattgtttaataaccagttctagacttctccggaaatttatgtcagactttatcattgcataaatcataaaattgtggttcaaactcacctttttaaagaaacaatttgtgtagtcaggaggggaatatttcaatagacaaaagacaatcagtaagagttatagccgaaatttatgttctgtctctcaatgtgccccgcacagtgttgggaatgtataatacatctcagatcattttgggttgactatgaagtaacggaaatgtatattctttccttgttattatcatggtagagcaggcatggtcagccttatgaataagaacctaaggttcttctaagtgaaagtgcaggcactcaaagtcctgtctttgactcaacatttcacccttattccttcttactgattgactgattggatgtttacatgattcattcattctttcatttagcaaacatttcctgagccaccaccatgtacacagtgttttgttataataatctggaattaaacacgacaagacctttgatctcacacaatagagggaaatagggcaatggaggcaaccccctataatactaatcatgataagataaaatgtatgtgtgttgggaatgcaaaggaagacataagtaattatgactgtgagaactggaaatgtcttcatgggaaaagtagaacatgtgctgattttaaatttcagcagcagccaagtggagggaatgaggaagccacacaaggaaggttcctgagcccatggaaaggactttatctgcttctagtccttggagcatagagtgtgtgtagtgtacaggactaggagtgttaagacgaggtttgattgtggggttgcttcagtgctctagtatgaagtttggacgttattctctattaagtaaagagctgtttaaagtttccaagtaggagaatgaaatgattatgacgatttagaacgataattcttgttcatggcatgaaatatagattagagagtcaagactggaaggaaggagcccaactctcaagccagtgcaatagttcaggcaggagaaaggaaatacaaaattggtctcttacaaaaaggtcagaactgtctggagtgcaatgagtggcatgtaactactgcttttaatccaaacagcattttctttttgtgattagggagacattaaaattctttgttatataacgagaataaaaattggatttttgaaaacaaaaatgccctgtttttacttaaggtttctagcttctttttgaatgataaatataggttgtaattttctttcactgatgcagtttttaattttaaaagggtagtcactctataagaatcagcatgttttagcataaatggtcttcctgtgagagacagtcaatctgagctacctgtattttaatttaaatattttggtttttgggagacataaaatggattcagggcttataaatgggagctcaagtgtttataacactgaaaatatggaggcctgggaacttcatgaaaagttggacaaccctaaatgatcttagtgataattttgtctacatattaaacgttaaaactttcatcctaaattgtagcctctcaaggtgaagagttccctccatttatgatgggatgaattctatgatgatagaaaaattgaacatataagtttttctcctgatgacttgctgtggtcacctgcctctggggaacctgttttctgaggatattctttccaatattgtacttgcaactcattctgaaattatggaattagtattgttagtttcctcttctctctgcctttaaacagaagtagacatagctacagttatatatttgacttggcagaattttcagttttcaaaatgcctgctatgaagggcatggtaaggaagtattttttgctgtgggatcatgattgtttctatgcacaaatttagtgagtacactctttgcttgactagctaacaagtgctatgggcttatatccatttttcagtctttaaaaaaaaagagaaagaaatgtgttcagaactttctcaactcgatggggaaattattcatgttacgtgaacagacgagtcctctccatggcagcctctttcatgtaacctctagtgagtttttactttccttatgtgtacaagctctttattcaggtttgattaaatggcaaaacaatagctgtggactgtcttggttccctttgggctactttgaatagtgaacatgcagcagaagatgccaggagtcaaaggaaatggcgctgaatgtcgaaaggtcagtccctcaaagatagtttcaccaaatgagaaaatagaaactctcacaaaaaagctgaggtcaaccatgctttactctattcttaatttctactttttttttttttactgtatttgatgaataaatttccttttacctcatgtaatgtttaggtgtaaatctttcattgttgtaaaggtgttaagtcaacaattacctattaaagctttcatgaccccaaaattgaactattcagaaatacaagtgcattaagacattatttttaaaggcttaattttttttagagcagttttagtttcatagcaaaattgagagattttgaagacacaaagattccccatctgtcccctgcctgcaccttgtcttccatcttgcatattttttgaaggatcgcaatgaacaagaatgggatcaacagtggggagggccacacacctgtaatcctagcacgtttggaggccgaggtgcgcagatcgctggagccctggagttcgagactagcttgagtaacatggcaaaaccccgaaaaatacaaaaaaattagcagggtgtggtggtgtgtgcttgtagttccagctacttgggaggctgaggtgggaggatcacctgagctggggaaagttgaggctgcagtgagctgtgatcgcaccactgcactccagcctgggcaacagagtgagaccccatctcaaagcaaaacaaaacaaaaccaaaaaagcacacaacacacacacacgcacaatggagctgactaatccagatactcctttcaccccctaaagggagaaaaagagtatctgagctctactgagtttctgttgtggcgagtatggaactttgaagtcagactgcctgggcttgagggccagccccactgctcactggctgtaccatgtagaacagctgttgtactctctctaaatcccagtttgttcatctatgaactgaggattcataatatttaccttgcaggcttttataataaaaattaaataagatttctatgtaaagcacttatcaatgtgcctggcccatagaaagcactcagtaaatggtatgtgctattgttcattctttccacaaatacatactggttaacttaccctgttccagacacttttcagcatgctggactgtatagtgaacagttcctcccctcatagaaatatattctagaggtaggaggcaactataaccataataaatgagcaaattactttgtatgctagaaactggtaagagctatgaaataaaactgaacatcgtaatagagatggggaggaggagtgcaggaattggggcaacttgcagttttacatagaaagtcacattaggcctcgtggagaagacaacatttcaacagtgacttggaggtatttgattgttattgttactaccaagtaggattttgttctaccaaacagggctttgctttacgcctacatttctacccttactgcattttgtaaaagttgatgataataataaatgcatacttaatactaataattaaaatagtaatactggaaattataatctatgtttacactcattttagctatataatctcctctccttttcgtatttttcttttcttttcttttcttttctttttgagacagagtcttgctctgtctcccaggctagagcacaggggcgtgatcgtggctcactgcaacctccgcctcccaggttcaagtgattctcctgcctcagcttcctgagtagctgggattacaggcacgcgctatcatgcctggctaatttttgtatttttagtagagatggggtttcgttatgttggctaggctgctcttgaactcctgacctcaggtgatccacccgcctcagccccgcaaagtgctgagattacaggcgtgattcaccgcacccagcctccttttcatatttcactcatttccactgcagtgagtttagggattagaccagtaaggaaattagttctttttgcttacagacaacagaaatagaagaaaacaaactagaaattagctccttaaaaacaaaatactaaaacaaaatacagaattcttctacaggatttctcaactatcttttgtctactttatccaactttccaatgcagtatcatcacactaaaatgctagtatttctgaaaatacttgggctcatctttgttgaagttattgacaaaaaagttctcaccttttctgtgaatgagaaatattgaggtgtttatgcagtctatggtttggtgctgcagttgactcaggttggcatgggaactggtgccttgtgaccgcttacaataaccaagcatcctcaaagaacaggaaaagctgccctttcagagttctatatggcattaatctgtatttctctcttctaatcatgagcaaatgatattttcctttacagagctagcatcaccttttggtacttttgcactttaccttcctgtgtagatacattggaatccgctctctacggtttctctgtgcatccaaagcagtggttactaaccctattagattcagtgctgcatctttgtaatgtgttttggaatatccccttcatttctgaaatgaaatgtattaataatataactgcctctacacataaatttaagtattaaaatagtgttacaattttaatataaagaaaagagaaagatagctttcagtgcattttattatgtaaatgcttacttgttgactattcctggagataaaatgatgtcatcagatgtttggacctacttgcaatgaatatatttggattaaagaggagtaaaacaacattcaactgagtattggcaaaagcttttctttctatttgaagctttgaaataaggagtaaataagtatacacataaacatacatagaatcctataaatgtaacatctgtgtatgtagattgatgcctggttattgtgttggtgattgaaatgccatgaattgtcgacatgatttttcacaatgatgaacaactcttggtacaattgcaaacaaaacaaagtataattcctcttcaatttacatttaaggatgttgcattccttgataattcagtgactactaaacagtgcaagaaacacttgtgtctgtaagtaaaatacagttaggctctatattcaaagaagtaacaggattttctcacctaccggcaagtctggtggaacatctgaaagacttggaggatactgggtaattatttgttatctaaggctgtcctgtctagcaggcctggctacagtctaccacatgccattgtgacaattgaaaatactgaaaatggtccctagtacccccagtgagaaccactgatctaaagctcctttgcagtgctcatgcccagatggggatcctgtccaagctgcagtgctgtgttgctccatgatttagcttggcacggcactgcgctgtgtgtaagtaatgcttcttagtgctctggaattattctgcttgaagcactttccagatggctggctgatagcttctggggatactgaaatgctgttccgatggtttctaaccctctagtctcttccttccaatacatcttatagattcctcaaagtttgttgtgtataaaatggatacagtggataggtagttgccactcctttttactactactcgaattacaaattatgttttcttggtggtgatgtttcattgatggactgattgcttgattggctgttttcctctctgtcgttatctaaggttcatagccatattgcccatatttgtctgttattcaggatccctctcaccacttctgatcgtcatcacatccctcttgtttttgccattgccattctttcttttattcctcttagctttaccaaagggtcttttattatatgttaccactccatcgaagtatgtctttccttcgagctcataaatcgtggtcctcagctgaactttaaaaactgttctatactcagtagattacttttaaaatattaaatagctaaaaattttaaattttatttgtttattcctctttagtttatctatatcaaagtgaagaggtatctgaaagacctggtttctagaaatctcaagtttctttgtcatagaaacttgtcatacatagtatggttaccccatttaccacataggtacagtgggattttgtctgaggaatttgaatgtggcataacaggcaataaagagccagtgcatattcttcagataaaattaacatgatgaaagttatattctgatgacttaaatagtattcattatgcaggggtttgtgaagggtatgggatgcagattcaacttcaatatatgaagtactaaggaagactattcacagtgttaaatatgctgccatcaacatctttaccaatgtagtaaagttccgtaatcattgagacatcataactccataagggaaattccagatgtgtgtgtgtgtgtgtgtttttttttttttttttgagacggagtctcgctctgtcgcccaggctggagtgcagtggcgcgatctcggctcactgcaagctccgcctctcgggttcacaccattctcctgcctcagccttcccagtagctgggactacaggcgcccgccaccacgcccggctaatttttttttgtatttttagtagagatggggtttcaccgtggtctcaatctcctgacctcatgatccgcccagattttgttttaagtagaaaagatcactctattacagtgtcatgggtggcctggggtgaggcctgtccaggcctctgtgtatgatcatcagatacattctcaaccaagatatattctagctgaagccatcacacctggttattttctgtcttaaattatgctgcttgtgtccctctccggccttatgtcatctgccttttattgtagtcactcttttactcattcatctatctcattaggttggaaaactgagggacagtcttaggcatttttttgcacttacattgactagctcagtgttttgcacctaataggtgatgggtacatgttaggaagttggctctattcaaacctcgccttctttgtggacagcatctttggattttatgcaatttaattaccttcaaagacttagtgatttggttgataaaaccttaaaaaaaactcgtacagctgtagtctttattgctggaagtaacttttctttctttctttctttctttttttattcattcattcattcatttggaactttttaaatagtcactttggccaactccacattttacagactgggaaacaaactagagaggttaagtgacttgccttaaatccacagccaattagtgacaatactgagactagaacacaggctaaaggtactttttaaagagagtgtttatcacttattaaaacagttgcttttgcaataatagtgataggataattcatcattaattcaacacttattgactttgttatacacaaaatatggtttaagcattggcagtgaggtaaatacgaagacaacatcttttgtggaaaggatcttaaatggagagattttaaaataaagaaaatgtggtatattcgtagatatagatatagtgacaaggatgacagacatgacttgtaagaggcgttgataggaagaaaggctgatggcagcagatgcaggactagtcccatctttgggtgctagggttgccatttcgttaacggttcctatgtaaaattgtgcatttctcaggggaaaaaaaacacaagaaaaatggacagtatgcatccctttgtaatgttttaattaggcattttggacttagcatactgccttatgtaaaacaatacaagcatgtaatacaattttaatagcttcaattttattagggacaaaaataaaaagatggaacccaaggactgccaccattaggaaagtcagtgcagaatgatttgtgtgtgtgtgtgtgtgtgtgtgtgtgtgtgtgtgtgtgtgtgtgtgttttgagatggagtctcactctgtctcccaggctggagattgtagtggcgtgatcttggctcactgcaacctctgcctcccgggttcaagctattctcctgcctcagctgcccgagtagctgggactacaggtgcccaccaccatgcccagctaatttttgtacttttagtagagatggggtttcaccattgttggtcaggatggtctcgatctcttggcctcatgatctgcccacctcggcctcccaaagtgctgggatgacaggcgtgagccaccatgcagggccaatgcagaatgatgtaggctgttgcatcagatggctcttccgtttagattatcacctgcttgcaccttgaagttctctttaattttggattgctttgaacatattcagctcattttttgaaaggtgttctggcacttccaaatgtcagatatctgtgattttgaactttgtaattgttattcaattttcagtgagagaacagggtaaaagaggatagtacattgtaaaggacagtctgttatctcctcttaatttttctctttagctctataaggtattatagagagtgtttcacggaaatcaaagtaaaatcaaaaaactcaaagtatgttttcccttgacagaaacttcctatgaagaagttctgtgatccatagatttaaaattggcctcttttgggagccatttgattggcctgaagttaatcatggctacgcccttcattgtgtttttcagtgcagatgtgaaattagtcccggagagcaggggcatgtttgtttggtgtccttggttaggacatcagctgagttcggcctggtcaccatacacaatgtcatcttacatttggttactgggcaatccagagttcaatgaaagtgtccagctaagagttaaatgaaacgtgtcctttagtcaaatatgtgatttggtctttaattagttggtgcatttttgaaaattacttggcaactagggatatttcattagcatgtaatgggattaatatttagtgaatcatttttgaaatacatgacagatgttcggagccttggtaatttgccatatggtagcaagtagtagttttcagaattcttagttctgtcatatacgaatacaccttcataagggtgtgtgactctgtgtttgagaaacagcactctctttgttgcttaggctggagtgcagtggtgcgaccttggctcttggcacactgcagcctcaaacacctgggctcaggtgatcctcctgcccccgcctcctgagtagctgggactacaagtgtgcatcaccattgctggctaattttttaaatttttttgtagagatgggatcttgccatgttgctcaggctagtctcaaactcctggcctcaagagattctcctgcctctgcctcccaaagtgctgggattacaggcatgagctacctttcctggccctgcattctttataagtgtgtctacttatctccaaagaatattggagattctttttttttttaattagtcttttcttcctgttcattctgcaagggatatttatatttgaaattttggagaatgagagtttttcctttaaaattgaactatttttgaataccactccagaggatgtaggtgttgtattaactgaagtttcattctgaacatggaaagtttaattatcttgtgatattttatttgattagaactctgtagtaatcgctttgctatattgtgatgctcttgtcacagatgatatgcccggtttctgtcattaacgctgcactcttttccctataatgacatcactgattactcattttagaaccagtttccagcatatgttcttcctacttcctgcaacagtcattttgtagttactggcctggagggtaagtctttatccttccattagacgggttcagtatgagctgctattaattttaggacatgaaagagagataatcaacactgctatttctctgggaatacactgaaaattaaatatgtagactaaaaactacactgtatcttaagtcaacttctgttcattttaacagacatttagatgaattttggactctttcatttttaaaagattacagttataatgaacaataattaggaaagctttttttttttttttttttttgcaaaatggaaggaatttcaaaattcatagtaatggtgaaaagcaaagaaaaagaaataaccctaaacacaaaacaaaacaagaaacatgagagaggaccgaccatcagttagccatgatctgactcagtctgcaagacagggaataacttccaaatggttctttgttgctacacatttactgggtggcttaaaaaaaatactcatagagcaagagaaattatgtattaggataatgtcctagtaaaatattacttttgttttgtctttatatcacaaaatatttaaagtttagtacatattaggggctagagattgcagacacaacatgatgttctgtcttaaaagctgtattcatgttttctaatattcttagactgtatccttctcaaagcaagaaatgtgttttattcgtttttgtatccccactgtagcaacgtggaatgaacatgagattaaagaaagccatccttcatgtagtcatttttgtcaacactgagaaaatactgattgagcaggtggtgtaagccaggcacagtgcttagaggtgggggtaccagcttgtgtgatacgtgctccctgcccttctggatctcacagcctagcagggaagacagatgtgtacataactaaccccaaatacattcagagtgtctggaaacacacaggagggatggttgggttggagatgatttcacagaataaatcacattcaagtttggctggcctgtgacccataatttataaatcaaaatattggccatctagccaatgtcattatgagccacgcattatgccaagtgctgaagatacagaactggacacaacatactccctgaactcaagagcccattgatttgtagaagacatatacagatgtttaggaatccaacaagtagaaactgtgaatgggatgctgtggaaggaggagaaagactgaagaggagagcctcagtagggccggagaagagaggcccagcaaaaactatacgggaagcgacccttgagtttaggaagggggactaggaatttagtaggtcagtagagggtggattaaggtctggtttcaggcagtgaaacccctcatctatgaaaatttggagcatgataagtgatggggttccggacatgctaccccaaaatatggcattagaacaaacagcagaagcaagaaggtcgctcttatcttctactcatccttatctcctgaagcaagttataaatccttcattccagaggcatactctctatacctggagaagagaccatccttatcctcaaaggcagagagataccaagaagaatgtgaacaaacaggcgttgctaagttttccccaatttattaccattagatcatattcccattgtccaatcacacttccccataactctctggtcttcgtcagacctaagcataaaaatagaccaatttccctgcttctttgggtcttcatttctgaaggctcctgggtcacttaaaacctacattaaaataaatttatatgcttttctcttgtcaatctgtcttttgttatagggatctcagccacgaactgatgggtaagaaaagaaacattttcctctcctacatagagacatagagaatagaattcttaagaaaaatagtgtatgtcgtacatggcaggagatgaaactggcgaggcagcagggcttagaacttctggtaggtgatagagagttgttcaagagtgagtgttttaggccaggtgtggtggcttatgcctgtaatggcagcactttgggaggcagaggtggatggaccacctgaggtcaggagttcgagatcagcctggccaacatggtgaaatcccgtctctactaacaatataaaaattagccaggcatggtggcatatgcctgtagtctcagctactcaggaggctgaggcaggagaatcacttgaaccctggaggtggaggttgcagtgagcagagatcatgcccctacactccagcctggtcagtaaagtgagattccatctcaaaaaaaaaaaaaaaaagaaagaacaaaaagagtgagtgttttagttacagcttggacttagctgcaagacagagacccaactacagtggcagaaagatacaacagtttatactctcaaataggagaagtcttggctgggtgtgatggctcatgcctgtaatcccagcactttaggaggccaaggtggaaggatagcttgaggccaggagtttgagaccaacttccaaaaataaaaaaaaaatttagccaagcatgttggcatgcgtttgtagtcttagctacttggaaagctgaggcgagaggatggctttagccctggattttgaggctgcagtgagctatgattgtgctactgctctctagcctgggcaacagagtgagaccttgtctctaaaaaaataataaaattaaaaataaaaataaatgacgtctagagggaagtattccaagtctagagaagcatctttagaaggtcctcagatgtcaatctttcttttggttgtgctgcacctgactttcatccttaaggtcctgcacggttcaaggtggctgctggagctccagccattacccctgcattgagaaagaaaggcagaagagccaaaaaaaaaaaaaaagcacgtgcctcataccttttaagtttaagttctggtgaagtttcatacaacacttctctttagcacacattttaaaaaaaaattgggagtctcaaggaagaagggagaatgggtatttcagactagctggcatttttcatcacctggaggtgtctcatcagatgttgatttacaaagatttccctggcagaggatggaggatttgttggaaagggtatgaaaccagcagaaacgaacacgccacagtttgtgcgtttaatgtttcccatcgctgacattcttgagtaagcgtcagtgatggttctagcttgaggcatttggatcattggggtgcaggtgcaccatattgcacataatacctgcacatgcaacttcctgatgggatttaatggaggcttctagggtgtctctaagggtcttcggtgcatttgaggtgaggaatggagttgagttctgtcttccgtgatttcagtatttggtgcactttctgcttggaaaaatctcacctgctttaaaaatatttcccactctttgaataaccttaaaggtatcatttatgatgttttctgctttgacttttttggcctgacatttgagttctggaaaaataaactaaaagtcagctactgtttttaccttaaatttatcctttagtgtgtatttaaaataattatttgtgaaattttttagcacttcaggtttatatacctcgttgcagagaattttgctcagtatatattctgagcattttcggaatcactattgtttgtgtagtcccttacctttaaaagttcattatcagcattacacagttattggtctttgcctcctaggacctatactgtttgtactatgtgtgatgatcgtgatattgtaactattatctcttaagttcctagcagaaagaaattctgtcacagaaagaatatgtaatttgaccaatgcaaagaaataatgttattctactgtttttcggaaatgaaagaaccaagtttttaaagtagttatgtttttactataaaagattcttgggttgataggcacagcaaaccaccatggcacacgtttacctacgtaacaaacctgcacatcctgcacatgtaccctggaacttgaaataaaaaaggttcttgaagtttctggctgcctgcatgacatagtgggtttctaagttgaagggagagagagagagtgcgcaagagcgagcactggggtcaggagtgggagggaaaccttaccttgtcattactgagtttgtataaccagacacctggatcagatttcagaaagcacgtgaaataatttcaattgtaatatgaaaatgcttttaaaaaatgagataatcagtcatcctggatttgtttattctgcgaaacctggcttcgagaggtatttttggcatctgggttgcctgcctactgtgttttgttgaagcagaagggggcagcagagaaaccaactagaaagcccacatctgtgttggttccttctaacggaaggtgctgtgcaatgtaaatacactacaaggaaatgaaagtggaaagtcctatcttttatttattaaattctaaaaatgattgcaaaacattttcagataacatgattcggatttctacttgtccatttatacagatactgcgaagtggatatatttgtgtgttttgttctaagatctgacaagcaagtgtagagtggattatttgtaattcagtacagctttcagtggggcttgttttccagtagacattctatgtgtttatagaaaagcagatgctctagtgggtttttgcagttcattctaatatttataatttatccactggagtaagagtttttaaggaaaaccatttcatttcttgttaaaattcaggggagttaatgccttttgactgaattttggttttggagtcagttagcagtctaatttttttgttttatttttaaagtattgcctgtgaaaattttcccgtttgttgaaaggaacaaggtttaagctgactgattggtttcatgcccttaacctttgaaaatgtggtaattaattaaagcaatactatttttctgtaaatgatggccaagtcatgttgatgggcctggctaactagttatatgtgctatgtatgaaagctgttctatttctcattaatattctatatttcttttcctgtgattcaggacagtaagatagcatagctgagggcttctcactgaaaacctatcaggtgttttgatgtattctatgtttaagataatggacaaggtttagtggttaacaggaaactagtgcctcttttcactgacttacaagttaaaagaaggagtcattgagttatatggtatcttcctctgcaggagagccagtgaagatacagctgcagttctgttccaaatccattatgtgtgttttatattttgataaatttaatctgttgacttgtttcagccccatttcataagataagctgtgaaagaaacctcctcaatgtgatttacaaagtgagaagtgaagtgttagctgtactctactggttaggatttatagcatggtacagtatttagcagaatgtgtgtgtgtgtgtgtgtgtgtgtgtgtgtgtgtgtgtgtgtgtgtccatctcagggtgcttgaggtataggattacagttaattctttttttctttttttcttttttagacagagtttcgcccttgtcgcccaggctggagcgcagtggtatgatctcggctcactgcaacctctgcctcccaggttcaagcaattcttgtacctcagcctcccaagtagcttgggattacaggcatgtgccaccacgcccagctaatttttgtatttttagtagagatggggtttcaccatgttggccaggctgatctcgaactcctgacctcaggtgatctgcccgccttggcctccggaagtgctgggattacaggtgtgagccactacgcccagccatgattacaattaattcttattgaaagtactcagtggctcatctattatctctttccagtgctagtcatctcattctctctctgtatggtagttgttatttgatgagcactagttgtataaaagtaatatgtctgatttcttcaagaaatgtttttcttttctgtcatcagtgacctcatctatgacactggggacaactgtccagtgaaaatgcactgccgtccagtgaaaccatgctgctttttccctgcacgtgtatttgtcctcttgaagctgcgacttttgactgaatgccagatgttgttattttatctttttgggtactagctatttttgtatccctcaaattattcttgagctttttttccccctgtaacacagtgaagttatttggaaacagttttatttagtgtgtgtaggggaaggggtcttgcttttaatctttcttaggtgggaccagagcagtatttagtgtagggcaagtcactgaggcaaggctctttgggtcttctattcaataccccttgaaccttgaggttttctactctggttgatgggagcaggcagtattcgtggtcttatttgagcacctgctactgttacctctaactctttcagctggtcctgtcccagcttcaggcagtatgttcatgtgcatgggctgattagtactccgtggaatatttaaggctgaccttctgcagatttgttgatttctctccctgtacacttctttcctctctggtattctgtcctgtaaactctagccttttttggtctccctatactctcaactttgtcaccttaactcagggcctccttcaggctccgcctggcttctacttgttgtgagcgtgactggctaaggctggcttcacgggaagtaaataatttactgaaacaggtgcgagttaaaaccaagtttaggccgggtgcggaggctcacgcctgtaatcctagtactttgggaggccgaggtgggcagatcacgaggtcaagagatcgagaccagcctggccaacatggtgaaaccccgtctctactaaaaatacaaaaatgagccgggcgtggtggcgggcgcctgtaatcccaagctcctcgggaaacggaggcacaagatttgcttgaacctggtaggcagaggttgcagtgagccgagatcacaccacagcactccagcctggcgacagagtgaaacttcatctcgaaacaacaacaacaaaaacgagaacaagtttattagcgggaagcaatggccggcacagcagagaagaggctgtctgccaagaggcaggggctgaaaggaagttttctagggccatgctggaggggttatgtgcagagaggattgtgctgctggggtatatgcagagcaaggtatttgggaacaggatgttgtacaagcaggttgtttgtgattagctgtctctcagaacaattgttctcccccatcgggggctggcctcttccttgttggtgctaacttaccttgtcaggactccacaccacctaccttcattgtggtctggaagctttcttaataaattggggcagtccttttgtttatttcccagtctctcagtgattgctgcctttgttcagtatcatgaaaaaccactggatgttggtgttacacatggatgggaaggtaaatccaatttccatgattacatcctggctggacacggaaatgtctctctataaattcttaaaactgtcccctgtcagagcccatctgaaattagtgcttttctctcctcctgataatggggttctattagtgctgaaaatctaagttgtaggcttcactatgaaaaactgcacagcctccccaagaaatatcatcaccagtctgcctggtggtcttctctttctttcgcggattcctaaataggtttacagggagtgctgagaggatcgtcacacttaggcctactgagggtgactcggcacagaatgggaagtctgcagaagagtagagtgaggtggtcatttctcagcagatatgtttattgttacccacactctttttctaaaagattcgaggagtatgagatatttatgtatttatttctgaagtctgcctgtgttccagtcatgaccattcagatgctgagatacaggataagcaggaagcagatgtttctgtccacaggaacctccctgtctgtgggagaaacaaatgctgtgtaaatagaaagtgataatacgacgtgataaactacggctttcccattcaaggactttagaagatactctcttttcctccttgtaccattttaacaaaagcagcacagcactataccgatgcctttttatactttgcgttacttggtgaaaatgaagttctctattttatctgtcagcaaacatctaagagcaaaaattatttgaaacctttgttcttaccaagactaactttatcttcatgtggcacattttagtaatttacctagtttgtagccatctaactagaatttgctgattgtttatgtatttcttcagattgctgatagattttattctaataagcgaaaagcaattctaagccttgatccttaaaaggtatatttcccttggcagcaattctagtggaaacaatgggtagtctctttttattaaattttatttatttatttatttatttatttatttatttatttatttattttttgagacagagtcttactctgttgcccaggctggagggcagtggcgtgatctcggctcactgcaagctccgcctcctgggttcaagcgattctcctgcctcagcctcctgagtatctgagattacaggctcataccaccacacctggctaacttttttgtatttttagtagagttggggtttcaccatgttggccaggctggtctcgaactcctggcctcatgatccgcctgccacagcctcccaaagtgctgggattacaggcgtgagccactgtgccccgcctaaatttattctatttgtatgaaataactctaaaaatttggtcttcattagtgtttttacttatacttcaagatgctgaattatttctgtgtaaatatattggcatttctgttctataagacagcattaaatgaaatagtttcgtttcttttccaagtatatttttaaaagtacattagtgtagcctattttttatttttttgctttgtcttttgatagtgaaacaaaatactactattctaagcttgggttttcaaaatacacattattcacggtgtaaattctgcagtagccttgtattgtagcatatgaaggaggaaaaattggatccatttagctctgatcccttttttgttagcaatttatgtgtataaccaacagatttctccttaagaaaacctcattattaagctaacttagggaaatttagtaaagaaatgatttggaggaaagcaaataaagtaatccaaatatacaataattataccaaaattttaacatcgatttataagaatatcttaccacttttaaatttcttccaaaattgacagatactgatttttttcattaactgtcagtggaaatcctatgggagacagctcaaattttgacagcttcaagaaaatggatggcttctccttctgtgtggtaattgatcttaccttttgaagaattagctcataagtatagatttggagagagttacaatatgcaatacagccttcctcttttgaaaataagtcagtcattctgtgaactgaagacttcagcatgaagaaggttgctctgaagggcagagtatataatattatttggttgcgacttttgctagcttggtggctcttgagaaatctttagtgaacttgccagtttcatgtttgtagggggtatgcatctatccaggataatcatcccccattgaaaaactaaccttttcaaggttaagtataatgtgaaacaaataatattgctccagaatgaatttctgtgcagtttgtatgaattaacagctggctaataagaagctcttgaagtctatcataagcaaggtcttgtattagccatagactgagcagacctattgctgcctctaccgtttacctcacatggtgaagtagtctgggaaaaagcagtgtcactgttccactccagatagctgtcattatggtattacataaactagcagactgctgtgggacgcaaaggggatgtgcaccgttttggttatttgaggggactttggcatgcccttgtaggagcccagaaggaaggatcatacagtttagtcttaagctgtgcaaaaacatgaccacatgaatgaaaccagtcttcctgaggccagagggcttataaagaggaaagatacacaccttgagtagacttctttttgagcaaggatatccagaagtagagtgttaaggcaaagcaaaagattctttagactgcactcaagtctgtctttataggcatttcttgcttgtgtagcatggaaaggaccactgcttgctcagtgtggcttttttttctgctatgctggaccatgtaagtagccattgagataatttattcctgagtcaaaataagagggcattaaatttagtagaactgaagttggcactggctagactgattactatgatgggatcccttggagagcatcactggtgaaagcacctggattctatttagaaaaacttaagtatgtaagttgccttctttgggggatgaaacttataatgaactattgtagagggtatgaaagcccacggcatgtttctatcatatactatatatatatatgctatactaagatgttatgcatgggtcagggtccttggtaaggctcacctgtcatttcttatgtagtttatatttgtttctctttgcgcaaggatttggtgagttatcttatggacaatgaaaggagaaatgtcctaatgcagagttcgctcctaagtttaaatgagaaatatctaaaatcctaaaccatgaacatggttcatggtttagaacccttaaaatggaattacagtacttttaaattggtaggtgtaaggaacatggctgcactgcagccaggcaggatgggctgaggtaaacatcccgggtgactcagcaagtctgtagcgcaggcgcgcaactccatgtgtaatataaacagctatgtagccataacatgggagggccatcacttggctctttgccactgttgtctttaaaaggtataattgccctggtgacactgtgcaggcgtgcttgcacccaaagaaagagagagagcaccagatctgtctgtcttgcagcggggagccaggacacagctcagcttgcttgcgctcagagggaaagagttaagctgttgaccccaaagggagagagagccagcagagatctgtgcttgggagtggctggaacaagcagccgagacacacagtgtaagagagctgctgaataaaattgtatttcacctacccgtagccccctgagtgttctttcagctgtctgccattcatctacccactcccttccggcctcagcatgggctggaacctgaccctggacctaacaatggggatcttagggacttaagagatcatctaaatgaactctttacagatgaagagactgaatccccaatggttaaatgacttgtctaagtccacacatctagttagacgctgagccaagacagaacctgatttctggtttctagatgtgcaccccttactcagtggcatgtactgtaattcacagtttccattcacttgttgccaaggtctgccacttccgagagtttcacagttttggtgtaagtgtacattgccaaatgagaaatagcttggaaatataactgaagagacattatctgttgtgactgcagctgaagcaccaacttttaaccagtattagcactgcttatttcagctcctatccttatctcaaataattctgccttcctataacacatgatggggacccctgggagccgccaaaaaggacacttactctgaggtcttgcccaggtctctgcttcttcctccttgttcccagatggcaaacggacatcctcatagtaagactgggctgctttccacctgcgcagccccatggtaagcacctgcagctccagagggaatttattttagtaaaacaaacaaacctggagaccaggagatcaattatcagtagtttggtaataattgaaaactaggtcagaggcttctattcctttttccatgagagctggatatgtgaggttgttcttgatgaaagctgaatttttaaatgcaggttaatggctttcttggaagccagcaagcaattaaggttttctcatccatgcagaaattacagctgcagggggcaatttttaaaaattcctttggattcttagaacatactatatttatttattttcccttaaattctgaccttaagcttaaaaataagtttgttaatactaacgttgttttcccttgagctagctttgaacctcaaatgaattgcaaactgcgaagtgactgctgtagggctactcttcagtaagctggtccagttatatggtaatgaatccatttataaaaaaaattgtatgtgagctgtttccaaggctattatagtatttctttatcagactatacataattttacgtttgtaacatggtacagttccaactgaataggcagtaattttctttattagagttgcattttagagtggttcattcatcagatttttatcaaatatattcttcgtgtcattcattgtgataggttctggaatatgattaagaaatggtccctgaactccaggggctcacagtctaggaagaaaaaagacaaataaaattataccaatataatgaatgcagttccatggcatatgaagagtgttatagaaacacagagcaaagatgtaaccctacctagtgtcaaagaagactacacagaagatggtgcattagaaggaagagaaagaattggctgcaccaacaggaggaggggaaaggaccttctgagaaagagaagagtgtgtgcaaagcagtggaggcctcagggaggatggtggtctgctaatactgagtttagtgtggttgtctttgtcttacgttgcttgcagggaataaagctagtatttgctttgctagctggactgagctgggctatactaagttgtctgacctttatcccgtacacaacaggaactacaggaggttttcaagaaagggagtgaagtcagattcatagttgagaaaaacattctagtaactaagtggtgaatagaatgaagaatgggagcactgattggaaagcatttataatagacggtggagggcaagttttaggaagcaggcagtgattgtgatgtcagaatcaatttgtatgatatttaaatagtccacccggaactcagtaaagcaaagattgttgaagagggtgagcttgagagactggatggatgttgataacattaattgtgtgagggtgtgatctctttgctgagattttaagtacggtaattttctgatgtgatacctgtattcatagcgtaacctgtgaccctatttggatagcccttatgcctctgtattatgattgtcagtcacttccctgaactataaacttcttgaggtcagagataagttttagtggttcttgttccacagcctctgacacagggcttagttatgtaataggtgcttggtagattttggatgtttagacgtggatgcatcagccatctacttaagaattcctctttcgaattcttcctttgcacaagaagacctttgtttcttaacccaaagaagacgagctctgtaagtccgttataattttcattttatggccaagtttctctggactttcattttccagaaactacctatcttagattttgctctttccttagtgacaactcagtaaagttcctattgttcagagattacatgatgaagtagatatatacatgtgtgttttttcttctttaagtttggctatttgaacctgtggctctgtggtgtaaacagtaattcctttccagatttatttatttggaagtttttgggtctttaaaaattactcctgtgtttctggtcttgagttaaatccacttataattgccctaggggttcccatggcatcagcacagctggaggtctggtgggcttttgtaaatggcatttggaagagtgattcatttgccaaagcattagcaatcttttgtattgtttccatgtggtttttgtctaaagagacaagtgctgggattttatttatttaataaactttgtttgaatgagctaatttccccactgtccagaattactaagggaagacctgagcatttatttcaaggacttattctatccattccttgcttcagtggggagcagtcacttctgtagccaccaactacctgatagtctagtcttttctgtgattaaattataaaaataatctctttgtgaacttgtctgcttttggtataaggtcgcatatttaaagagcaatctgtgatgagatatgttggcttcattttctgtttgttttctaaagaaaggaaaaatagatacatttccatttcaaaattctttttttttttctttttttgcgatggaatcttgctctgtcacccaggctggagtgcagtggcgcaatctcggctcactgcaagctccgcctcccaggttcacaccattctcctgcctcaacctcccgagtagctgggactacaggcgcctgccaccacgcctggctaattttttgtatttttagtagagacggggtttcaccgtggtctcgatctcctgaccttgtgatccgcccgcctcagcctcccaaagtgctgggattacaggcgtgagccaccgtgcccggccttcaaaattctttttaagagcctattatatgcccaactcttgtattactttctcttttttcacgttcacaccaaccctacttgagagctgtttttctcctcactttgctgttgagaacagtgtttcggagagtttaaggaatctatacaagtcccttagtagttcatatcagaggttgttttacacccaggttttctgtcataagacagaagctttgaaactgcctccattgtccccatggctccacataggccagagggcttccagatgctgataacattgatgaagagggaaggtcagagactagacctcagttggaagctgtggcagttgtgctgtgaaaacccaccagagggaagagacgtttcaattcttctttcataaccacggaaatcctaagtgacttgtggcacctcggtatattaggacttctcatttcagaaagttaatggtcttctctcctctctgtcagtgtgatgtatgtaaccactgattagctgactcatttgttcagttggcagatacagaggcgatcagtttactcgccttgctgtttaaaaatcatgataattttgcactccctttgagaaatgggtaagttcagaaatcagttttgggactatctttatttaactaaggcataagtgactgcaccttcagcaaatttaattcctggcttcagactgcagtaatcttaaatgagacattttgttgtatgcttataacctcagggattttatctgctgccgtcgtggtcttttgaggaggattctcctgttgcaaaggatgtctacaatgtaatgaatggcaagaagtatcaggagtattttgagtgcttaaacccatccgaggtttattaattttccggatatgggttaacatggttccatgaataggcacaaggcctagagagtaggattaggaaggtttccagggattctgaactcatgtcaagcaaaactggcatgctgggcagctaagtcaactgaatagggaaaagactttgaaagtgctttatctcactgcataatgtttgtcaatttcattcaattaatttacagctgcagggctcatgaggctgaaattaaagttttgtaaagtttcgataaggaggcagccaaacaagtttgattagcagtggatgttttggaaatgagttggcagccatgcaaaaatagagggtttgaatttcaggaggcacgttggcatggcagtgcccatttgattaaccgtggaaagcccattactttccacctggcatttcgggcatttcttttctctgtgtgtcttctctgaggtaacctctaacattggaataaacatctttttagttaagtctcatcagcccattgttcttagtctgttttattagcaataaatccgttgtctgtgttattctttctacagccatacaacatgctctttagtctttctttccaaattgtagacatttcagtaaggtgtttctccctctgcaggttggggcagcacagggcctttcacttggagttcaggagttgagttgtatgagttgtggctgaagggtcacagacaagggggcacagcaccttttcacataatatttagcaggctagagtctgtacaataacattgatcattgttcatttttagtgctttttttttggtgaaataaaacatgaccctaatcctcaacaggaaaatttcatcctcctaaacgggatttggtgctgacaaagattctttgcttttctaaactttagtcaggttcctgaactctgtccccaccagggcccatctgtgcattttagcaaggaccctgctaagtcaatttagccagaaccccagtccttcatatctgatcagtctcagtgtctgatcggcttcctcatcccccatcgggtgatgtgtcatcatcttggcctgtctttggcaagaatcctgttaggatggtgtggccagaatgtcctcttacctgtgattttgcctcttaataatttttcattcaccgactgccaccctcctctttggctataaattcccacttgccgatgctgtgtttggattcagcctggggtcttgactgagatctctttccccctgttgctgtagtcctgataaaaaatattttcattgctctgctctccagctctgcttttcctttgacagtagcctatttaaaaaatgatataggagcaggagggggaacgcaagggttggggaaggacatagaggtggtttcaactgtatctataattttttttttatcatggggaggaaaggtctcaagcgaatatggaaggtaaacatgaggaaattggttctggtacactggagtttcttattttactccctttgctttttaaactgtctcgcgaaaggcttgtgttatttttccccccatttccagtctgtcccagacgaatatcgtcctattgcaacatgaccagcctgcagctcttgccccatgtgtcacttttatacacaagttcgacaagacccgaaccagccagtaccttctcccaggagacgagcccactcagcctgcattttgatggatcagccgtgtcacattgctgtagaaatttctaaatacttattctttttattttgtttcttatttcacagtggatccacaacagtctctggtgaacagcatgctctgagtagcaccgttctagtctttgtataccagggatgtttcacagtaaatgtttaaatcattttggacatatttatgttttcaaagtattttatgttaactcatttacccagttctgcatattcgctcttacaagtgggtgattcttttattccacaaatttatctccatcttggagctttgttaggtgctcctgaaaattcagtggtaagacttgttcttgccttatctcagccagtgaatattcaaagatgtgtaattcatagacttttctttcaaaggagctcccattttagagtggagctagaactaatagtttgtgttccataccaggcgtataagataaatgctacagaaaccctgaaaagagtcatgatttgtaattgggcaggttgaaaggttttatagaagaatggcccatctgaacaaggttttcttcaaggatgagtagggagttttcagggtgacagagggataaagtcaaaggaaaaaagcatgagcacaaatgaggagagatggcacacagcacctgctgagaagtgatcagcagatgggtgggttctagaatgcacccagggaggtgaggttagaaaggtagaatgaagcaagacagtataaggctttgattttcacactaataattttgagctttttcttattcacatgagaagattttaaggcatgatcagttttggttagagcccaggcgcataaagagtgggttatgaaagggagagactagaaggggagagattagttaagaggttgtcaaaacagtctaaataagagatgataacgacctcaactatagcagtggctctgggaatttagaggagggaataaatctgagggctgtctcagaggtgaaagtgaatgagtggggtttgggaagagatggggggccaggtgaggagcacgagcttttttttttttctttttacatggacaaactgaatcacagggagggacatgttttcctgtggatgaagatacagataatttttgcatccaagaggagagagaagcatcactctcgatagccttaatattctgttctcaaaataatcaacattatttcaggaatgagagtataagaaataaaattaaggacagtgggaaaatataaatttgtcttggggaatgtgatggggccttctgtattataacagctagaatcttgactgacagttttctgatatagacctttagttctcatgtttgaactccctatattcatttgttcattcttcaatatttattgacagcttaccttgtaagaatcattgtattatgagttgtggatagaaatacaagacataaatcctgccctcaggtagctcacgttttaaagtggaggacaggcacttaaatacagcagtgtggttggagtggataggctcacaggagccgtagcaaaattagcaaatcttgctgagaatgtggggccatgaatgtcagtgaaggagaatagtttttgttttttgttttgatagagacagggtccccttctgttacccaggctggggtgcacttgtatgatcatagctcactgctgctttaaacacttgggtttaataccacctcagcctccggagtaggtaggattattattattattattttttttttttttgagagccaaggtctcactttgttggccaggccagtctccaactcatggcctcaagcaatcctcctgcctcagcctcccaaagcactgggattacaggtgtgagccaccatgcctggcctagaatactgttaggagatgagaacgtgctagccggtgaaaacaagagagacattccaagaagggactgtagggtttagaggaagagatggctggggccagattctcagaggctgggttctatatggcatgtgagaatttgtggttgagtgagaaagagaggaacagcgattaaagggtttaccctttaatggagaagtaagcaaccaaatggagtttcagtgggattgtgctggccattatggagaaggggatctgagatgtagagaagaagggagacacctgagagacggtgcagtggttcaggtgagaaatatttggaatctgaactagagcagcaatattggggacagactaaagagttaataaatagaaagtaaaattggtaggacatcgaggtggattcaagtcagaaagtaggagagaggcaaggagttcgaggtgacacaggttcaagcttgagctacgtacatagtggaagcattgctaagagcctgtgcgtgctgggaagaaggatgatgagttcagctccagaaaccatatgaggtgcctggagatctttagcaggcagttatgtactcagatgcaaaggtctgtggagaaattaaagccggatagaactttgggaatcatcagcatttaggaatagattgttaaaatggataatggaggtatttacgtaggccgaacaaagagaatttcaaacacctgcatcctgtttaattcttcagtttaaatttaccaacaaacataaaaggtaggagattgggctgctttcagggcattgagctcaaaagacagaaagaggcaatttatgtgtcacttaatgtttatcttacgcttgcctaccgggaagagtgaaaagatgttaaagaaaaagagggaatcttttcattccttgaactgttgtgttgaataaattttaaagaaaaagaagcaaaatgaaataacttgagaacaagaacctaaccgcatatgaacataatttacatgccataaaataccattttcaatgtacaattaaatgatttttataaaatttacataagccatattttttaaagtattaaaagacagttatgagctaagcttttaagtacagtgatgattgagagtgtgataaaaatactgcaggtagcatttaattagggaaattcctgccagttgaaagatgtggatggggattggcagagattgaaggaacagccattttgtgccagacactctgctggaagaggagcagataaacgggcgagtctgggagcattttaagcagcatttaaaggataataaggtcctgtcttcactaagccattgacatgaatgtgatacttttatatttgtttctgttttctgactttagccctaggaaaataaagggtcatactagcattgcagttattttctcacataaaaaattatatttggctgcttctaattggaagtatctattttaagctcaactaaccctaacatctcaggtaactgtggacagaacttcacatattataagcgtcttactctgtaaaaaaaaaaaaaaaaaaaaaaaaaaaaacaaaaaacccctaaaaatacatattactagtgatgtattcatttaaacaagctatgacgatttatctagtttctggaagatactgaaacttgatcatttctttgctgcagtgacctacagcataagttaaatggtagttttagttgattatgctttattttattttgttttttaagtcaaagcctgtttttctccatgataatatcctcctcatggtaagactgcatggacaagaagttgcatagagaatagagtgttcgtgggatctttctataacttgtaagcaaaggaggctttgggtttgctgtggatcgtcctctggagagtcgcattcattttctcagaggagctctgtcccaggatgctcaggaatataaaaaataaaagtgcaaaaggaaagaggacgtggcagagccgaccttttccaactctgagggtgaatatcttctgtcttgggaggatggtgacaagcttggacttggaaccagaaccctggtctcttgagccatgtttgtccagtcctgagcgtcagcaagcagtcagggaggagggaaagcaagggttgcaggcagatctgtggaaaaagtgagctttggtatgagttgacataggcattgcctgttggtgtggtaattgcccagtggagacgtccacaggccttggagtgactcctgagtggggccatctgactcgtcatgctgccaggcagcggcaggtcacagttgacatgttttcccatttcttcactacctacctggcttttccacaaaaatgaactcccttttaatcatcatttctgcagtctatttagagagtatgaaaagcttatactaatctaaaataaacttttttttgttttaatgcgttgaagtcttgctctgtcaccaggctagagtgcaatggcgcaaccatagctcaccacggccttgaactcctgggctcaagggatcctcttacctcagcctccaaagtagctgggactaccagcatgagccatcatgcctgtcttcccaatctatgtattagtgccagtaaaacaattaagaagagtgaatatattagataaatatatcctagcacattccgaagatgaatagaatttattatgattttaaatcgcccactccagtttttcctttggcacggagaactgaaagctgcatatcagtgctgggctgtccataaatacttactagtcattgtactgttaacagttatttaatgatttaatcagaaaagactggctttggatttctgatgaggtaatgagaattggcatttaaccagttaattggaattggaaagagctattaaaaggccatgagaaggtctttcatgaaacccttgaatatgcttcagtctgaagatcttattaaattatgccaagggtgttttttttccctttcactttaaatcacccgttaggatcatctcatcagcttcctgaatgttgctgcagatgaaattattattgacatcataatgttggaattttaattttttctctccagttgtcagtgaatccagtgttcaacaatcactagtttttcttagccccattgggaccaaacccaaactagtcttaaattttatttgcacctttttgggtttgaagcttgattgttcgggatattggtgacagtgctaggactcagtgtcagtcattgttccattgcctattgaggacatagttctacttcttttggacagacagccttgctttattcaagcgtcccatggaaatcagtttgttgccacagagaagcagatgggtagatagaatggtcaaattttgctgtcccttcactaataacttagagaactgtttattcacagccggccatgaaacaaagtaaatgtttgtttcaaaatacgtatcaaattgaatattattctgaagaaacaacttgcccgataggcccgacacaaactggctattaccatttattttcaacttatcagtctgatacaaccaaagagattaaatctgatagttgaaaactattgtaggtctctagcattatttaaagatggagactggttagaagaggttggctggaaaagggtgggagaaaagcaaaataggaaatgttttgttccttttatgaccaaaaattctactattcccagagatagcctagaagtagtttggcaaatgacattttagttatttttggagctgcttttcaatattttaacatgtgtttatgtgtaagcctgaaaggattacaaatgtgtgtgtgtgagtgtatatacatgtacatataactacacatatctttctttatataataattatgtttttgaaaagttgagtataataaaatacttacaatctaaataccattttaataggacaagggaagctgactttctaaatacaatgtcacattctaagtgatgaacataattttgttaatgtaaaatttagaacagtatagataaagtgtgtcactcagcctcaaaaaagttctaagattttgtcatcttcatacatttattttgtaaatgaaataaaatattccagggaaatttgaaaaaagattttttaaaaattaaataatagctccttgtttattggctttaaatatttaaacattcaaattgtagcctttttctaaatgcacaaaatacaaaatattttctcctaaagtccatgaatggtgccttttggcctctctgaaccctcttcacacagcaggatttcgaacgtgtgctggacaccaggaaactcatgtcattcccgcagggctttggatttaggactttcttagattgacagggaccgaatatttgaaataaactattgacatgcaagaggcagattaatgtgaaggttagtagttttggagctaattccatcatctttcttgttcttgatttgcatgtgtgcattgaattatgttgtctttttgggtgcgggtatagatatagttttacccaattgatcattaacttttttgagggcatctatttgtatcttgtttatcttgatggaaataaaatataaaaatcagtttagtggtaatttttaaataattagacacaggaaggaagaacagggttgcaacaaaaacactacgacaaaactaaggatggtggaaaagcaagaaggtaaatttaatgtagacgggtgtctgtaaaatataattgaaactaaacttctgacaccacataattttaatcacagaaatatacttgggaaggaaataaattctcaaagaaaaccaactagatttaagattgtcactaaggaaggctgatgcaggtgccacacaaagtgatttaggtctagggccccggacactcctctacatcatattgatatgataggtagcaggtagatatccaagtctgagttggtcacgaagcagaaggtattgtgtgacttctcaggcagtggtacagccctctcggtgaaagtactggttggaaactggggtgggattgtgggggttggaaattaaaggttggaacaaaggaatgagaggttttggacaggtctatctgagaactctggagtactacagagcttttgcttttccagctaactctgaccaagccaatatagttcgtatacgcatattggcaaccactggtgacctttattacatggaaaacattttggcctgggaaagatgggtaggctctctctcctggaaccttgtctgagctggaaccatctcggcatcctgctgcttgccacatacttctgactttgctatcccttcagacggttgaattcacccagagtgaggcatagaacagggaatcagcatagtttgtaaccccctccctatttattgttttcttaatgtgtgccaagcactgacctcctcaggcttggtgcaagttaaggaaacaataaatgtaaagggaatggattgctgtgaagtctgttcctggggagaaaacatgagatcagaatgacgtttctttgtctgaacaactatatttttcacgtgttttgtgcattttccaaatatttaagaatccaagaaatactttgtaatgaaagaatttttaatgaccctatgcagaaactgtaaattgcatgtctatgttgtgagtttcttactggattatagattactggattatgtaggagaaaatggaatgagcacctacaaatcaacaacttggataaataatatctagaaactagcagggactcatcatttcattgtctttggtaagatggacagatcatttggtggttgttgcacatgtcttttcccataaactgtacttgttgtcacgtaactggaattagagttacaatgataaccatttgttacaatgataaacatttgttacaatcataaccatttgcaagaaccgtgaatccttttattcaacaaaagttagttctggtatctttttcatatacattgcctgaggctcagaattgcaatgtattctagttaggtctttgtgtttaggctcccaagtacccgtattaatcagaacatctaaaaagcattcccataagtacaatggactgagattgccaggtgtctgatgtagtgcaaagattattgctgtttaaaagattttgacctcagagcttcattcttcccatcgtcataattttctgagcgctgaggcattgcagatcttgtctttctgtttattcagctatactttttgccagcaaagaggcctgaacaagtaggtaatgagactgtctacacagaggttctgcgagcccacagctgcccactggcaagacccgtttaggattaatatttcagatcatctattctgcttgctctgagattgatgcgcaagacacaaagcaacctctagacacttcagctaagaataggtattaagcgtgaatgcatttgcatatttggtggcaacctattctacattcttccttaacatttttttcttgtttattaaacagaggatgcttttgcttacctctcaactgcagaaaaggtactgtttgatatatatcggttttatttactctgttctcacagaattgcacgtgtgctgttcatgggggaaatattttatgtaatttccaataaatattgaagaaaatactataatcatggcttgatagaaggtgtctttgtatggatatttcaagggagttttagtaatggccctgctctatgaaaaataggagttgaagttgatgttcaggccatttctcctttatttactgttcttgtatttttttgacacagggtcttgcctgttgcttaggctggggtgtaatgacataatcacggatccctgcagcctcaagctcctgagctcaggcgatgctcctgccttggcttcctgagtagctgggactgtggcacgtgccgccatgctaggcttagttttgagtttttgtacagacagagtctcactgtgttgctcgggctgcttttctcctttgaaagaaagcagctgggtttaaggcctggttatggcttgattgatttgactggtgtttttgatgtcagcctgccctttccttgtgtcttttactggttaactcccacagatgcatcagtcccaagctcagatgtccaggttttgtgcagtcttctttgaatcctttagacatgatttgtcttcctaatctgtgctcccaaagaagcttgtctgcaccttatcgttgcatattacatttgcgtgctgactcctctgctgtgttgtttgcccctgtgtgcactcacttctgcccttggagtgcctagcacattatctggcatacagtataagttcgataagttatttgttaaattaatgattgagtagctatgaagagatacgaaatggccatgggctccttcccctttctcctggacagtcttaactcctgtttcgaattgttttgcttcctgtgaaggaaagaagtatgaagttgtatttgtgctagccacccgcaagcccatggtgtggggagagacagacaaacacattccagtgctgggcatcattgatgcgatgatatgtgcacggggctttggaagcccagaagaggagcctgcagttcagctgaggggaccagagaaggctgtttgaagaagatggtgcccgagcagaagaggatcaagacgtcactgggaggggcagagggtctaatagagataccaatgcggggcttgccgtaaacactcagggccacagaagaggaaagtccgccatggagggagggaatggcaaggaggcaaactggagagaggctccgagatacgctcagcagatttagatgcaggttagatatgaaaagtgggaactgtgatgtgtgttaggtttgttatgatactgatttctggtatttctggagggacattagccgtgaagaaatgaagtatggctcatgtgatatgtcactttaaaatcctgagggacagccaggagtgatcctgtgcgttttgctatagaaaaagcagtggctctggacctttgtgtatctgcctgggcattgaacggcaattctttgaccttgttacaacccagagggctttaaaagtctggaaagttatggactgttggtggcgaggcgggggacatgctctctggaagatcagtctgagagagccccaagtatccagatacactaagtcataatgatacaaaacttaaatcctgtagtctttcacagcaggcggaagtgcaaggactgggcttatggttcagtcctctcttctaagtttaagaaagttacttaacctatcagagccctcctagggtagtatactgctgggtagactgctgtgtttcccacacggagttggtgtgtggattaaaggacgcagtgtatggaaagtccccggcacaggacctggcacatgaggtacctttccctgtctttgttagtttcagtgtaacattatcaccagccctcatggtagtgttttttcctttgattagaaataacatgaatatcacaaacactgcatcatcttggtggtctcccgcaggcagctgcccccatgacagcggctggagtagtccttgtagtgagaatacagctgtgttcctaggacatgttcggccccacctcccttatggccaagtgggtttttggtagttagacacagctctgcccctgtccgcataggggatatatgcaggatagtgaaacacacgctacaccgacttctagtaaaccaggaatttgtatgggctgtgtggttctgtttctaaaaaagtatttggcgggtaagaaggggactgccaatgaatgggattgtttttatatattaaatgtatccaaatatgcacagaaccctttgttaccattttaaaattttatcttctgctaatagaatttctattggaattaaaaaaaaataaactgaaaaattattactctgaggttttgttatcaagttttaggaacttaaatcattttcaatttattagttttattgatacataataattgtacgtaataattatatttttgtacccattaagtaagctctcttcatcccccactactgttcgcagccgctgataaccacccctctactctctacctcaaattgttttagctcccacatgtgagtgagaacataacatatttgcctttctgtgcctggattatttcacttaacataatgtcctccaggcttatccatgttgctgcaaatgacaggactttattcttttttatggctgagtaatattccaccacacatatatgcattatattttctttatgcatttatctgttgatgggcacaggttggttacgtatcttgactgttgtgaatagtgctgtgataaacatgagagtgcaggtatctctttgaggcactgagttcctttcttttggatacatacccacctgtgagattgctgggtcacgtggtagttctagttttagtttttcactgaacattcataatgttttcttttgcataacagctcaactaatttacattctcaccaacaggatatgagagttcccccttctctacatccttgcaagcatctgttctttttcgtcttttttaaaatggccattttaactggggtgagatgatatctcattatggttttgatttgcatttcataatgattaatgatgttgagaattttttcatatatgtgttgggcatttgtcttctgaaaaatgtctattcagtttattcagttaatttgcccattttttgttttttttttcctgcttttggtggtttttttgctattgagttgagttccttatatagtctcattattaatcacttgtcagatggagagtttgcaaatatcttctcccattctgtctctttactctgttgattgttttgtttgctatgcaaaagctttttagcttgatataatctcatttgtctatttttggttttgttacctgtgcttttgtggtcttctcaaaagacatctttgccgggccaataccctgaagcatttctccaatgttttcttctagtagcttcatagctttgggttgtacatttgtccttgatccattttgattggatttttgtatgtggtgagaggtggggtctacttgcattcttctatatatggatatccagttttctcagcaccgtttattgatgagggtgtccttaccccaatgtatgttcttggtgcctttgtcaaaaatgggttgaccgtaaatgtgcagatttgtttttggattctctgttctattccactggcctatttgccagtttttatgagaagcgtgacattttttaatgtacaggatggttttccaagaatggaaataggtttatttctagttctcctgtggtttcctcttttctgatgggtcttgggtaatttcgaacagcaatttaaatttgcactgtgcatgtaagaattttgaaatcatttcagcattttttcctcacttctttggaaaaaataagcacttaaaatgaccctcagcctgaaaaagtaagattatgccttataattaatcagattttatcaaaagtgaagtataataccacatacatggcctttagtctaaattgacttttttcttaaagtaagatttgaatggataacagaatcttatataatatttattagtaaaagctacatatactttttaaaaaaaaattgtgttaaatgactagaggacatatccagatttctgtgtctatgattattaacagttttgttggtgatcagcagtgataatgtggttaagacacctattttcttgtctgttttgaattcatgcccaatagaaaggctataggtattattaaacgtttatataaaaaacctttgagtttaaagttgaaagtagcattggaaacacaaagttgatattcctgatgcagagttagcaccatgctaatcactcatacctgtcggcactatatttagctcattgagctcacatatttccaagaactactaggatttcaagtgaagcttcagtcatacacagacattgtctaaaccacgcaagtatgtgtttaaaagaactgcctgtcagtgtgcagtggtaatgccagagcacaaatcaatagcatattctccttgaccactggagaacaccacagccaaatttaaagcacattttccctggatgagtccagaaccgacttcagttcttttttttttttttttgtgctgaggtttaataggcagaagaataaagaaaaccagctctctctctatagagaggggtcttccgagtggaaaagacaggaggtatggtgggtgcagacaggaaaggaggaaactacataggaaagttggaatcctgttgcccacaacccatccagcggtggaggctggggtcagtccaggagggtttgggtaatactgggcggtagccccagccagaaatcctcagttgctccagaacctcttccagcttcaagcgatggctaagtccttcatgaaaggaagcttgttcacacgtggccaacatgcccagcaacccatgggtgctgggagattctccatgttttccccagtacgcctggcatcccagtctttgaacagcagccgtgctaaccgcgtttctaactggctgacggatgcctgttactgatttgatatggttctaacatttaggccgagagccttgaaatgaaagggcagagttggagtccgttcctctgctcaccatttcggtgactgctgtaccttggtttccccgacgaggttcccagtatgaagtggctacgttgtctggggtacgtacctgggcttcgtcatttcgcgtcagcaaaatttaggacatgaacacacaagaggagtttagaagcggagttaagaggcaaaagaaaagagaaagagccgggtgtggtagctcatgcctgtaatcccagcgctttgggaggcggagggcgggtgtatcctgaggtcaggagttcgagaccagcctgaccaacatagcaaaaccccatctctactaaaaatacaaaaattagccagatgtggtggggcacgcccatgatcccagctactcaggaggctgaggcaggagaaccacttgaacctgggagatgggggttgcagcagacagagatccagccactgcattccatcctgggtgatagagctagactccatctaaaaaaaaaaaaaagagagagagaaagaaaaacagctctctctctttctctatagagagaggagtcttccaagtggagaagacccaatttcagttcttggtggagatcaggattttgttcaaacagaagatggtgttctctctgtttcttccatgcccatttaatgaccaacgttcagctgtcactgaagggctaaaagagagaagctcttatatgtgattattttgacttaatttttctggaactggtttctttctctgttaggacatactgggtgcttatgcaaggattatgtatgttggacagtttggccattcatatatacctttgtagaatttttctgtatcttttcttttgtactctagtattttaatatattttgtcattttgcaatttaagcctgggtctgagacagtttcaccttattcttaataatgctagataattccatatccactaatagaaagaaagggaatttgtgatggtgactgctttggtaccaagaggacagagggagaaaaagaacagagaaaaactgactggattcttctagtgccagccagtggaaaatggaaagaaaatttctccatacccacatttcccccaaatctcccttgtaaaaacacccctcccccagaaaaaaaaaaaaaaagcaaactaccaatttcagacataggttttaaatgcagcatcatgaaaactgagcaatttggagggcgagaaaacatgtgagtggctggcatttggggtaggaacagccggtaaaggtctaaaagttttgtctactcatctcctgttcataccatcatgagataaaggggcagttttctacccgagacttttggttgagtagttgaaaacttgttttcatggtgtgcaaaagaaatataacatgaaaatctggatcaagtgaaatagaaatatttttagaaaccaaaatcttcaacaagcttctgtgaaggtttgtgaagattcatatgttcctttctcacggtcttaaaggagcaactgaagtgatttcaggaatctaagctattctggctcgaaatagggatgggttggatatgcacctttcccaaaataattcactgcatctaaaatttataattaaaatagttcttaggaaatataataacatgaagtgctactcatggacatggaaaatgtaactcatgcctaatgttttggttataggagaaagaatgttccagggaaatgtcatctttatgtattgaattttctaaaagtagggtcgagtggctgggcttagtggctcacacatgtaatcccagcgctttgggaggctgaggcgggaggattacttgagcccaggagtttgagaccagcctgggcaacatggtgagaccccatctctacaaaaaagtacaaaaattagctgggcatggtggtgcatgcctgtggtcccaggtacttgggaggttgaggtaggaggatctcttgaacccaggaggccacagtgagccgtgtttacgccactgcactccagcctgagtgacagtgcagtaccctgtctcaaaaaataaaagatcatctcaaataaatataaggtcaagtaattacctacacaataatcaatgaattcaaagcctctgaaactaaaaatgtagctaaaacttttctggatataaaatatatatgtgtgtgtatgtacacataaatttcataaagataaaaacatttgccatcttcctatacaaattataagctgtctgaaattattagaaggggatgtaatataggaagtgtattgtgacaaagctaatttttcaaacttttggggatattgtactgaaaacaaaaataagcactaatcaatgtcctcagacttacctctaggataaaataaaattttagttggactacttcatggaatttccctcattactcttaacttttttttttctttgagacggagtctcgccctgtcgcccaggctggagtgcagtggcatgatctcggctcactgcaagctccgcctcctgggttcacgccattctcctgcctcagcctcccgagtagctgggactacaggcgcctgtcaccacgcccggctaatttttttgtatttttagtagagacggggtttcaccgtgttagccaggatggtctcgatctcctgacctcatgatccgcccgcctcagcctcccaaagtgctgggattacaggcgtgattactcttaacttttaagccgggagaaatgggaaattgagaactcctgaatagagagagagagaaagaaagagaaagaaggagagagggagagagagagagaaagagagagagagtgtgtgtgtgtccttgttttgatgcgcttttacctgggttacctttccgtgacagttctgagctttgtcacatgggtgtttcctgctcataagtgcatggcgctcgctgtagatagggacagtctacactggaggtttcagaagttaaaccaattcatgagtcaaaggggctcacagaggacgaagagcatctcatttattctaaacaagtgattgctcttttttttccttattagtgagatgtatgttttttcaataaaagcttagttagaaagtcattgtgcaactagataaaaataataattttctatgtttacatataaagatttgcttgctatgatgtagttggttagagttgggaggcggtttggttaacagttggagtactgaggacgggtttcagtccgcgtaagtcttcatgtagaatctagagggggccttgtcagtggtgctttatctaaagccgtaatgacagcagtgttggaattctgctttgcaaattgtgtttgttttacttgttgaaagttaaaatcaagacacagaatcagtgcagtcatgccgttattgcacgtagagttgctatgttggtaggctaaagtgttttggacagaacacattatttgtttagaaaaaagtttcatagataccacggaaaacaactaactgaacttgtttttccttgtagctttttttgtgtgagcctctgagattttttttccttgcctttgctttccgactatttgaacaggaaaagaacaactaatggtctggaggagaaatcaaggacactttttaaaatttactcattcagcagatattgactaactgatgagtaccaaatgtgctagaacccagggttctagagatgattaaggaagtcaacggtcttggcttcatggaacttatgtctagtagggaagaaagatgttggtctagtgataaaaagtagcaagagatgcttattccctctataataagaataacaggaaggatctagaaataggctcatgggtttgtagctataagggcaagaatttgaaaactcttctggccaaaagctctacttattctgaatcatggggggagctttcatctgcaaggaactgccagatagaggagctttggtggcacatacacaccatggaatactatgcagccataaaaatgaatgagatcatgccctttgcatggacatggatggagctggaagccattatcctcagcaaactaacgcagagacagaaaaccaaacaccgcatgttctcactcataagtgggagctgaacggtgaaaacacatggacacagggaggggaacaacacacactgggcctgtcggaagggcgaggggagggagagcatcaggaaaaattgctaatgtgtgttgggcttaatacctaggtgatggattgataggtacagcaaaccaccatggcacacatttacctacataacaaacctgcaggtcccgcacatgtatcccagaacttaaaataaaaataaaaattaaaaaaattaaaaaaaaagaaaatttggcattttaggtgtcatatggtagcaactagatattgatttcccttctctctctctgaggcttttttgttgttgttgtcatttgcttgtttagtgacttgattaaactattttactgaaatctaaaaataaaaataaaaagcatcaagtacttagtaataaatctaataagtgaagtgtagaaaaaaaaaaaaagaaaatatatccgtagcctctagtagataggagcaaatgaaaactgaaggtcttctcacctgcaagcacagtcccaggcagtgtgttgtaataaaagcaagtctcagactgactcatgcacagatacaaacatttattaggcaggcgcaaaaactgtcacaccagttgttctataaatttatcacagaaagattcacttgaagcaggtgaaacagtgcgttagcttcggaattcagctaacctagtagcagttcgctgacaaaaatccatacagggtccatcctagtattaagcctagggggcctttaagaaaggtatgctgtggtggggtgtccatataatttgtggtccaaagcagaatgctttgagaaccaaagagggcattcttaataattatgttgggataagaaatgtaaactgggactgtaacaggcaaattgcaacctatggtaattctagtcattcggcatgctagattcttgtacattgttcaagcaaaggcaaaaggaaataaactaattattctttttctactgtttttagccatccacatatcttaaacaccccttgtttcaccaaggaaaaatatttttatctataatgcaaattatcaaatcctttaaggttgatcagaaacaaagatatttgaaaatgttttgtagcaaaggggaggaaaagtatctttcctgctacttattttgggtagctgggaccccctctaataaaatttattttattagaaatttattcaagttttatgtgacatgggagacttcataaggaaatgaagacccgaagaagcagttaaacgtgagcttgtttcatagtaggtttgatgaagagtggagagtcttagagaaatgtgataggacaaagcgggggatgagctgaatgttataaactggaggatgcttagtaagacctatttgttcaggtctctatgtcactgcatgtttggagataaggatgcccctttcttctgggtatagggagggcacctcacacattagggtcctttgacctgcttcggggaaggtcataaaacgtaggaaagattttataacctttttcaggggagaaggggagggggaaggtctgttttctcaaatccttcagcttaaaatatctaatatgccaaagtaccatattttggggtaggatgtcttggaccccatcagtagctacctctggcattgtggcagatggtcaccatgtgtcagatgataaacatccacctctggattaattcctcattagggtacttcagatgttaactaataccattagggtgtgagtggaaactaacccagatacacataaatcacactggaaatacttctatattgaagtgtttaaaatttactatagatagtgtaacactttctttgctggagataaaatttatgttgttaaaagagaaaatgcaatattctttaggatgtacagctttaaagctgcattaggagtaaaacacaggaggtacatgcagcatttagtgatcatttctgctcttttctgtagtcttctaggtactctaatcacaaaatgttaatgcgcatctttaggggtaaaataatgtgctctaaagaatatggtagtcactgataatttgtaattatttactagattttttgttactaaataattcaatggtatgactatagtatcagtaatcagcctgctgaagaatgaataatgcaatcaatttacattcttttgttgccattgatagaccagtaacagcttacctttcctatattctgtaggcatctaagaagaaaatataccaaaactttaagatatcaaaatatatttttcagaggtaaaacaatgaccctcgtaaatacatagtaagtgcgtgtcataaatttatttgcctgatgaatgagggaatcaacataatggtgatgctgattcccagaaaattccacagataaattatatataggcactgatagaatgctagaataagattgtaagatcagtaaattgggctgggtgcagtggcctgtaaccctagcagtttgagaggctgagacaagaggatcacttgaacccaggagttgaagaccagcctgggcaacatgtcaaaactccatctctacaaaaaatacaaaaaatagctgggcatgatggtgcatgcctgtagtcccagctacttgggaggctgaggtggaaggatcgtttgagcccagaatgttgagactgcagtgggctgtgatcatgccactgcactgtagcctcagcctgggtgacagagtgagctcttgtctccagaaaagaaaaaagaaaaaaaaaaaaaaaaaggaattgtcagttggttaatgtcttacagggcaataaaactgttgtctttggggctatctttctatcacacaaaaatcatttacatccttttggacaaaaatctgcaagttaatatgttacttagcagtccttatgctgatagataataagtagtaagccaaacaatactacagtattaaaaaaaaatccttgggtgggcctgtttagactgtggtccaatatttaaaagaatataaaggtaaccttttgacatattttcaaatttttcataatttttactaataaagtctttcatttcgtttggtttcggtttataatgagttatatgattcttgagcaaatacaaattgtgacctttatgtgtgtattgtgtgggttttttgtttgtttggaccagaatcccccttacttgggactcagtaagggaaagggctcatagttttgacttacctgaattgtaggtgagattagctgtgttattgtttaggaacttttattctgtgtgaagggaactgtagtcacccaactggctcttcctgtctgctgcacagacaaaactgaaggggtggcctgcccctccacacttgtgggcgtttcttgttgggtggaacgagagacttgagaaaagaaagatacacagagacaaagtatagagaaggaaaagtgggcgcaggggacccgcgccggcaccagcctctgagttccctcagtatttatcgatcattatcgggcatttctgggagagcgggatgtggcaggacaatagggtaatagtggggagagggtctgcaggaaaacatgtgaacaaatgtctctgcatcataaacaagttagagaaaaaagtgctgtgcttttgatgtgcatatacataaacatctcaatgccttaaagagcagtattgctgcccgcatgtcccacctccagccctaaggcggttttcccctgtctcagtagatggaatatacaatcgggttttacacggagacattccattgcccagggacgagcaggagacagatgccttcctcttatctcaactgcaaagaggcattccttcctcttttactaatcctcctcagcacagaccctttacgggtgtcgggctgggggacggtcaggtctttcccttcccaggaggccatatttcagactgtcacatggggagaaaccttggacaatacctggctttcgtaggcagaggtccctgcagccttccgcagtgtttgtgcccctgggtacttgagattagggagtggtgatgactcttaaggagcatgctgccttcaagcatctgtttaacaaagcacatcttgcaccgcccttaatccatttaaccctgagttgacacagcacatgtttcagggagcacagggttgggggtaaggtcacagattaacagcatcccaaggcagaagaatttttcttagtacagaacaaaatggagtctcttatgtctacttctctctacatagacacagtaacagtctgatctctctttcttttccccacacaaaaccatttcgccaagcccacgatattgcagtaaagaaagagtttaattaatgcagagctagccaagtggaaagactggagttattactcaaaccagtctcaccaagaactcagaagctggggtttttatggacagtttggcgggcaaggggctagggaatgtgtgctgctgattggttgtggataaaatcataggagggtaggaaacggtcctgctatgctgagtatgcctctgggcgggggccatgggaccaactgagtcataagtcacaggtccaggggggtgagttggttgccagcatgctaacgtctgaaaaacgtttcgaaagaccaatcttaggtactacaatagtaatgttatctgtaggagcaattgaggaagtcacaaatcttgtgacctctggccacatgactcctgagcagtaagggattatagaaactacgcctacattttaacaaattgcaggcccctcccataaccctaatcttatggcctttcattagttttacaaaagcggctctggtccctgagcaaagaggggtttagttttagggagggactatgaccatccttcctgtctcccatggttagcttggcctgtgcctaggaatgagcaagggcagccagcctgtgagactagaagcaagataaagttagtcacgccagattcctctcaccgtcatgatcttggcaaacgtggtttcagaactcctcaaatatccaggagctcgatttggcctttaggctaacttgaaagaaataaatacttctattttaaattctttctttaaaaaagtttttttgtagagatgaggtcttggagtgttaatccaggcctcaagcaatcattctcccttggcatcccaaagtgccaggattacaggtatgagctacattgctcaggttattttaaattttttctagcaggaggagagatgtattcaatcctgagctggtacactagtaattaaaaaaaatagaagctaggggctgggtgcagtggctcatgcctgtaatcccagcactttcagaggccaaggcaggcaggtcacttgagggcaggagtttgagaccagcctggccaacatggcgaaactttgtctctactaaaaatgcaacaaattagccaggtgacatggtgcaggcctgtagtgtcagctgctcaggaggctgaggcatgagaattgcttgagcttgggaggcaggggttgtggtgagcaaagatcacaccactgcactccagtatgggtgacagagtgagactctgtctcaaaaaaaagaaaaaaagaaaaactagaaacaaacaacaacaaaaagtcttccgtttctatatttgagcagtctcacagtttgtaaacacaagcacagagtctccttttgaagcttctatttagataccacagagtgaaaacaggatgcctgcttaaacacagagaagtctttcagctcttaggttttaggttttgacttagggatttagattttgactttagattttgaaggtaaccacactcttcccagagcgaatcaatggacgctatgtaaatctttccttcctcaacgctaaggtcataggagttaaatttgtctcacattttcctttcagtgggttgcattgtttgatagtttatgataatcaaacaaagtggtaacttatctgtattggtgatggacttctttcagaagggctttgcttttgattacacacactaattatccttatgaaaatatacatgcattccataaacgagctgttttgttatccaagccttgattctttcgtccattcttagctactgttgactacctagtgttgttaaccattgttgtagatattggggagacagcagttaacaacacagataaaaaatttctgcctttatagagttcgcattctagaggggggagatagataatacactaagataaatcaaatattaagcttttctgtgtattttatatcaaaaaggtatactgaacttggacactaaggtgtagtaaggatttcctcctttgtatggtaaaagaagagtccttggtaatctttctttttacaataataatagttcttttttctcctagagtctcccgttttcttaaagaactttacccacacaagcaaggttgccctaggacagtggttcccaacctttctggcaccaggaaccagtttcgtggaagacagtttttcatggatggggcggtgaggaggggatggatggttttaggatgaaactgttccacctcagatcatcaggcattagttagagtctcataaggagcacacaacctagatccctcacatgcccagttcacaatagggttcacgccctcatgagaatcgaatgctgccacttttctgagctccagtggtcatgcctgctcaccctccatgagaatccagtgctgccactgctctgagctccggtggtcatgcctgctcacccgccactcgcctcctgccgtgtgacccagttcctaacaggccatggaccagtaccagtccgcagccctggggacccctgccctaggagactgacttacgagttcatgaagaaagtaaaaaataaatttagggatcctaaataaaggatatatataggataaataaagtcgagttttggtgtagagccctgatgttccaaattgtcccaaagggttgaaaaattaaagccttctcttcttcacacagattgaaattttccttacttaatcttatctgccgttaggttacctctccaattcttttttcaattatttgggcattaaactgctctatcgtgagttattagagatcactttctatggctgacaaatgtcatttaaaattaataccaacatttatgatttctgtgtgaaatgtttattctttcatgagataggtttcatatccttgttctcttgttaacatcccctactttgtttttagttgtggggtttttgttttattttgtttttgcattggagaccacagtttgcaataaggctatgcactaagcctcattgatttcctctaagctcttgtttattgagcacttcatatgtgccttgaattctgtgagtgacagacagtcgggggatgatgatatacaaggcgcagtttttgtttcccatgagtgtgaactatgcggaaacttacacgagttttacttacccatgtacaacaattagagaaaaataaaaaatacagtgcagtctagttgggaagtttggatgggaaacaagttagactttaaatttatcatatttctaattcacaccaccaagtaataaatacatcaatcttcattatgtgatgggaaaaaagtagagtcagagttcttttcaaaattccttaaattgttcagaagtacaaacaatattttacttttttgctagaagccagaaaaatccttacaatcattcagacattcttttaacgtgtatgtcctatttcagactttatcagcttcattgggatgaaggattcccagtgaagctgtacatatgatgtgaatctgctctgtgccatctagttccaaaatgcgtggtgtactctggcacacctaagacaaaagaagcctattggccagaatgatcacattggctgctctgcctatggagaagccatttattcctttactttcttaataaagttgctttcactttactctaaaaaaaaaaaaagaatgatgagagaaggttttgtagacatcttatttgtttactgtctatcttctgctaaactataacctccataaaaatgagacattcttctgtctgatgatgtatctctggtacctggaaccatggtagatacttggtgctcagtaaataattgtttaatgactgtttagaggaaacctatagatcatcgttgacttttccctctcccttatctttacattcagtcagtcaatacatctggttagttctgcttcctgttctcttttagctaggtgtttttcttcagccacactgccagtcccttaattgaggccaccattatatgggtcgctgaatcaacctcttaatggcttctgtgcttgcagttgtggaagtacccttccttcagtcacttctacagaaagtgaattgaactattcttcttcgactctccattgcctcctaataaagtctaaacttcttgaccttgaaagatggatggacttcacatcctcgcaggaggagatggtctagataggcagaagacggctgaagaagcagaagtggaacaagaaggccggtcatttcaaagttactttttcatagaagattaaaacagaagaagccttccttatcacggtgcctaaaagtggcctggttggggattagactattatctctctcctactttctcaggttaaacaagttggtttcagtttggaactttagtctcaataactccatgttggcttcgtgtctcggggcctagtgtaggagcttagtccaaatcaatgacctcccataaattctatttaatgctttttctccttaagtcttctaagagtgaaactgggataacaatagcccaataaggagtgtttggggcaggggagaaatttttgaatgcttcagataaaagttgtctgacattttacagtaagagcacttatattatttcaaattttaaaaagtgtatgtgtgtatctgtgtgtatatcttctgcttgttttatgaaaggcactttaaaagaggctgccaacatgtactttactgaatgtcaacaataatatatttttatttgagctaattttgaaagtctaaagaaaggaagacagattttgtttttatttgacaaacgattgttttctttttaaaaatgagaatgtcattcataaaacacaattccttcccttaaagagttgataaaatagcagaggtgtcagatacataaacaggcaacttgaatcctgtgggatgagaactgtcattacagagaggaagaatcaggacattatgggcacatagagtagtggcatctacgccagaatgggaaaaagcctggataatttgcaaaggaaatcctgtattaatttttgccacattaaaaaaaaatctttttttagtcctgtggtgttattttgcactgttttatgaccttttcctggatgataggtattctgattacagaaaaaaaaaagattcctcttctctcttttttttaaattttaaattattctttcatgtatgtgtcatatgtagtctgggagcttgaatttggtaaggcaatcccaggcttgccatcttggcttagacagaacaatagcataatcctcactaaggctttctaacttgttgttctctttacatagttagctccctactcaactgcagtctgcctgaggttggattttgtgggattccttgatgtactattacttgtttgcatgtttttggcacataatacttccaaaggctgtttattgttaaatgatgaaaaatgtcactccacaatttaaaaaaatcttctgtgaacctcactgcctatcaaatgaggctcaagacctttagcttggcttcaagagccaccataattagacatgccatgttttctctcacagcttccaccagtgtagcctgtatgctccagccatactgagccagtcacctttccctgaattgtcctacacttccctggtctcctatttctgcttctggttccccacccccagcttacctctgaaaacctcatcctgcaaggacaaacttttcctgattctccaactgaaaagattgtctctctcctttctgctttcatgaaacagtcagctttgttttatatctattatgtatatatatcctatgtattttacttaagtcttagacgataaggggccatcttatttatctcgtcttcttctatgcctggcaaatgatagtatttcaataaatactgtgtgacaataaagacattcaataaatactgactgattgtgaagcaaagcattttttttcattttttttgttctgttttctatctcatccaaagggaagagaattgaattaatctagaaaaaaaaaacaaaaccagacagaatgctagtgggagcagttaaaataaatgagccagaaagagcaagtaagtgacatgccttagacttattttttactattttggctatcagcattagtgtactgaagtcatttgtttatgtactagttgattgactatatagttaagtctaagattttggatttttttttaaacccagaggagtcacattgaaacaaaattttattctgtcttgaataaaatgggatatattagaaacacactgaaacctaactcagcacttctctgtgttggtctgttggcagtacatttggatgtgggtgaatgtgtagacaacactgaagaatgctggctaactatatataggaaatgaagttccagctctgtcttttctttgaatttctctttcctgggtgagaattgtgaatggaacagagaactgaagtagagacgggtttggtattttgtcttttggtgctttctttatatagtttcttttttaattgaatgaggagtagaaaatctgaccattttagtggacttatgtgtttatgtgcgtgtttaaatctacagatgtatcccttaccatttcttatgcagatgaatacattggcaagaaatagaatttgctgagatttcatagtagcatttccaaaactattttccatgaaaaaaatttttattgtatattatctttcggttcttttgccaaagttcttttggctgagcttttttttttttttttcttgctatatgtctctgtgttctttttcaatggtttctctaggattataaaacagataattaaattttcacagtctaaagttaacattgtcccatttcatgtaaaatatgaactcctcagtcttacagatgtcatatatattatatttgcatattttaaagctccctcaatacaacattttacttctttaagtagccatatatattttgaagaaattcagagaaagagtcttttatacttccctacgtatttaccatttccagcacccttcattctttcatgaaatttcagccttccatctagtctcattgtcctgcagcctgaaggacttcctttagcacctccggtagtacaggtctgctggtaataaattattttagttttcttttatatgaaaatgtctttattttgcctttattcttgcagacaattttttgctggatagaggattctagattggcagcttctcttctccttctctttcagcacatttctgtttcttattgctgttgtaagaaagtaccacaaacttagtggcataagaaaatggaaaattccttttgtcttcacaggcaacaatatcatgctgagttcttaccatgtaagactgagttcttatcactgccgtctctctggttcttttatttgtgtctttctcttcctcttccatttttattggattatttttcattcatttcacattttattcatatcacatttttaagattctttgttgatatttcctatttgttcattacaagcatattttcctgtcttttcttgggcatagtaatgaaagctgactataaacattcttacctagtttttgaggcagttgggccattttgggttggttttcattgattgaatttttttttcttgagaatgggtcaccctgtcctcttccctcatatgtctagtaattttgggttttattcagaacatttttaatatgttataggtttctggattctcttatattcctctgaagtgtgtgtgtgtgtgtgtgtgtgtgtgtgtgtgtgtgtattgctttagcatgctattatattggcagatgtgtgctccaactttgttacccctgtgaagggcagcaactgaaatcacttttcagttcttttagacttttccggactgctgggcctctcctcaatgcatgtggatagtaggggtcacccagagattcaggcattttatgcactagactctggccctcactgggatttttttcctgtcactttccttttgtttctttaagaagctgcagatttctatccaacttgcagttgccccagctggcacagccagaaaatttctggcttcaatttaaaaagctttataaacaagaaactcatctagtgtttttcatttattttcaagtgttaactcccttccagtttctgtctgcttttggccactctctagtaccttcagttagtttttttaaatgtcgaatccagagcttatagttgttatatttggtatgttatatatgggaggagctgccttattattaccagaagttttattatggttgttgcttctagtgtatgttcacagtttgttttttttttttaattttttttggcaaaccaataaaaaaggaagataatttttttttatttgcaaaacatgctttactaggaattagcctaaggattctcaaaagtactggtcaaagtcaatgctttggagctgcagactgcttattaatttagtttgatcttatctagatatccttctggtgctactgacctgggccaggggtgtctaatcttttggcttccctgggccacactggaaggagacaaattgtcttgagccatacataaaatacactaacatgaatgatagctgatgagctaaaagaacaaaaatcacacaaaaaaacttatgttttaagaaagtttgcaagtttgcgtttggccacattcaaagccatgctgggccacaggttggacaagcttgacctaggccgagaccaatttgccatctattacacttgatttcttcttaggaaattgtgcctgacacatgggcatatggttgcgccagaatggagtcatacggaacttctgtagtatctggcgttgtgctttccagtacctctatggaggtttggaccataatcttgagagacactatcttgaatgccataattccaaatgttgaaattttgaaagattaaaatccctaaagtctagttttatttatttatttattttgagacagagtcttgccctgtcacctaggctggagtaccgtggcgtgatcttggcttgctgcaacctctgcctccgggtctccagcaatctttccacctcagcctcccgagtagctggggctgcaggtaggagccatcatgcccggctaatttttgtattttttgtagagatcgggttttgccatgttgcccaggctggtcttgaactcctgggctcaagcgatctgcccgccttggcctcccaaagtgctgagattataggtgtgattcactagctccagcctaaaatccctaaattctaaaatccccaaatcacaattctgagagaccaaaatttcaaaaatataattgtggaataaagttttaaaaatatttaaaatacatttgttacaattttaaaagaagactttagagacatataaatacatgactgaacacattataggccactttacacagtaaaataggcaacaataccatacatgttctctttgcaagcatcaacacacagatatactaatgggagtcactcagctattatagctatgaacagacaaactgtatttataaagaaataggtcagaaagtgaaatgtgtgaacgcttattactatggttggaaattgtatgcatccatcgttgtaactgcagtcatcaaaaataccctgacagacatgttttgatgagatggatcaaaaacctctggtcactgccacaaatacagtcactcaaagagccaaggtctcaagaaattttatctttcacaaatggagacacagaaaaaaggcagttcttcatttatggaagaagtttcagtgtttttatgtacatgcaccatgcttatacacaaagcagcattgtgataatgcgtgtacttggaataatgtttcttacgtccaaggcagaagaaaagtctgtctcatctctcagagagaaagcagtttaccatctgtgtttgttccctctggacccaaggctgattggatggtgcccgccaacattttaggcagatctccacctactccattcagagtcatgtactaatctcctctggaaacacccttacagacatatctgaaataatgctttaccaagttactagataactctttaatccagtcaagctgacaccgaaaattaagtctacaagtctaccccttgtgaatctggcacctgtacacatcttaaaccatagctaatttccagatgaagacaaccacaagataagagtcctgtctaacatgatagaactaacacgattcatccacactgagcacagcggaaagcacacgaatccctccccagaactaacaggatgcagccacagtgagcacagtggaaggcacacgaatccctccccagaactaacacgatgcagcgacagtgagcacagtggaaagcacacgaatccctccccagaactaacacgatgcatccacagtgagcacagtggaaagcacacgaatccctccccagaactaacaggaagcatccacagtgagcacagtggaaagcacatgaatccctcccccgaactaacaggatgcaaagacagtgagcacagtggaaagcacacgaatccctccccagaactaacacgatgcatccacagtgagcacagcggaaagcacacgaatccctccccagaactacacgatgcatccacagtgagcacagcggaaagcacacgaatccctccccagaactacacgatgcatccacagtgagcacagtggaaagcacacgaatccctccccagaactaacaggaagcatccacagtgagcacagtggaaagcacacgaatccctccccagaactaacacgatgcagcgacagtgagcacagcggaaagcacacgaatccctccccagaactaacaggaagcatccacagtgagcacagtggaaagcacacgaatccctccccagaactacaggatgcagcgacagtgagcacagcggaaagcactcgaatccctccccagaacttggctttcaggattgcagcatttggggtttcagtgtttggggattatgattttcaggattttcgatttcagagatttcgacttcaggctaatttttactctcaggccttttttgtttttaaaggcctgtataccaatattttcagggatgatggcattcaggattgtgtcctttgggattataatggcaccacccctaggtactaggctcttcccatactcagtaatcactacttgtgattatagtggggataaataagtctgaaattttgaaatattttaattgcacaaataatgtataaatgcaataactttattttaaataatttaaaacattttataacaaaggcaaaattccccttcatcattgtccttaatccctgttttctcccaccgtcctaccctccttcctagaagtagccactgctggcattttggcacctcaccttcagcattacacatccccactcccacaatttttttttacagacacacacaaaaaattgttttgtgttgttttgataagcagcaccatattgtatatatatctgcaacatccttatttttacttacttacacatcttagatatctatgtttattacatatggatttactgtatttgacattctatactccagtgcttctgctgatagaattaatttatcctattgtaatcttcttaggaaacccttcaacaagtatttctgatcgaaccagtaaagcctcattgttttggagcctacttacttgaaatctgtaataattatgcctagaatagaattaaaatttatggttgccaattaatgacttaaaagaatatttgtccccactaagagataaatagcttttaaataccagtttaaaacataccaattacacataaatttttatctgtgtttcattatctaacaaggcagtggcttgttctgctgacccttaagcatttgcaggcgataaaaggtgcatgccattaaaaccatcctccagtaggactgggcactaattaggactttgcttaggtgaacgtaaacacaatggctccctctccactttatctcgccattcactttgttctgttgctttttgatcagggttctgacagatcctcaggtcggtgcttcacctcttcgtgaggaggactcctcttggggcccatctctgggtactttggggaagtgaatacaggaagattatcttatggtgttgtagtaccctgaagcttttcatcattttggatgtcactttaaaaagacaaaatggaaatgaataaaagctaataactaaaagcgcattattttgagatggatacgtgtataaagtctcttacagattgctgcagaaatgcccagatgtatttctggctaaaacaccaagagagtatatttggacctaatcgatattagataccactttctctttctcctttgagaattaaactcacttgtggcattttcctcatcatccataaaagtaagatgaatgttatcagttcagccctcaggatggaggtcccgggaaatgaaaagaaggaccagagactgctgttgccgtaggtttagaaattgccagttcccacctcactagttttcggtgtgtctcttggtagtctttgactctctaagttcctgtgcctctcacccttcaagatagtctaggacgggcagggcaaccatctctcaaagcatggatccactctctgaacacagatttaggcctaagaagtggccagcacctccacaagcctgcctcattgacggggagagggaagggggcaattgagattcacttccccccaaactaaggctccacgtaggagggatgtgggggagatgatggtatctggggcagtccaatagctcactgtccatctaagcattcctgggaagaatgacaacagtctcattcgtcctgcccaccaccaaccccaaatggaataaatggaattcagccttcgcaggcagctggaggagtgagcctgctgctgcctctgcctcaggattcttcagaggaagccacaaagggtttggatgggggtgaacttcaaagtggcatgatgaaaagctcgaggtgatgtcttccgggatttagcaatgccatctttctgttttatgttggctttctttcttgatttgggattgtgtttatcagttcggcttattaatattaagtaattacaaacaatcatacatgcatttaggaacttatgtttaatctctggcaacagcatagtttattggcaaaaacaaatgcacatacactgtaggttagtgatgaacatcagcagacaggcctgctcttgagatttttgtctaactgaggagcgtcattaccatggcagtattgttctgttttatgtgaaatgtgttggatatttatgttgagtttaagatatctggcacgaagctttcctcacacagaagaaaattttcacaacttttgcagattctcagtttgttttcttttattacaaattaaaacattttgatttagattttctgtttcacaattttcatttttatggtagaacatgataaggcagctacaaggtcatgactaagaatacagagtccagaagcagacaggctgtgtgactgggggcggttatctctgtgctccagctacagcatctcaaaattggagagaatctaaatgatgttctatgtagttggtcgcctttgtcatgttatattttcagatgagagccaccttgttttctgcacagacatatcctagtcagtgattcttctccttcccatgttggtttttgatggtttcatttttgaaaagggagaccagcttttcattcgctttttcagcagaagcataaggtaagacataaggggtaaggtaaggcataagttggaggtatgactggtaattctggattgatggctttgcaaaaggatggctgttatgcctgcggaactggctcccctccaagaaccattcacactgacttcatattaaggaggttctttgatttgttactaataagagtagtattttttattgtggtttttattagtgtaacaataacaaatgcttctgtagttcattattatgaacagtaaactcatgtacctgattatgctttttgtcgagatgaggaaactgtggtaggggtttgactggtagcaggttgcaggcaccctgcgctccgtctctatgttcttgttcttccctcagcctttctgccccctcccagtcatagcctccctcctgagctctgcatccatcagcaaagactttaaccatttaggtttagatcatcattacttctgactattcgtttttgattgtgttgtcagaagactttttgttataaagaagagaattataaaacatagatttgaagcaagcatagcatatttgtacccttttaacagaggtggcagtgaaatgacagctttttgctgcgtgggtgttcttttttttttttttttgctgacctgtagtttgatttccagtgtctagacttaacagtctgaatttaaacacgaggcatatacacaaaatcatctggaactgattttttcacactaaacacttctttctgatcctactttccaggaggctccttcctccaaacatacctccagatgaaaatcacttaattaaccaagaaagactcaaccgcccttaactgcttttctaaacagtcacacatactggatttacttattttgagacatgacaaaccagttgcaaaccacaaattcattctcatgggccctccacacggtctcttgttccttctgaagagggtcttgctgaggaccatttgtcccccttcctgcagcagctactcagtcggtgccggagagtgtggcctttcgaactatttgcggttttcctgccacatgatgctgacggacctcagcctctcccggccttggtgcacatacaacagcctgtaaaagctccactttctattccagattgctgttatgcgtctgcttctcattcaaaggaaataagaggagatgtaaatcgtcgctgtgcagttacgtgtttaatgaaaatgatcttgcatgctagattcacgtccaggagcgagtcgcccttactgctggtattgaactcactctccttggagcgccccaaggctgtgggctgtgggggggcattagtgtgtgtgggcgcagctattatttgtaccaggaggcacaagtctgcacagcaacctgaagatttagattttcaagaaactgcaaatcctgacacacctggtgataaaacccagatgctctccccaactcataccttgtcccgcaactcccactccccacttcctgactagactttttattttttggtccagaagataggggtaagagaagaatgctgaagggagtgagtggatgagagaatgcttggcttacttgcccattagatagttccagctccaaatactgttctaattaagaacaaaataaaaccattctcccccactggctgtctggtatgtagacaaatttggaaataggtaaacagttgctgtattagaattgggtatattttagcttgatgacaatatttacttgattttatcactgaagagaatcacgatctttgtgacatatacagtccttcttattcttttagctctatctttattaaactagattgtcatcaaatggtggtacgtgacttcaaaaggactctaccagctcttattcaccggaatttttacttttattgactatctaaaagtttaccgcttcaaagaaagactgttcctactgagataaagtactgaattctgccactctctcctcctgtcccagactttaattataaaatcacaatcacaccagatagtaagccttaaatattttaacatttttcccagtgggaagacagcaacacataaaacgacatgcaattatatgaaaagatttatttgtccctgacccaggaagctatgcaccagtgctttcagataatagtctgcccggcccaccctgagggatctaatgaattaacataaatacctgtgagtaggttaagtacacacaaggagcagattacaaaagaatgaaaacttaagcaattagcaaggattttaaaacattgatctatcaggtgttctagaaagtatttgcttctacatttcgagtttagctcaaattttactgagcagcttaaacagcactgtctgcttttgcctctaggtcacaggtcattgtcaaattcatttataagatagtttcaatctgtacttatttagcagtgcagagaattttagacacactaccttttcactgtttgtaaaaaaaaatttgaaaaataagaattgtaatgtaaaaaatattggaagactaattcttaacctacatgaagaaacagttttcagcagctttctaaatgtcttgtttacatccaaattgttgagaagctcgttgccaatctgttaattcatgaaaattcaaccttttaggatgtccactaagctgccttttattagcccggtttgaatgactgtgttcgtacttgagatgagttgaactgaattgccttaaaaattcaaatctgtaatgaattcataaggagttttcatcccaaagttcaaattggtagggcctagtaataactttagacatttatgtggtgacgagcttttaatcttccttaaggtttttaaaactctgcatgtactgtccttcttctatgttctcttgtccttttagttggttttggtagaaattttataaggcaaattaatgaaagttatctcctgagtggcagtttacaacaaaaacagatgtaaaggagaaaaaaatgaaatgaaaatttggattaaagaagaaaaaagtctcatgttagtaacagatataacaaaaagagtgaactctacgtggctataagttccttgacagcaaggactttgcctttcttaggtggaatctattgacatgtagagaaggaatgttttacttaggaggttgtcaaggaatgtctgtcaagtaggggtagaaggaaggaattaacagggctttgagaacattctcacatttgaagtgctaataatttctggtgtgaatttggtgataacagtgtttcagtatttaatattaatttgaattttctggctggttattaacttgagttacgtttataggtgatgaaacaaacgaagaggattgcatgtttatacacagtagaacttgagggttttctaataagcatactttaacattgcctcagcctgtaaatctgggattacaaggcagataagttttagggtgattacttctttcaccccataattacttcatggatttgccgtggtgtttctgtaagtagtgagcatctctagtaaactgacattttgattctatttaaacaactcattttacccagtttttcagcagcacattgactggataaagtaaggcgcgcatctgtcctcacttttttgagtcttgctcctaagtcttgtgaagaaaatatgggtgcacgtatgcattcctttatttagagtaacttcattgcatgaagttgagctgaagaactaggaggaaaatagctctttttgtaagttgtgctttaggagactttggatttagctaggaatgggatactgagaaaaactgaggtttcacctcctctaaacaatgggacagtgttctcatctctttgggactatatacatatctatttatatcctgctttagtccagaaggaatttcagctttggaaaaaaccatgcacacacacaaagatacaaataaagtgtaagtgaagtaatcagagtaagaggttggggaaggtaagtcgaaaccaaaagtgtaattagtatacagattataggctctgcagacctacacggtcacaggaagaccaccacatatttggctgttagcttttgaacaaagccaatgcaaagaggataacatgaacgatgcacggttcccagtgtctgtgccaaaatcgtctaagttcagtccggtctagaaggccgggggatggagctgacctcaggggaaccctgctgaagttgtgacatttattcagtcaagaagtatttattggacatgaacaatttgtcagtgaccatgctagacactggggatacgcagtcccacctttaaggacacacagtataggggatagatcaataaaatagactgaaattgcagtgcagtgggataaatgccgtggaggggagtaggcatgaggtattagactgggagacggggatatctggggaagatttgtgttggtgcctcagctgacttctaaagcctacatacttcttaacccaggcaaaagtggaaatgcattctaggtagaggacaagtagccagaacaaagtgacaaaggtaagaaagtgccatgctttctgagaactgcatttaatagttcagtttgactagaacagagagtacaaaagggagaaagtgttgagaaattagagagaaaacttgggcacatcagaaaaaggccctgttttccactatgctcgggaggttgagggcagtgggcagccttcccggcaaagagcctgtggagaatggatggaaggataggcaggagacaaggtaggagttccggcagtgatgcgagcaagagagaacagaggcctccattaaagcccgatagtgaggacaggaagaagggagtacagggaagttactcaggagcaaaattgacaggatttggcctagaagagatgagggacagtgaagaagtaggaattgggattatttcttggtttctggcctagtcgctgtgcagaaaagagttaacctagcaggcctaaactgcttatccttgaaaagacctgggctgggcgtggtggcttacgcctctaatcccagcactttgggaggttgaagcgggtggatcacttgaagtcaggagttcgagactggcgtagggaacatagcaaaaccctgtctctactaaaaatgcaaaaattagccaggcatggtggcatgcgcctgtaatcccagctactcgggaggctgaggcaggagaattgcttgaacctgggaggtggaacttgcagtgagctgataccataccactgcactctagtctgggcagcagaggaagactgttaagagagagagagagaaagggagggagagagggaggaagggaaggagagggaggggagaggaggggaggggagggaatgggagtgagggagggaaggaaggaagggaaggaagggaaggaaggaggaaaggaaggaagggcaggcccacaagtttggcccttggctgacatttagcaactgagatttcagcaagtgtttcccccttatctggtaagagtggctgacagtgcctaaactgtttgtgtcaacattatggtttatgctgatcccctgctgtccttccaggagtccaaaattagaggctgcctacaggcgattgaactccaataaagaccctgggtactgagtctctaatgggtttccctgactgggacatttctcacgttatcacagctttttgtaggaggagtgaagtgcctcccttgtgactccctgggggaaggcccttggaggctcccactctgtttccacagacttctccccatgtgcctttccccttgctgacttcgcttggtgttgtttccctgtaataaactgcagctgtgagtacgactgtgtgccgagccctgagagtctgcctagtagataactgaaactgaaggtggtcttgggctcttcctgatgcagtcagctgtggatgtagtggtacctctcatagcataaagaacgcaaaagtggtagcaggtttgggagtgggagcagtgatgcattctgctgtaagttttccaaggtagtcacttatattgctttactagggttattttgagctagcatttattattatatgttttctatttcaaaattaagttaccaggaaaatctaatttttttcaacataccttcgctcattaattaattcattcagcaagcatttgctgaaacgttattgaacatttggaactggttaggcattttaagtgccataaggatgcttaggaatatgggtcaagtgttcaaaggggttataaatacactgggtaggtaagacatcatctgcctttgaaaaataaaatagcattcatttcaaaaatgaaatgttaaaatatatcaatatgtaaacattttgtccttgagaaattaaccaaggcattcttgggttagtggtccaaatgactagcatttgtaattgggaaaattgtaatccaaaacagacacaccacatattaggttcatcatcactaggacaatttttgtcctcttctggtgtcacaagatgtttaaaaccaagattcagagtgttttcagtgatttaggagttctgtaattgcagtcactgtggagaggtgctctaaattcagcacattttcagtggtactcctgatggatgttttttctcgcagaaaggccaagtcattgtcaaatggtagactataaagatccccaaatcagtgactaacctctttatgatctcggggaaatattctgtggatttttttctccccactcaggaacaatgaatggtgacgatctttaagtcaatgatgtgaatgaatcacatgtggatgaactaaggctctttcctgattctcagtcctaatgagcagctcttcatttaacctgtgggattcgtttgtgctgccctgaaaaactatgaagttttggcttgaggttgttgagatcctaaggaaatatcagccaaataagtcattttattaagttagatgaaaaatcaattcacttccctttttcagatttttatattgtaacgttgtggccttttttccctccatgaagaaaaataagaattcaatctttggtttagaaactctgagaagcaccacctcttgatcaggcaatgcacgtctttgtaatagtgccggtctatcaaggcagctctcatttcatcactaacgaatcaaaagcttctttcacatcactgtttctgggtttttgtgtatattttgttagctttaacttttaaaattattttatttttgagacagggtctcactctgtcgcccaggctgggtgcagtcatgtgatcgtggctcacagcagcctcagcctcgctcaagcgatcctcccagttcagcctcctgagtagctggaactacaggcatgcactaccatgactagctaatttttcttttctttttttttttttaagtagagatggcgtcttgctgtgttgcccaggctggtcttgaattgtgttcaagtgatcctcccacctcagcctcccaaagtgctgagattataggcacgagtctctgtgcctggctttttctttttttcttttaccattttattggacttgatgtggatttccctaccacgcatttgatcctaaagaaactctatcagcacattttttccaggtgatatgtgtttgctgaaatagtcatatggtacctaccagtccttactcatatatctttttgcagttatttttacaagaatttaagcacttgagacatttcttttttgtgtgtgtgcgtgtgacggagtcttgctctgtcacccaggctggagtgcagtggtgccatctcgactcactgcaagctccgcctcctgggttcatgccgttctcctgcctcagcctcccgagtagctgggattatgggtgcctgccagcacgcctggctaatttttgtacttgtagagctggggtttcaccaggttggccaggctggtctcaaacccctgacctcatgatccgcccgcctcggcctcccaaagtgctgagattagaggcgtgagccaccatgcctggcctaaaacatttatttctaatgagaatgaatatgtgaataaaatcagcattctgttaggaatgaaaaggaatagatgtgtgtagtcagccagttagtgtacactaaaccagttggtattgtcagtagcagtaagagtgactgtctcctcagacttttgatgggctggcttagaaaagtaacatgaagataaagtgggtcctggatgtctttctttatgggagctgagtgattatgccagacatgagatctaggactcattttgcaaatgaagaaaaaacagctgaaaacttgtcaataaaaatgataaccaaaggagaaattatcatatgatccaatttagtaatgactgagggatcataaaaatttattaaaatgaataacagtttattgcttttctgctttttctatttttttccttttttatcttcagaaatcaagaaagacattttgctgctttgggaatgttatgccatttttgtcgttaaacggaatatttagagttaagatatgattaggataaggtaaaaccttatgaaatgttctcacatataaatgtatggaacttttcaattagctgtttaaaatgaaatatttatatatggagatcttctcagatatataatgtttaaaaaaaaaaacgcaacctttatttttattttttgagacagtctcgctctgttgcccaggctggagtgcagtggcataatcgtggctcactgtagcctcaacttcttgagctcaagccatcctcccatctcagcctcctaagtagctgggactacagatgtgtgccaccatgcctggctaagtttttttcttttagtagagacaaggtcttgtaatgttgcccaggctggtctatcctgagtctgagctcaagtgatccttccacttcggcctcctaatatgctgggattattacaggtgtgagccattatgccccgccaacttttttttttaaagcaatatatttagtggtctctggagtagctctgtcaacactgtcgaatttgaaattgtaacttaagtattctgtactgtcttctctattttaactttcatattaatgcttaaatgcctactgttccaacataaatggattttgcttaacaaatactgtgagtgattgggctcttaccagtttaagctggcttccacaagcaaggggcacatttcttcttcattagttctcctgattgagtttcagaaaatgaaatcttattatgccacaaaataatcgtatcttacttgcctttttcctgaagcttctcaaaagtttttaagaccttttaaaaggaaaggaatggttttttttcttaaatccatctgttcctcagcctcaagtctaagataacgtctgagatatgttgttttcagtttagactcacaagatatgcagcacttgggcatggcaatggctggctcaccatgcttgataataaaataggagaaaaaggtcctagtgccagtggagtcgagagagacaaaacacctccagttggtcatatctctgttcagtttttcagaacaatggatttaactacttttaatagttcttctgttagtatagaatacttaaagtcatcttaatttgatttttttttttctctaggtaaatgtgttttattatccctgcctctgctggcttagaaaatctagcaaaagcctgccacttgagttggctgtaacatcagacccaaaggatctattgcctccctcgtttacttttaccgctggtgaatttgcagtccattagaaatgtggagttgtgggccgggtgcggtggctcacgcctttaatcccagcactttgggaggccgaggcaggcggatcacaaggtcaggagattgagaccatcctggctaacacggtgaaaccctgtctctactaaaaatacaaaaaaatttagccgggcatggtggcggacgcctgcagttccagctactcgggaggctgaggcaggagaatggtgtgaacccgggaggcggagctggcagtgagcggagatcatgccactgcactccagcctgggcgacagagactccgtctcaaaaaaaaaaaaaagaaatgtggatttgagtaggtaaatgggcacctttgttaactatgagaaacattatctatagattacttttattacaataaaagtccttctatactatttaattttgaaaatttccaacaatttttattgtttcctcaataaaaatggttttgcttttgtgagctgctataagttctgtagaacagcaaaatgttgtatatggcttctagactgccagctgttatacttggctataaaaagctttcctcaagcttccttgtactggcttttgaaagacaatcttccaaatgtttgagaaagtgtaaaatttttatttccctagaaagagaaaggcaggaaaatgacccgattctgccaaagataaatgaatcatttattatttcgtaagataacgtgctgcttcaggttactgaatggggttttctttcatcattcatagtttccaccatacatgttttttaaaaagatgatttttgaagagcaaatttaggttcacagcataattgagaggaaggtacagagttttctcatatccctcctgccctcctcccccacctccaacacaaaacacacagcctccctcattctcagcatcctctaccagagtgggacatttgtgacagctgatgaacctccatggactcttcattatcaccaaagttcagcttctgttagcgttcactcttggtgttgtacattccgtgtttggacagatgaatactgatatgtatttacctttatggcattatacagaggtgctctgtgcctcacctgttcatctctctctcaactctcatccctggcaaccgctgatctttttaccgtttccatagctttatcttttccagaatgctatataatcgggatcatacagccttttcacactgccttctttcgcttagtagtatgcatttaagattgctccgtgccttttcatggcttgataacatcacttacttttagtgctaaataattgtccattgtctggatgtgcaacaatttgattatccattcaccttctgaaggccatctgggttacttccaagtttggggagttatgaataaagctgctgtcagtatccacatgcagatttttgtgtggacataagtttttaactcctttgggtaaataacaaggagtaagatttctggattgtgtgatgagtatgtttagttctgtaagaaattgccaaactgtcttcccaagtggctgtaccattttgcgttcccatcagcagtgaacgagagttcctgttattccacatccttgccagcatttggtgttatcagtgttccggatttggccattctaatatgtgcgtagtggtatcttcttgttattttaatttgcatttccctgatgacatgtgatgtggagcatcttttcatatgcgtatttgccatctgtatccatcatacatttttaatgcaaaaactatatttgaggaacagcaatgcattttaagggagagagagtgggagggaggaaagaaggaaggaaggacaacattagtgaattcaaaccactacctgtaaaagtagctttttctttttcagttctgcatgtaactctacctgtacctagctattacagatagaccatagctgttataggtagactatatggaagaggaaggctaatatttattgagaatttcgtatgcctctaacgctatgttaagcacttcacatccattatttaatcatcacaaaagccctttgaggtagatgcaattattattattgttatttttatagacaatgtcttactgtgttgccgaggatggacttgaacttggagtcagatctttctaccacagcttccggagtagctgggaccacaggcaggtgctactgtgcccagatagttacaattataatccgcattttgcagttgagaaaactgaggcaaagggagatcacgtcaggtcacagcagtaggacgggacctgggaagtgtgactgtggagtgtgtgttcttaatctgtgtgcccaattgttaagtaaggagaaattacaaaagacaaaggtttcaataactctttgcaagaagtccttaaatgtgaacagaagtacctattttccacacattttatgtcctttttttttctttttagtttacatgtatttatgggctacagagtgatatttcgatacatgtatataatgcataatgatcaaatcagggtaattagcatatccatcagcttgaacatttatcatttttgccacactttttatcttgttgatagtgcacaattttcatggctttgcctcttgttatttcccctcatgtatgtaggtctggtgaaatcacacgtagggagaacatttttacaatgcacatttgtgaaggcttagaaacacggtggttacaaactgagctttgccacttaatctcgtgtgacctggataaacgacttcataccaaacttcatatagtttcctcatccataaacctgtaacactcaggcttattggagtaacatatgaaatggaggttatctaagtatttgttgaatgaatgtccccctgcccgcactccctccgtttttttctttttctcctgcttcctatgaaatagaaaactggtaggcattgcaggatgaaatgaggaaaggcagggaggagaggcataaaatatattcttgctaatttgctagtgtctttttttcccctcatcaactttattgagcaataattttatgcagttaaatgaatctatttaattggatgaattttgacagttttatatacccatgaagccacagtcacaatcaagatagagaacatttccattacttccaaaatatttctgtgccacttttttctttactatttccttattgtagtaaaatgtatatataatgaaattttccattatgaccacttttaggtatacaatccagtagcattaagtgcattcatgttgttctgcacccgttaccactgtccagctccagaactctttttcatcatccagaactgaaactttgaacccattaaatgataactccccattccccttttgccccagcctctggcaaccaccattctacttcctgtctctctgattttgacaattctaggtacttctataggttgaatcgtacaatatttgtccttctgtgtctaacttctttaatttagcataatgtcttcaaagttcaccaatatgatagtattgatcagaattcccttcctttttaaggctgaataatattgcattgtatgtatataccacatttgatttctccattcatctgttgatgcatatttgggttatgtccaccttctggctattgtgaatagtactgcagcgagcaaaggtgtgccaatacctatttgaatctgtgctttcagctcttcaggttatatacccagaagtggaattgctggatcatatagtaattattttttaaaattttttcttgtcttcttttatttttaaagactaggtcttgctatgttgcctaggctggctttgaactcctggtctcaaatgagtctcctgcctcagcctgcagagtaggagtacctggggctgcagatgtatcactgcacccagctcgtgtttagtcttttaaggaactgccagactgttttccacaatagctgcaccgttttgcattcctaccagtaacgcacaaggcttccagtttctctacatccttgccaacatttgtttttttttttgtttttttctgagacagagtcttgctctgtcacccaggctggagtgcagtggcaccatctcggctcactgcaagctctgccacccgggttcactccattctcctgcctcagcctactgagtagctgggactacaggtgcccaccaccacgcccggctaatttttttgtatttttagtagagacgggatttcaccatgttagccaggatggtcacgatctcctgacctcgtgatccgcccgcctcggcctcccaaagtgctgggattacaggcgtgagccgccgcacctggccttttttttttttttttttttatagtcatcctaatgagtgttaaggtggtattttatcatggttttgaatttgcattttcctaatgattactaatgttaagtatctttttatgtgcataaaaatggccatctatatatcttctttgtacctgtaccctttttcagtctatccctcacccacccccagccccagctgattagtgatctcctttttgtcactgtacatcaacttgcattttacataaagtgaaatcagtatgtacccttacatccaactgttttcgcttagcataatggtgttgagatgtattcatattattggacctatcagtaattcattcctttctgtttatgaatagtgttgtgttgtgtagacataccacattttatttatccattaacctcctgatggacattcactgtgaacattcatgtacaaatctttgtatgacatacgttttctcttaggaaaatatctgtggtcacagtggctacgttatatggttagtattatatctaactttataaaaaactacaagactgctttctgaagtagtcgtgacttttcgtgttccccccagtagtatatgagagttccagttgctctgcatcatcaccaagacctggtagtgtcagtctttttaatttcagccattctaatacgtgctcggtggcagtccagtgtggttttaattcccatttctaattagttaatgctactgcttatctttttaagtgcttttttgccatttgtatcttttcttttgagaagtatttgttcaatcttttgcctatattattttgggttgttttcatgttgttgagttgtaagagttctttatatgacatggatacaagtcctgggtcagatatgcattgcaaatattatctccttacttgtgacttgtctttttgttttcttaatggcatcttttgaagagccgaagtttttaattttaataaagttcatttgatcaatttttacttttatagtttgtgttttcttcttttatttaagaaatattttcttagggaaagtcacaaatattttctaggagttttctgttttagcatttacatttcaatttataatcttttttttttttccatagagatcgggtctcactacattatgcaggctggattccaactcccaggctaaagcgatcctcttgtctcagcctctcgagtagcaggaatacaggcatttgccaccatgcccaactataatccatttttaattaacttttgaatatgttatggcataagggttttcttgattctccacacaaatatacagttgttcctgcatcatttttttgaagagactttcctttctccattaaattgccttttcatctttgttggagatcaattgcccatgtttgtgtaggcctgtttctggactcactattctatcctttcttcagtaccacaccattctgattagtatagctttttagtaaatcttgaaatcaggtagtgtatgccctctaacttttttttttctctctttaaaattgatttggctattttcacttgccttttcataaacattttttaatcagcttgttagctttttaaaaagcctgctattttgattgaaatggtgtgaaatgtagatcacttaggggagatttgacatcttaatattgaatcgtgaacatggtatgtccctttttttaaaaaaattttttttaagacagggtctcactttgacctccagggctcaagcgatcctcccatctcagcctccccagtagctgggactataggtgcataccaccgtgcctggctaattattattattatttttattttttagagatggagtcttgccatgttgcccagactggtcttcaactcctggtatcaagcgatcttcctgcctcagcctcacaaagtactgggattataggcgtgagccactgaggctggccctttcatttatttagagatcttatttagtttatcccaaatgtgcttgtctgttttgattgtgatttaatgtatgcaacacctattctaggacaggcaaagtacaaagtgccttacacttaatctcccataattacttcctgaacatggattgttctcactgtgttcagatgtcataactgcacctgagcgttacagagccaacaaatgttggaactgggattcaaaggagatctggtcactccaaaggccatgctcttagtctctagtagtcaagataacacatttgagaattctgtagataaatatttaaagacatttttagcaattgttgcatgcttgtttctcacctcctgtctccctcaaccaaaaataaacacataaattgtatgagtggatagatgtatctgtggatgaatagattcgtctttaattcaccatctcaaactcacagtggacttgcgtactattagaaaatcatgttaggattatctttgaaatgcattttaattagccttggtttttttttcctgttatctatctcatctagatatcatcaagcataaagtacatcttgtactatcagcatcacataggaaatcattagcattccccagagttgtctgatcacatgccgtcccattgatgtgttggtcacctgaccccatcatcgttccctgcatctctgaggaggtctaagaatgtgacctacttggatgtcacttgttaaaagttgtctggaactttagttctgcctaatggttttttccttcctttaaaagacaagaaaaatgaatgggctgttttataaccccctttcaatcctctgatcttcagagagaaaaatgttaaaaggcatgatgcagccgttttatgttgcagtttataatctaattaagtgtattttatccagatcattatggacttcattagagctctggactttttgtaagaaagatgatgagttagatttatgtagaatcatttgggtattttaaatgttgtgatcatgccagcagtgcctgattaaaaaacattcaaatctgcctatctgatttagttggtcatttaattttggaaggctcttgcttccaattttgctcactttttttgtaagcatacagtttcagcatgattaataagagaagtttgttgtttggggagagtaccatttgggaatgattctttttagtagcctatatactatttgaacattctgatacatatgggaaataaaacatctaatgcaattggcataatctaggtcaaaaagaaatgaaattacatttttcttttttttttttgtactgcagaagaaattaattttatggcctacagtttaattgctatttttttctggtgtcaggtataagcatttaatctataaattgattggaaaacggaaagtgactcatgttagtcttagttacattatttgaatgtaaatagtcaagagtatttttactctgttttagatatgaggaccaacttctgtgttactccctagtctgttatattaaaaaataagttaatattggctgggtgaggtggctcatgtctataatcccagcactttcagaagcagaggcttgtggattgcttgagctcaggagttcgagaccatcctgtgcaatgtggtgaaaccctgtctctgcaaaacatataaaaattagctgggtatagtgggagacacctgtggtcccagctactcaggaggttgaggtgatgagcctgggaggtggaggctgcagtgaactgtgactgcgccattatactccagcctgggtggcagagtgggaccttgtctcaaaaaaaaaaaaaaaggagtaagaaaaaaaaagaagttaatattaagctctgcttaacaaacatctcatctttccaaagaatagtacttggtatgtcttcctcttcgtaatttcatattttctgaatcaagttgtgtctgtagccttgaatttgcccatccttttacctctcatcatatgatcctagtaacattcatagcttatccccatttggataattttttcaatcagtttactattggtcccaagcaatcctgaattgttattcagtaagggacaatattaaaatataatttgatagttaatattaggtggaacattggttttgcctgactcctttaagccatgaaacttacacctcctcttgggaggagctcgctacctcccagcttgtttatatacatgtgtgcacctgcataatcaaacaaacacactatccaactggtacaacacaacaaaaatcttccggcagtctcagcgttcaccattttagttctaacctgcttacaaagacccaatttgttatcttcataccccttaatttctcatcttcatcatgtctggcctagaaattccttttgctttttatgacctcaccatttacgttggacctgacacttagaacctcttcttcatttatataccttggctttcttcctcaacagtgatagagattgttcctctaggcagactaccttatattattctaggtgaaaaaccacccagtttggcctggctttgaggccctcatcttttgcccaaccttttatggatgatgccctactctctgtcttgtagctgtgtcttaagaaatatgttgtacattgagtctctctgaattcataattgggtaacattatctctgtgaactatttttgtgtgtgttgcactgggctacctggctggaatcatcttggcactactacttcagtgtttttgcgtgatcctcttaattagagaaagaaagaaaaattctagactatgagtctaattaaggcctatatggaacctctgatctttcatttcaaagtgaaaagaacactagcttgtagtttatggccctaatctctaagtatttcgtgaaaggttgtttgttggttatattaatgcgttcactagttgctttcagactaatactaaatggtactgctttttgatattatagtcaacttctgtttacttttgttcagtatttactacgtctattgaaaaatttgtatattttatcttggtggaaaccactgtttattagtgggctattgaagtggtaagtaatgactgaaacattgagatgggttatgcagtgcttcttccttccgagggtttgtgagccactgagtaggtgtgggaggaatctcataagctgacttaagtattagaaaatgataatttacaatgtgtttttatattttttactcattttacttgaaatgctagtttgtttttcagttacaggcagaagcctagcctagctgaactggcacagcgcagttgacgtctgttaaatacatactgtgttttttgtgtttaaaacacatagtatgggccggacgcggtggctcacgcctgtaatcccagcactttgggaggccgagatgggcggatcacgaggtcaggagatcgagatcatcctggctaacacggtgaaaccccgtctctactaaaaatacaaaaaaaaaaaaaaattagccaggcgtggtggcgggcgcctgtagtcctagctactggggaggctgaggcaggagaatggcgtgaacccgggaggcagagcttgcagtgagctgaggttgcacccctgcactccagcctgggcgacagagcgagactccatctcaaaacaaacaaacaaacaaacaaaaaaaacacatagtatatatttaacgactctgttttttgtgaggtggctttgataagtcttccccttgcagagtctaagaagcacagagtcgtttattgtcaggatacttgtggcctgcaactagaactgggctcttgaaggatctcagggttgggctcatgctcacacttgctcctcccctcaaaatgcctccaaccccattttccttgtttctcagtctcttagggcatctgtacataatgctgcatgcctgctatggtctccttttactaagaactagccaaatcctctcgtcgtatgccacagtccaaacccagtctcgcttccttaattaataactatcgcctcctgtttggacaaaaaccatcccagatggacaatgtcctggtttgttcaggcaatggtaagtgagataagatctgttatcttgacaaaaaaggaatcccacaacagacattactttgtgacttaattttcttgaaattgattttaagaacacttttttttttttgctttaaatactttatctcatttgagccttacaataaccttgtgaagttgctatcattctccctgtttgctgatgaggaaacgggtccagagaacttaaggaggctgctgaagttcacaaggttaggaagtggtgaagcccagacttggaatgggctgtcgggcttccatcctctagagcccttactactgtatactatattacatctcactgcagcaaaatacagtttttttgcataatgtgtgcattatgttccgtagaaatggctgtaatgtgatatattcagtcatgccccattaatggacccagtatttttacttttttgtcactaaaatatgcgatagacattctagtgcatacagctttgcacactggcccttttattttgactgaaaaggctcttcaaagtagaattttcttttcttcaaggccacgtgaattttatattctagaaggtgttgccaaatttccccaagaaatattgtttgtaatggattataatttcacccacaatgtattttaccagtgaaatgcttgaaatgaaatatttttccaatctactgggtaaatagtgttaactaacgtgagtttgcatgttcttgaggttgaagaccattttatatactggttatttgcaattccttttttgtgattcacgtgtactattcattttttcattttcatggtgaatttttggtcttttccttatcgatttataggtgttctttgtgacatcaacactttgttcaacattttacggatattttcgctaggatgtcacttgtctcttgacttcagttactaacaaattttacattttttacactggaatatgactatgtaggtttttttaaaaaatgccctgtgggtttcctgtcgtgggtatctttgcttatatcaaagctatataattattttcacatttttttttttttccttctgctacagggtctcactctgttgccaggctggagtacagtggtaggatcatggctcactgtagccttgacctcccttgactcaggcgatcctcctgtctcagccttctgagtagttaggattataggcacacaccaccatgcctggctgatttttttgtgttttttgtagagatgtagtttcatcatgttgcccaggatggtcttgaactcataggctcaaatgatctactccctcagcctcccaaaatgctgggattacaggcatgagccactgtgcccaggctggtgaataatttttaagattgagatatttagtctatctagaaattcttttgtgtatgctttgaggtaatacaatccagctttcttttttccacaggtggagatgcacatatgctaatgcctttttattatacaaatggttcttttccccactcaattgaaaagtcacaattgagtgatttaacacttggcttaaagttatcataacacttggcttttttctgtgctatctggttaattgttcaacttttctgtccctgttctagaatcattctcttttcttttctttttccccatggtttgtagtaagtttggtatctggcaagacaattccactcccactattcttttgcacacttttctttactgttctgtatggacattattgcaaatgagctttaaacttactttaccaagttggagaagaaaaaataccactggattctaattggaatatatggaattaaatgtatgtattaagtttagaaagcatgacattttaagaaagtaacctcctcttcaggaacatatgtttatctttttgttcatatggtattttatatctttcaataatattttctgtttgttatatagagtttatatatattttgttgttaaatttatactgtgtggcatttgatataagttgctactttttataaaatatttttcatttgattttctagctgtttatctctggtacagagaaaactaatgatttctttgtatatttgtcttacatctttgtatctaagtacattctcttattagagttggattttttattaaagttggattttcaaattatgtaatcttatctgtaaataaagatcacctgctacatatatgtatataaaatttcttcttacatcagcaaaatatatatattaaaaaaatatataaaatatatatattttatatatatatattttattgcattttaagttctaaggtacctgcacacaacgtgcaggtttgttacatatgtatacatgtgccatgttggtgtgctgcacccattaactcatcattcacattagatatatctcctaatgctatccctccccactcccaccgccccatgacaggccccggtgtgtgatgttccccttcctgtgtccaagtgttctcattgttcaattcccacctatgagtgagaacatgctgtgtttgattttctgtccttgcgatagtttgctgagaatgatggtttccagcttcatccatgtccctacaaaggacatgaactcatccttttttatggctgcatagtattccatggtgtatatgtgccacattttcttaatctagtctatcattgatggacatttgggttggttccaagtctttgctattgtgaatagtgccgcaataaacatacgtatgcatgtgtctttatagcagcatgatttataatcctttgggtatatacccagtaatgggattgctgggtcatatggtatttctagttctagatccctgaggaattgccacactgtcttccgcaatggttgaactagtttacagtcccaccaacaatgtaaaagtgttcctatttctccacatcctctccagcacctgttgtttcctgactttttaatgatcgccattctaactggtgtgagatggtatctcattgtggttttgatttgcagttctctgatggccagtggtgatgagcattttttcatgtgtctgttggctgcataaatgtcttcttttgagaagtgtctgttcatatcctttgcccactttttgatggggttgatttttttcttgtaaatttaagttcttcatagtttctggatattagccctttgtcaaatgggtagattataaaaattttctcccattctgtaggttgcctgttcattctgatggtggtttcttttgctgtgcagaagctctttagtttaattagatcccatttgtcaattttggcttttgttgccattgcttttggtgttttagacatgaagtcttgcccatgcctatgtcctgaatggtattgcctgggttttcttctagggtttttatggttttaggtctgacatgtaagtctttaatccatcttgaattaatttttgtataaagtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttgtttactatagccttataatatagtttgaagtcaggtagcatgatgcctccagctttgttcttttggcttaggattgacttggtgatgcgggctcttttttggttccatatgaacttcaaagtagttttttccaattctgtgaagaaagtcattggtagcttgatggggatggcattgaatgtataaattaccttgggcagtatgtccgttttcacaatattgagtcttcctatccatgagcatggaatgctcttccatttgtttgtgtcctcttttatttcgttgagcagtggtttgtagttctccttgaagaggtccttcacatcccttgtaagttggattcctaggtattttatactctcaaagcaatattttataaagagtcaataatggttatcctagtccagtttgtcattttaataaaaatggctttaacacttcaccactgagcattaagtctgctattgaattttgctgaatggttcttatcatgtttaagtaatttttacctttcctatttaagtatttttaacagacatatttattgacctaatttgttgcacacctgtacatatgggacctcattacctctcttctgcagccttgatagaataaagagttctggtaaaattgctaactgggctggaaatcagtttgtaagcatttttttcctcagtgaccagtgacctctagcctctctgccaagcatgagacggagcctgactgatctataaattagttctggttttacgtacctacaaaatttcttgcccaaacaacccatttatttgcaagttcttgtactggcatcatcattacccagtttgtgcacatttctctgaaggtaaaatagacatcatgcgatatctccatttgacatggagttctcatgtttactgtatgaacacctgtgtatcttacccagaacatgttattttggtgtgtatggacatggagttgtttaaactattttctataaattgaaccaggaatcattataatttgcactgagaactaaattgaggtaatgaatttttttttgcacagaaactcctcttaatttataaaaatgcactgtgaatcagttcaagttggtctttattcgtagaactgttgaattagaagaaaactggaatatataatattttgtggaatgatctctctccgttttaaaaattgaaatcttagactaaagaggctgtgaaagaacctcactgaggtgtgagagaaaaataaaccacaccaggaaccacgtgcggacactgcagcaggtagagcgagtcctgaatattcctaaaggtgaatgtgcgaacaggcttccctgtacctggagatccccgaaactgttggtgcgagtcattatccagtccactctctgtagccaggttttctcctctggcagggctctaactccaactccagtgtttgggaggaaggggaaggcacgctgtgagagctttgggaagctgccagggaagaactacctcctcagacaattactttctgttgtgcttgactgcacatattattcatcattggctgagcatgttcatcataaatgctgtttaatcacattttaaaggtaaacagcatttatcaaattatcatctggtgtcttgctccaagtcaccactgattcttcaccagaaacctatgccctgcaggagaacgtgtgtgtttatttgttgtcacatgatctgtccaaaggctgagagccacactcatgtcccattgggttatttcctgtgttcccagccattcctcatcttaaaatagtcaccttgttttggttgtgttggttctatctcaagatatagtttcaatatgggcaggacttaattttgcttttttggatctttctgaatgtctgtagtgggtgttgaagcattttatgttcagaacatatgagcattttaattgattggcttctactgctttacatagtactgtgtgctcagtaaatattagtctgaataaaggcaatgcatgaggagactttggtagattatgtgattttgtgtgaatatcataaattcttaaatttcttcctttgtcttgtttttacatgaaaggtagtagatgaagcagagttaatccatggagtaatcgatgctgtgtatatgtgtacatgtgcatacttaagtgcaggtgttggcatgtgtttatttatgtgtagatagaggtggggataaagaagtagtgacaatggctgaaaaaagagacaaacatttcccagtgtgttctggaaattgtgttaggccactcggaccatttgatttttcatttatccctaagagtatatttacgtatttattaagagtagccactattcagagcccctggaaatagcctcaacaaaatgagtaaaaaattaatctccagtaaaaaacatagcagagaatgtgtggtcaaagctttgttgaaggtaaatacagggtttctggggttgggggaagacaaaacagggcagccatactagaatgggttcagaaaggctttgaagtgtgtgttgagcttagtcctgaagattaagaaggaggtaacttaccaaaaagggtgcaaagtggttctatacaaaggaaaccgtgtaagagaatgattgattaacgcagctctgatttcttctggggtgatcagggagaaatattctgaacttaagacatcataggaggttcctgtgttagaatcggttcactaataatgcgaagtccttacatggagagaggtaattgaacggtgttcccaaagagcagaccggtgccactgagtgctccgtggcttggagtgtgaacctgtggaaggtgctgagctcctcactgcttaatctgcagttaggaatttttacaaaccctgagtatgtggctcttgaattacagttatattcttatacgttcccatggattttcctccacagtttttttcctgtcatattaatttgtttccaatcttagtttctctccattcttaaaatatttagtatatatctgtgaatccagagaaacgtaagtatttgttactgctggagagtgttataaattcaaatgatgagctatataaaggtagaatttagagggaaatattagcttttctttgtagctgtgccttccagaacacacagaaaacttgaagctttctgcagttagaggattatgggcattcaaatcaaatggacttggggtcccatcctcaaaatgtgacttatcagtcataagaccttgaacaaattgcttaatctttttgaatccatcattttctcaactatgaaatgaaagcaataaaaccaattttgtggtggagagtgttagaaaaagtgtttcagagtgtacctcataagggcccaggaaatacgcaggtagcaatttttattggtagtttcatctaggaatacaaattatgattaaagcgtatgtatttagtcaccctttttttttttcccaataaagattacataccatctagattgagctaggtataactctgagtccgtccattggaagagaggttataccccctccaattctcttccagaaccagaagtcatgatttttctgatatacccagtttatgtgatcactcaggctatgaatgtttttctctctcttcctttagcgttacctacttagagagtatgaacattgctgagtttacccactacaggtcttggacttatcgtgtgcatacgacgtagggccctggcaacactgggatacatgcccaggcacacacacacagagactttcctttcacaaaagaagtttaacttgggacaagctaataagaaacttactattagaaacttcagaatgctgttatgtaggtttcagcatatgcagaattttgtcttttgatgattagtatttttattttgaagtccgcactgaggagagagagtgagaaacatgaagtcatttcactctgtggggactctaaagagcttctttccaccctcaggatggtgggtccagcgtgtgttgcttaagggtgggaatattttctgggaagtgcatcttcaggcaacttcatagctgagcaaacatcatagaggtacctacacagacctggatggtatagcccactatacacctgggctgtgaagtatcgtctcttgctcctgggctataaacccgaacagcatgttactgtactgaatgctgaggcaattttaacacaaggttaagtatttgtgtatctaaacatagaaaaggaatagtaaaaatacagtattataatcttatgggaccaccattgtatgtgtgttctgtccttgactgaaatgtcattatgcagtgcgtgactatatatctgtcttttttctaccatgtggttcttggagaatttatatatatcagagagggaaaaagacacaaccatctatcttctagttatttgctatttgtgcgatattttacatgattttcaaacatatttctaagcagcaaatattaagatgtgttacaatcagtgacatgtagaccacaaaattctagcgctctataagaactgaggaatcaatgactacaggagttttcagaatattttaccacctcagcaccttttcaaatgaaaggagatacgggagccccatgagtcattttgttctggggaatggagtcggtaactactggtttaatataagccccagctgaggaccttgacatccagaaggatttatccccacgtggctaaacttaaattgtttctctgtttggtggctggctgcattttgggttaatttggcaaattcctacgagaaagcagtgctcagacggcagcatcagcttcattgagatacttcttctaagagaagtgagacgttgggtcagcaccattctgagcccaaggtcacattttcgtgagaaaaaagataagcggcagcacttgcgtttgtggtggcgaagcacaagtatttaatttctgaataagctgtgatggtggggtgtctgtgccaggaagcttgaatccgggtcatgttcctacttattgaacccctccggagctacataaatcctcttctgttttcatctttgttgttattaatatcccggttgtatatgtaatacaggaaatatccaaaacagcccaatattaattgcaaaccacgtgttagaatacagctatttgaaaagtgaatgctatttctgtttcatgataggatcttgtaaggttgactgaataaatacagtttaatactagccgggagaaatgtcttacttaattctattacatcacagatcatgtcggacgttaactgtaacttacgctaagacaatggtactaatcaatgctgcgttaatgttgttacttttctagtacttgaaataagcttgggcttagccactcttcttctcatatcccttttgatctagtggcaagatgttgagaactattgggcctggtctgtgtctttgaaatacaatataggtcattggcagagagtactgaacctgcgcccttggctccattacagcatgacctaatcaattgagaaaacgcctctccacggcttttctctggatgattctcccctccttactaccctgtgactgatgtttgtcatcttgtggctcaactaaactgtcgccagttactcctactcttttgatctcacatgctgtgagtcttacccattggcgcttagtagaatttatggaatcaatttgtgtaaatggagacatgaaatctcagtttgtagtatcagtttgagggatacagcaatcccacatttcgaaggctgctacagatcattcacaggtgttagacttattacagagctgtgtctttcttattccccaaagcctttgccactttggttttatatgttggtttcggtaaatacacattttctaatatgcatgttgtagacagtatagtgaagtgtggtgggtgcatatctgcatatacctatgtttacatctagatgaacatataaataaaatatacatctcaatatgcatgtatatggggatgagggcatataaatatgaataactttgttttggtcaggacagagcaaccgactacaattgccaggataatttttgtaattcaacaagagagattttaaattgttattacacattgctatttgtattttttaggatgcaaatccatgctgaaacctccaaatttccacggtctatgttttgttccttcacttataactgtgtctgcttctccatggtaggagaaaacaaggaaaggaaattgtgactttaaaatattaaactctggtagagacttgaacggccaatttttgtttatttgtttgttctttttcccatcctttccccagtgtttttttcctgaaagtcttgcctattttatgcaaataacatgtattttaattggcaacattttactttccctgtttctacttacaaaatttccacaaagatatttgttttaaatttatagaatgcaaaaactaaattcattacaaactaaggctaggagcctttagaccctggagcacagtcatgcaggaacagaagaatgagtatgaagtggaaatcccgagagatcccctagttgtaagaactctaacagatgcccccatgtcactgatgtcggaaagatgttggagctaggcaaagcctgatagaatgggtgatttgtgaaatttttatacagcgatcacctagaaaacacttttctaattttcttttgataggattcgtatttgtgtcgagaagtgttttttaacgtctagaatacagtggcctgagagttacccgaggcacatgtggataggtacgtcctggctcccaccaggatgctcgctccattttgtgtctcagccttccgtcgaaagttttcatttgttcgtttgctttttaagaaagagtttttgataattctgtcttagaaggatgagtagttgtctcattaagaagactcttggtggtagcatggtctgactagcttaaggtacagtctttcctctttgagtttcctgtggttttactaactctttgctttccctctgacataaaaactagaagccataaattacggataaattccactacgtaaaataagagatctttaaaactctgcatggcaaagccactataagacaagtaaaaaactaaactgggagaaaaatagttgcagcttatatctcagagaaaagataatttccctaatgctggggttgggaactacagcccaaggcccatatctggcctgctgcctgtttttatcaatcaagttttattagaacacagccacactcatttgtttgcatattgtttgtggctgctttcaccctatggtggcagaattgaatagctgcaacagggaccttatggtccacaaaaccaacagtatttattatctggcacttcacagaaaagtttgccaactcttgctctgatgaataaggagttgctacaactacaaatcaatatgaaaagaccaacaaaccagtagaaaaataggcaggagatatgtttgttagtgtctcaggaaaacaaagcaatagcaaacaggtttctccacaaatgcttcttctccccaaatggggcaacttacagaggtgagggcaggattttggggacaaaaagggaatgacattgtgacgctcggagacctgcaaatgtgggaagctattactatccctgggattgaaggcagggacaaagagagagaacggcattgccggagcaggaaagatgggtcatccgaagaaggctgtgatcatggaggatgtagccactgtgagaaatatgtccttgaagcaggatggaaatgggaaagatatctctccttccacctgctaacctcctgctagtgcctcccagaagttatcagaggagggagtccaggtgatgctgtcctcaggggtgagcttcctatgacacagatgaaaagctcctcagctcattcataataagagcagtgcaaatgaatatgatactgaaatgtcacttttaacctatcagattggcaaacagcagaatgttaacaccttgtattggcaagggtatagggaaacaggtactatatagatacagatatgtatatatgaaggtaatatctttcaaaattataaattcatatatcctttgactcagcaattacatttataggaatttagctaatacatgatactttagctaatacatgaaatgacctatgtgtaaggttatttattgcaaccttgtttgtaataggaatacaatggagataacctaaatgtctatctgtagggaactggttatataaattatgctacatccattcaagggaattctctgaagccataaaaaacgatgaggaagctctttgtgtcctcatatgaaatcaacgctcagttatgccattaagagtacagagaatttgtctcagctttggctttcataactaaatgatgataataaaataaaaggcgaggcgtggtggctcatgcctataatcccagcactttgggaggccgaggcgggcggatcacgaggtcaggagattgagaccatcctggctaagatggtgaaaccccatctctactaaaagtacaaaaaaaaaaaaaaaaattagccgggcttagtggcaggcgcctgtagtcccagctactcaggaggctgaggcaggagaatggcgtaaacccgggaggtggagcttgcagtgagccgagatcgcaccactgcactccagcctgggcaacaaagcgagactccgtctcaaaaaaacaaaacaaaacaaaaaaaaaaaaaagagagaaagaagagtacagagaaaataaaataggatgtgtagtttatggttatttgtgtaaaaaatgaagaaaaggaagatataaagcatgttcttgtgtatgtataaaataacatcccaagaaatgatgaaattggatgcctctggagaaggagactgcgggggtggatggggggatggtcatcctgttgtgtcttttgaatactgattaaaataagtttaaaatctccttaagggccaggtaaacagctttcatctgaaaatttgagaaacatctcaaaattctagtccctgcctgtggctttcaataattatcagataagatctgaaaagctgattggcaaatccaatgtgaaatgataacttgaaggacttccaggaggaagccctgtctcctcttcaacccaattttaaccttggcctgttggtataagtcccaggtactgtttcttaaatttttttcttcaacatacttaaaatcaatgacactgtatattttttaaatgctccgtcatttgcactttcaactggttctggctgctcccatctgttggttcgatttattgaaagttttgtaggtgtgtcatccctccttgtcacttaagacaggtacatgctttagttgtttagagctgcatctttagaatatttattttgatgtggagaaaatggtggattatcaacaagtaaacacctggacaatcagaggatcaaaataaaagacaaatctggatttataagtctctctcttttattattttttttctgggcaagatttgcctgaagtggaaagagttgaatatggatgagcgcatgttgcagactgattttcagccgtaattgctttgcagcaggaaaataggcaaagaaaggagattgggaatataggcaatcaaagacgaggttctcacacctgccagataccatgtgtagcatacaggcatccgcagagaaatggaaattctcttatcctgtgacaagatgttccaattaatgcgattcggatacatctgtctgcccgtagctcacctcgtgaaacgacagtcccgtcctgctgctggagtcagtcaaaaggctcattttgtgagtggcacagcagtcatcctgggaactgtgccgcggggctgtgaccctccttcctttcggtttacttcaactcagaaacttcctttccgtttatttcaactacagggaacatcctagctggaaggcttgcagcaagatggcattgagatcataaacgccattctgaaagcatatgttcttcagacacgtggctgtggaatgggggttgacatggcaaattgccaggttttgattgctgaaacaaagatatgtttactatattaattttggcatgaaaaagagttggacagtgtatggatcctttcaggccttaacttagaattgagtttaaacagggcctcctgggtgattttatctcctgaggcagtgacctggaagggtagggtcaggtgggaggctggggagacgtttgctgtgccacaggctttcctcctaattttatttttgaggccggaacactatgacgcttcatactgtctgcatatattgggggaggaaggtgtctgtgtgtctgtattttctcttataaagtatacttataaagtagccaggagcttcatacaagcgaatttgtgcggcagggatctggcagcaggggatggagaactctgggaaaggtgggattacattgcagcgtcggcaaagtactaaggattgccgcggtcctccagaaggccaaggtcgtgcgtctgccatcagttcttcacgcagtccgacagtgctgtgtggagccagcagcccccaattcccttatttgccccagccttgctcacctctcacctccctcttctgcactcatttgcccccagccatgctcacctccacctcttctgcagattttttgcactgatggtctgttctccacttgttctctgagtcttcatatatgagacttttcctgtcttaactagctgtgaactcttgagcacatgaaaccaagctttattcttttcatgttctttcttcattgtctgtaaaagagcatgccaattaatttttggccttgattcatcttttttgactgtgactcttaaccaactggatcataatcccctacaacctgctccactggtcatattttttgatggaagaaattagttggcacctgagttgtacagttttgctgtaggaatgtggatgaatgttatttagcgtgaaataatacttcctcaaagttcagattcatagggaaaaaaaggctaaatgttccaaaaagtgtgtatgttatgatcagaccctttcatggagttacgtcttcatttgatccacaaataaaaatctactaggatgcattctgtctatgtacaacttcttagaggaaagaaattaacatttaatgagcttctgttattgccaagaactgtctgtgctaggcaatttttcatatacgtaataatttttaaattattgctcaattctatatatttaatctttgcagtgatattctgaaatatgattattttaatttctttgaagtaaaccttttatttttgagataattatagattcatatacagttgtaagatagaacacagagaggactttgtaacctttatctagtttcctcagatggcaacatcttgcaaaactgtaaaactatcacaaccagaacactgacatttaaaaaaatttttaatttattttttaattaattaattaatttttttgaggcagagtctcactctgttgcccaggctggagtgcggtagcgtgatcttggctcactgcaacttccacctcctgggttcaagcgattctcgtgcctcagcctcacgagtaggtgagattacaggcacgcgccaccacgcctggctaatttttgtatttttaatggagatggggtttcaccatggttggccaggctggtcttgaactcctgacctcacgtgatccgcctgcctcggcctcccaaagtgctgggattacaggtgtgagccagcacccggccagaacattgatgttttgacatttgatatggtcaagaaacagggcatttctatcaccacaagaattcctcacgttgcccttttatagatacattcactttccttacatcccaaccgctctttaacctgtagagctactaatctgtactccatttctctaatgttgccatttcaagaaagttgtataaatagaaaatgcagtgtgtaaccttctgggtttttttttcacttaggataataactctccagagatttatccaggttgttgcccttatccctagttttttttttattaccaattagtattccatggtgtggatggaccacagtttaacctttcaccctttgaaggacatctgtgttgcttccagttttttattactataaataaagttgctgtaaacattcatgcactggttttatgggaacatggtttttcatgtctttgggataaatgctcaggaatgcaaattgctcggttgtatgctagttgcatatttagcaggtttagcttgcaacttgcagcgatccctaaagcattcatgattatcattcttattatatacatttgaggaaattaaagcctagagtagttagttcacatacccaaaattacataactagttaagtagtggagccagtacttgaacccatgtctgcctgaactctccaaatctacatcttttccagtgaggactctgctaaagtatataaccttttacatgtatcagtgtttggaatggaaactaacggttctgttttcacctgaccttgaatcactaaaaatgagaagatgatttcatagtcacaatattgtatctgatttttttcctcaaaagagcagaaagcaaatatgagtacagaagacaccaaagttcatggtagaaattatcaaattaggattcctagcatttgaatgcgagggaatggagctttatgatcccatctttggtgagaggttgttgctcagtgaatcaagggcagagccaggactcggatatgagctctccatcccgttctgtctggctgccatctgtctctccttcagtgctagggcaggcagctcatggctggtaatgctcagaaatgcagatactatcaattattggtgtgttagcggcaaatatgtgggtagaggagggggagagtgagagattcccaggtgttaggtgacctgatcatgacaggtactgaaactctgaggccatttatggttatgagatgcactgtggggaattgcagccccttcctgtaatctacagggttatttctgggtgacattttgacaggaagatgtcctgtgggaaaagactgctaactcagtttgcctgcccaacagttaattattaatacttcatggctgaaagtggagtaatgttccttgtatgccttttatggagttcttggtattttgtttattctttttttctgataaaaaggagaaggttttattaagcagtttgagaaaattacagccacaaaattgcacgttgcttcgagggtgtaagggtcgtttcaacgtaactttagagtctctgtaatttatgctgctacaggaaatatcccttctgtctcagagattttaaacaaaggcagggtggttatcactctgctttctacagcctaaatattgtttctgaattaaaatggctgatttcaatttagtctctgcagactacaataaagctagaatgaaaccaacctaattttatcttcatagcagtaaaaccctttgaaatcagcttcttcactaactttttttttttttttcgagacaaagtctcgctctgtcgcccaggctggagtgcagtggcgcgatctctgctcactgcatcctccgcctccctggttcaagcgattctcctgcctcagcctcccgagtagctgggactacaggcgcccgccaccacgcctggctaattttttatatttttagtagagatggggtttcaccacgttagccaggatggttttgatctcctgacttcgtgatctgcctgcctcggcctcccagagtgctgggattatagccgtgagccactgcgcctggccccataacttctttttaatctgaaataatttttatttccagggatcaatgttatttctattgtaataatggattttgccagttaatacttcatttggtttctgaccttgatatttaatatatatttaatacctaaataagattccagaagttggtctgaataaacccataatccttctttgcttgacaactagtttgctaccaagatcatttagtatgatttattataatgattatcgtatcaatggtcctttctttatgtgatttcctatgaaaaccctgtataatagtgtcataaaacattgctagaaacatacagataaaaggtctagtctatagccctcactttatgtataagcaagttccttacctggcaggtgattccatactaagtttgtctgggaataagaagcttgtaatacatcagtgattttttcaaacagtgttttggggaagcagccctgtcctctccctacaagcacaggcatgcttgtgcacccccactaaacacgtccacatgccttgccttgatttcatgagatcactgttactgggggattctattttgggatttacgtaacattgtttgatgtaagcgttccactgcaaaaaaaagtttgaaaactgtagtcaagaggcttaataaggctttttagggctctgacatcaatgatacatagtaaataacgtaatttgtgtgcgggtttgtatttatgatctatgtgacaggtgtggcgatggtgcaactccttttttcctttttagttgacacataataattgtacacatttatgggatacagagtgatattttcatatgtgtatataatatgtaatgatcaaatcagagtgatcactataccatcacctcaaatatttatttgtgttgtgaacattaaaaaatactctcctctaactttttgaaaaatataatacagttgagcatattcagcgtacaatgctgcagaacacgcaaactccatcctctctatgtaactgtaattttgtatccatcaaacaacctccctcccattcttccatttcccagcctccaatacccacaagttctactttgatgagcacaaaacaacatcttttttgctcccacataagagccagaatatgtgatatctgtttttctgtgcttgacatatttcacttaacataatgtccttcgggctcattcctgttgctgcaaatgacaggattccattcttttctatggctgaatagtactccatcatgtctgtatctatgttttctttatccattaatgcttcatgcgtgaaagtagagtggtgttacttgtatgtcttttatggagttaaatatccactgatggatatttaggttgattcagtatcttagctattgtgaatagtgctgcaatacgcattgggggtgtgcgtatccctttgatttcctttcttttgtaaaaaaaaaaaaaaaaaagaaagaaagaaaggaaacccagtgctgggattgctggatcctatggtagttctcttttagtttttttgtggaaatgctgtgctcttttctacagtggctgtacctatttgcattcccaccaacagtgtgtgagttcccttttctctgcattttcaccagcatgttatcttttctttttttgataacagccatcctaactgtggtaagatgatatttcattgtggttttgattcgtatttccctggtgattagtgatgttgaacattttttcatatatttgctggccatttgcatattttctttttctttttctttctttttttttttttttttctgagacagagtctcactctgtcagccaggctggagtgcagtggtaggatcttggctcactgcaacctctgtctcccgggctcaagcaattctcctgcttcagcctcctgggtagctgggattacaggcgtgtgtcaccacgcctggctaattttttgtatttttagtagagatggggtttcaccattttggccaggctggtctgaactcctgacctcaggtgatctgcccgcctctgtctcccaaggtgctgggattacaggcatgagccaccgtgcctggcctgcatattttcttttgagacatttctattcatatcatttgcccactttttaactggattatattttggatattaattccttgctgaacatgtaatttgcaaatatttattgctacagattgtctcttcagtctcttgattgttttctttgctgtacagaaaccttttagtttaatatagtgccatttgtctatttttgttggctgtacttttgaggtcttagccataaaatatttgcctagaccaatgtcctgaagtgttttcttctagtagttttatagttttgggtcctatgttcaaatctttaattcattttgagtttacttttgtatacagtgataatggtctcctttcactcttctgctttggatatggaatcttcccaacaccatttattgaacagggtgtcttttcctcagtctgttttcttgacacattttacaattggttggctgtaaatatgtgaatttatctctaggttctctattctatgctaatggtttgtgtgtttgtttttataccagtaccatatggttttggttcctatagctttgtagcatattttgaagtcaggtagtgtgatacttcctgttttgttatttttgctcattattgctttggctattcatggtcttttgtgtttccatacaaattttaggatttaaaaaaatatttctgtgaaacatgtggtttggtattttgacaggtattacattacatctgtagattgctttgggtagcatggtcatcttaacaatattaattcttccaatttataagcatgggacatctccatttgtttgtattctcttcagtttctaccatcagtgtttcatagttgtccttctagagttctctctcctccttcaataaatttattgttagatactttatttatgtttttgtagctgttgtaagtggaattgcttttctaatttcttttttcactacttcgttattgatgtatagttttgtatattgattttgtatcttgcaactttactgaattcatttatcagttcaaagagttttttggtggagtctttagatttttctgtatataggattatgtcattcacaaagagggacaatttgacttccttttttccaatttggatgccctttgtttctttctcttgcctggttgctctgactaggacttccactactcattattgattttttcaggttttctccttcttcctaattcaattttggtaggttgtgtatgtctaggatttatttcctttaggtttttcagtttgtcagcattgtcaagattgttgttcgtaacagtctctaatgatcctttgtatttctgtggtatcagttgtaatgccttgtttttcatttctgattactttcttcactgaagatttgaccccctcaaagtcatccatgaggattggaatcaaccttccaaactcttgttaatgttgatattttgatctccttctatgaagtatgagtgttcctaatggtgtctggaatagtgaatcctttccagaaggttttcaatttactgtccccagatccatcagaagaatcaatattgatggcagctatagccttacaaaatgtatttcttaaataataagacttgaaagttgaattactccttgatccatgggctgaagactagattttgtgttagtaggcaagaaaacagcattcgtcttcttgtacatctccatcggagctcttggatgactaggtgcgttgtcaatcaacagtaatgttttcaaagcaatcttattcctgagcagtaggtcacaagaatggacttcagatattcagtaaactatgcttaaaaacagatatgctgtcacccaggctttgttattacattggtagaacatgggcagtacagatttaccacagttcttaagggctgtaggattttttaaatggtaaatgaacatttgcttcaacttaaagtcaccagctggcattagaccctaacaagagagtcattctgtcttttgaagttttgaagcaaagcattgacctctcctctagttatggaagtcttagatggtatctcatcccaatataaggcggtttcatctacactgaaagtctgcttttccttgttgccaccctcatcagtcatctcagctagatcttcttgataacttgctgcaacgtcaccttgcagttttaagttacggagatggcttctttccttaaacctcatgaaccaacctctgctactttccaccgtttcttctgtcgtttctcacctctctcagcctttatagaatttaagcaagttagggctttcctctggattaggctttggcttaagggaatattgtggcttatttgatcttctgtccagatcactcagactttctccctatcagcaataaggctgtctcactttctgattatttgtgtgttcactggagtagcacttttaatttccctcaagagtgtttcttttgcatttacaagttggctaactgttttgtgcaacacatgtgtctttcagtttatcttagttctcgacatgtcttcctcactgagcttcatcatttctagctcttgaatcacagcgagagatgtgcaactcctcctttcacgtgaacacttagaggccattgtaaggttactaactgggctaatttcagtattattgtgtctcagggatatggaggcctgaggagagggagagagacaggaatgaagttggtgaagctgtcagaatgcacacattcatggattaagttaactgtctcatatgggcactgttcatggtgccccaaaacaattacagtagtaatgtcaaagaacactgataagcatcacagatagaacagtgaaaaagtttgaattattgtgagaattaccaaaatgtgacaacagacacatgaagtgcacacatgctattggacaaatggtgctaatagacttgttcaacaaaggattcacaaaccttctatctagtaaacacaagatccatgaagcacagcagagtgaagctcagtacacgcaatgaggtgtacttataattttgtttagtggagtgcgtctttcaagggtatgtgattaaactctgtatatcctatagatgcaggtaattacttagaagtcactgatataaatgagtatttgatctaagacttctttatgctctcttctgcaagacctagggaaggtcaaaagaaggactgtttttgaagaaagagaaactttttttctggtatgggttttcattttcttttcttttttttggcgggtgggggatgaagtctcactcactctgtcacatgggctggagtgcagtggcacgatcttggctcactgcaatctctgccttcactgcaacctacctcctgggttcaagcgattctcttgcctcagcctcccaagtagctgggacttcccaccagcacgtgtgtctaatttttgtatttttagtagagacagtgttttaccatattggccaggctggtcttaaactcctggcctcaggtaatccacctgcctcggcctcccaaattgctgggattacaggcatgagccactgtgctgggccaggtttttctttagaacacttgggactctcacatatagcaccttaggtcactgaaaattctgttgcttcctctcagtaacatcactgaatctatacctctattgagcttaatcatacatcactcagatgacaaagggagagatcatgctcacttccttcatcaagagggtacattgctaagcttatggctggagtctctgtctttgcaaagacaccaagtcctggaaatttctgtctgtgctttctttgtggttggtgtgggctagcctagtgtataggacgcagctttttctgaggtatgagtgttttgaccttacataattctcttcatgattcaattaatgaattccagaaaatgaccgtcacagtactggtacctcttttcggtttttagagggatgtgagacgtctttgtgtttgggacacatttgggtggagggtacagctccctttctgatggccactgtcatattcagggcaatctgtttcttttcttctgaattagatttgctgtatcttccttcctagatgctgtccacttgctgtatctcccttcctagatgctgtccacttgctgtatctcccttcctagatgctgtccacttgctgtatctcccttcctagatgctgttcacttgctgtatctgtcttcctagatgctgtctacttcctgtatctccttcctagatgctgtccacttgctgtatctcccttcctagatgctgtccacttcctgtatctccttcctagatgctgtccacttcctgtatctcccttcctagatgctgtccacttgctgtatctctcttcctagatgctgtccacttgctgtatctgtcttcctagatgctgtccacttgctgtatctcccttcctagatgctgtccacttgctgtatctctcttcctagatgctgtccacttcctgtatctccttcctagatgctgtccacttcctgtatctcccttcctagatgctgtccacttgctgtatctcccttcctagatgctgtccacttgctgtatctcccttcctagatgctgtccacttgctgtatctgtcttcctagatgctgtccacttcctgtatctccttcctagatgctgtccacttcctgtatctcccttcctagatgctgtccacttgctgtatctcccttcctagatgctgtccacttgctgtatctgccttcctagatgctgtccacttgctgtatctcccttcctagatgctgtccacttgctgtatctctcttcctagatgctgcccacttcctgtatctccttcctagatgctgtccacttcctggatctcccttcctagatgctgtccacttgctgtatctgtcttcctagatgctgtccacttgctgtatctcccttcctagatgctgtccacttgctgtatctctcttcctagatgctgtccacttcctgtatctccttcctagatgctgtccacttcctgtatctcccttcctagatgctgtccacttcctgtatctccttcctagatgctgtccacttcctgtatctctcttcctagatgctgtccaccaatacatctttaaccttttgttgttcaggcagaatgaggttcctcttttttgggaaaaagataaaatgtaagctatatagtacatctgtgactgtatcctggaatatttcttgttttctcgcttccatattatattgcagaaagcagaatctgatggagtatgaaaaaatattggactatgatagaagcaacctgattttcatctcaatttgacctctaggttacctggccaggacatttgctgtaaattcagtgatctctgtagttcctcattttatcccctcccacctaacagtgatagtcatataataattttgaaagaattaactgtctttattctttatttttttaaccaaatcatcagtatatgccatccacagaagtctctctgaaatagtagctaacaactactaggtgtgtactaagtactgggtgatatttttcagtaacacacacacacacacacacacacacacacacacacagttttgtaatagtcctgtgaagtgggttctgaggttaaatgactcaccaaagatacatagctggaaattggaaatccaggatttgaactcacgcccctgtagcccctgaacgtgccgtcttttttgttgtatgtccctctctttgtcttaaagtggaaagcaagagcttcattcttctagtaaatataactcccaaagtgaaacaatttattctgagcatcatcctctacactgtgaaaagtacaaaacataagtcctttttttttccttgacaatgctaaaatagtaatgattttggaaaatgggaaagaacaactcttttctactgaaaactgtgggggaaatgattcaagcagctacacttggtcattttcagacatttaatattctctgtcatatctttgaattctctaatctagtaacaagacacatttgattaatctgcgagagctagctatattatctcatctctgttttctaattgctcgttttgaaggaccacagttatgcacagacagacattccaacacagctctccctcggtgccttcagcatatcatctcttgagactcttctcactgattagcaagagcttggtttttaagtagatgcttctttaattcccagcacttgtgtctcttagctgttctcattcaccgtggatactgaaaccagggcagttacactgtgagttggaacaaaaacctgcctgtgtcctaaatggagaggcacacctgattgggaagtttagagaatggattggtagagaagttcggtggtatactttattgatgcttaaaaatcgtacagtctaacaagtgatctcactctttctaaattgcatcctatatcctgatttgaaaaagggaaatggaaaattcttcacagaattaaaatttagataagaaaatctagagttaaggttgctatttttgctatttactgttgtgaggtggtattaccctggcaccatggaaagtgcgaagtgaaagccttctcctcccagccactcctaatttttgaaagggatttattgtaacaatttggtatgtgtcccagaatactttccatgtgtatccacacaatatttgcacatgcagagttatattagttatacccatctacaatttgctggaaacattttcttaacaatgacacaggccatctttctacgctgatagatacagccctatctttttaaaatgtccatatacataatgtagcataataataattgctaacatttattgagctcgtatatgtcaagtgttttactaaactctttatatacagacgaggaaaccaagatttacagaggttatgtaagttgcctcaggtcgcactgttagtgtgtgtcaaagtcaggatttaaagcaaggctgcgtggctccagaacccacgttcttaccccctcgctgtgcactgtagttctcatactcaatctcctattgatagacattggccctcattttccaccataacaaacatttctgtaatgaacatcttcgtatagagatgcttgagagagcatttttctctgatatgtgcattttaatgtttgagaaccaacctggtttttgaaaacaatttttgcccatattgacttgtgcaaagaggtgatggcctctctgtagagggactgatgtcttaagtacagcaatgcatttgcttcataatgatcatgaatttgcgttctctcgtcatttgatttagactttcatttgtttaacgaaggaccacagtctgtggctgtgttcagcagtgctcactcttagttgctgtggatgttcatgtttccagcgatcagtgtccctcttaacctaggagaggaaacgctgattatgtcacagtttgaagtgctgtgcccctaccagtcaaaccttccaagaggtcacagacagaatgtcgaagcaacacagaacccacgaagtgagctgctgatatcctatgctcaatatcacattgaaatgcacagtttcatttttccatctttccattttccatttgaatgggttttgatttgctgaaaaatgaataaaaatatacaaacaaaaaacttgctatgtaaaatttttgcctgtattgctgagaaagcaatagaattgaattgagatagcttttcatcaatggagtgataattaatcagggtgtagggaggctgatcaataatataatgatgaataagtaaatgttctgccttccaagaagcatttcctggacctctttctttccacaaatctgcatgaccaatctttatgctagactgggtggctagttggccaggcaggtatttttgtggttgtacgaactcaagtctgtggacgttagtccttctctgaggccacttcctcacctcccattacttaactacagacaattctgtgtcaggggctctgtggcgcagtgtgggtgatcaggaatcagaatataccatctgtaccacaggaagattaactctaagtctttcttcaggctagagctatattttgtactcaaacaaaaagacatagtagaattctgtacccatgtcagaaggcttcaaagctcctctgtcttccttgaactttgctgtttggtgacagcaagggcagtagaagtggaactcctgaccttcacccgaggtgaagaaaggaacttctatcagagactgagagatacacttcatactttccttctctctgttaaattggtgactgccttgtgattgtcacatgtttctggtattggcgttgagaatcattcaccgttacctttacaaagcaatgatattctctttagtttttatgtttacaatcaaatttgctgtttacttagacaaacctatacacgtttgttctgggagctgtatgaacaggtacatgctcatgcaggtaggccttaagaagagggagatgtaggtttgatgctataatgaatgatgagtttcagattcagtcacgttaaaagttgagagggtgggaatcagagagccagaaaagtggttaagaccatgagtttacagtcaggctttctgacttcaattctgcttctaacctagaaaaacctattcacactcctgggcttcagttttcttatctataaaatgcgactgattattatgatgagtatctactttgtagcttatcatagaatgatgtgagtttacaccgatagagcatttagaatactatctgacatatagcgctcagttcaataagtgttagctactgttattattgttatgatttcatcataattattattttgctattctaacagcctcctttcttgtaatgagtcaggaccaaaactaaagcatttgaaatggagaggttaaagtttcgaataccaagttaggtttagtgtttgttggaaaggaaacagaatttacagactttgtaggcttttgaaacctaagaagccaagaagaattctcttcattatgtaatttcccatagctcattaggaaatcaagaccacaagaagcctccccaatgtgtttagtaatttctcgttgaaaatcacaggtcttgagaacactgttttatttatggtactttttaaaaggtattgtgctgaagaaaaggaaatcagtatagattttgcttgcctgttagcctctagataagtcttattgcagtcagcagtctgctgtgttcttgtgcaatggtggcagaaatagatgtcaaatccgtcagtaggacaggattacgttcagacggaccccataagacactgctttgattgggtagaggaggctgtgaaatcccttggttctgagaattgaatacttgtgaagatgatagtaaactcttctggcaggcaagtaacaagtctataaccaagaagatatatattgtgtttgtgaagagaaaaatctcctttctttctaatatatcttacatatcttgttaaattgcttcatgccatgctgctatatatgtattttctttcaaaggcctgagttccaagaaagcaacaattttatttgtaatactgttctttatttttaaaactatgtattttatatatgtacatttatatatatgtatgtatatatttacatttagtaccttggtactggccttataggatttgaaaaaattaaattaataattacatttttctttcattggcatttaagatagcacagatggacctaggtaatctagatatgaattcttgaccacatgacaaacacagatttaaaactttatgaattaggtgagtccctttatgtcaagaacacagctacgatcatcttttgtggaaataacaaagatagggtttttttggttggtctttttgacaatgcttttggattctataaggttctatgaccagtatttgtaactcagacctaggatttagaaaaagtcattgcctacatgaaaaatattcctcttttagcctttcttttctaatgtcttgttttggaagaaatcaaaagaatagctgtaaagcgtttgagagactccagagcagcgtttgacactagtgacattttgggctggataacctttggtcgtgggggctgtcttgtgcattgtagggtgtgtagcagtatcctaggcctttgccactagatgctaatcatactttcctacccagtcttcagactcagaaatgtctccaaacattgccagacttccagggggaggagcaaaatcagccctgattgagaatcactggagtggagagtaatggagaagttcagaaatgcaaaaagctcagagaaaaatggggctcagaggaaatagaaaagtagcaaggggttcaggctttctaaatcaacaaaatacaattttctattaaaaaaaataagtcaagaaccaaataagatatcaagaaattatctgcaacatttaagccaaagcattgatacctttaacacacatacagcgtaaactaatcaagaagaaatctgctgggcatggtggctcatgcctgtaatctcagtgctttgggaggccaaggcaggaggattgcttgagcacaggagtttgagaccagtctgggaaaaatagcaaaatccatctctacaggaaaaaaaaaaaaaagccagcatggtggtgcacacctgtggtcctagctacttgggaggctgtggcaggaagattgcatgagccccggaatttgaagctgcagtgagctgtgatttttgccactgtactccagcctaaatgacagagcaagaccccatctgtaaacaaagaaaaaaagtttaaaatcaatgaggtgtgtataggtaaatagacaaagcacgtgaagcacaatttttacagaaatatgatggcaaacatttaaaatattcagactcatctatgaaattgataatgtcttgttcttactgtttctctaaagctcagttcaaaagtcatgagatgaggcagagcaagttgagtgccttgactgtggagcgtggggtcctgggagagagggaagccactttggctcaaagctgagtgtctgaactcaggggagtgagagcattcacgtggaaacctggcagccgggcaggagagggcaacagagacacggctggttgttttggaaagggaaggaactggaataaaactctgttcattagagagactggtgtgaactcttggtattccacagagagaaagagctgtgtagaaataaacatagatgcagatctttgtgtctgtgtgttccacatacgtatatttcccggctgtgtccactgagaggacctgggaactgtaacacctagtgcacacctagtctgggactttggcttctaaatactgttcgctacttaaaggtgctctttggaagaatggctgattccagggctgggacagagaagtagaagatgagcctgggatgtcttcttgtttcataaagtaaggaaatgtccaaagatgaggatatagcagaaggacataggagtcagcttgaagaggctcctgctagccaaatctgtggcaatttcagcatcaaaataacggtagtaataggttataactcactgaataaaataggaatttgtgagttcagtgcttaaagtcctaagtttgctgaggaatgtcatatatgcattctctcagagtaactctccccactcccaaattcttaggaattcaaagagaaaatgagaaacttcacagtggagaagtctgacagataacactttaacctagtgatcaaaattaataacatcagtaataagactgattgaagttatgtaccacgtgataggatatgagaactcagcatcatgactgtgatgctcctgccaaagatgcagaacctcaatctattcgtgaagaaacatcaagcaaccccaaactgagacgcattatacaacaaaataactggcctctagtcttcaaaagtgtcaagctcatgaaagtcaagcaaacagaagccttgattctgaactggaaccttttgctgtgaaaaggatcatggtggaatgattggtgaacctaggattggatggtagtaatgtatcaatgttaacttcctggttttcataggtgtaggacaatgtcattgtgcataagaaatacacaatttggaggtgatgggccattgtgttggcaactaactttcaaatagctaagaaaaaataagttatactattctattcttgcactgttctctaagtttaagattctttcaaaataaaaaaaaagaataaaaattaatggtggcagtgctgatggcctcataccttgctgatacttttggcaacagtatgtatcagaagccctaaaaatgttcatgttctgacatttgttattctgtcctcagggaacaaaaaactttggaaagacacttgtattatggtattaagcagaacagtttcattgataactgtaaatgcagtgggtttttaactaggtacaaaaaaaaaatcatagaaaaagattggaagccccttctcccatcattcttagcattagaccgacaaggcaggatgcttctgaatggccacacattggctgaactgtttttccattatttctttccaatgtctattttattctcggtaacataattccagcttccttgttttctttttctttgaccttagttagctcgctgtgctccctcattctgccctcatctcagcccctcctggcccctcttccacagtgcttctgcctgcctttgtcctactgagagcaagatttcttgtgtttgctgtgttgaaagatttttcacaggtaatgctgttgttctgtttctttttctttttttttcttcttttttgagactgaattttgctattgtcacccaggctggagagcagtggcatgatctcggctcactgcaacctccacctcctgggttcaagcaattctcctgcctcagcctcccgagtagctgggattacaggcacatgccaccacgcctggctaatttttgtatttttagtagagactgggtttcaccacgttgaccaagctggtcctgaactcctgacctcaggtgatccacctgcctcggcctcccaaaatgttgggattacaggcatgagccaccgcgcccagccagttctgtttctttagcatgatgtttcctttcccttttactattctattttttttttttttttaagtgatggggtttcactgtgtggcccaggctggccttgaactcctgggctcaagcaatcctcccacctccgcctcccaagtagctgggactacaggcgtgagccagagtgcctggctgatacttatttttttatagacctcatgtcaatgcttttctgtccgccactgacgggatcagcctagccatgaccagctcagcactccagcattccagttagcaagaatgactgcttaggcctcgatctcacatttcaaaatgctctctacttccttagaacattagaaataaaattattatatgatccagcagttctctttctaggtatacaccccccaaaattggaatccagcaggtactcgaacagatatttgtacacatttggtgagagcaacccacgtgtctatcaacagatgtatggatctacaaaatgtgtgccacatataaaatggaattcagccttagaaaggaaactttgacacatgctataacatgggtgaaccttgaagacatgctaagtgaaataaggtagttacaaaagggcaaatattgcatgatttcacctctgtgaggcacctcatgtttgaaattcatagagacggaatggcgggtaccaggatctgaggggagagggtcgggaatggagcgttattgttaatgggcacagagtttcaggtttagaagatgaagaaagttctggagatggatggtcgtgatggttgtgcaacaatataaatgtactttgtagcccctgaagtgaatacttaaaatgttaaattttacattatatatatttaacctcagttaaacattttttaaaatgccatacagttgttagatggtagaacattcagtgattaatgctgaacttaaaggaaactttcctgagattgttggataggggaacttctgttatctttagcttataggactgtggctagtggagtggccaagggaaaatgtcccctttttcctctgaagttttgctgaaaatcagctgctaaaggcataaaaaagcatacacgtttgttaatgtgcatgagggagagtcacagtgatgacctaccacgccctgggggacagatgtatacacccttcttcttaggggaaagggagatggggaagtgtggatgattttaacggggtaggaactgatttttagggaattcagtgggcttgaagaacataccatggcctgggaccatctgttgggcccgcaaagcagataggagtctgttcaggtgtgttgacagatttcagtctttgttcctgggataggagttcagttactgaagacgcagggaaagagccagaggtgattgttttcttctttggcaggtctgggagtttgggcagataagggaactccaatgaacaagttcatcgtctgcttgggagagagagaagattgagagacagtgggtaaagtggaaggccagagagacctggaggcttcttcagttcaggatgtcaaagcgctgtattttagggtattggtttatgagccccaacactggattctgtaccttcctgggtattttaataggaaattaaaagaagttatctacaagtccaaaagtctaaaagtagctcttatcagacacctactatgaataaataatcctttaaaaatatccaccatagctttacaaaagatctgttatggtgtcatttaccgtattttggagaactggagacattaataatgcggctgtgattaaccacgctactaagtcctagagtcagggataagcccgtgactcttcgttcaaagttcatagttcatgctgtttcatgaaaccccacttcctacagaaagcatgaatgcaacattatctgaccaccaggaaatcatataggccgcacttgacaatgtgttgcttaggacagatactcacttttttatttgtttgtttgtttgagacagtcttgttcttcacccagcctggagtgcaatgccgcaatctcggctcactgcaatctccacctcctgggctcaagcaattctcctgccttagccttctgagtagttgggattacaggctgcaccaccatgcccggctaacttttgtatttttagtagagacggggtttcgccatgttggccaggctggtctcgaacacccgacctcatgatccgcccaccatggcctctcaaagtgttgggattacaggcgtgagccaccacgcctggccgacagatacttgcttttaatgcaaaattgctgatgaaagccaaattcctccaatgcctctgaactctaggtgatgtattttaattttttcctctgtattctcttttttctatttataaaacaataagatactgtgtaccgtataccagaaagcttcttgagggtacttgtccaaccctctcatctcagaaagcaggaatgtggatgtttgatgctatgtgacagggacagtacaaaaaacacacatcatctctttctagtgctgcttattattttctgtgtaattctccgtatatgtgctcattgacttttatacatttttgagtacttctccagctacacatgccagactgtctaatacctggcgtgtccctttaggctggtgatttacccatcagtcagtttgatctcatccctgctgcattgacgagattttcattgttaaattgctttaaaaaaacaccacagattcaaaattaaataaatgtaacatatcaaaccaataactgttacattataggctagaaaccacagagtacctgctgctacattataaaattatgtggccaggtgcagtggctcatgcctgtagccccagcactttgggaggccaaggcaggtggatcacttgaggttgggagttcgagaccagcctggacaacatggtgaagccccatccctactaaaaatacaaaaattagctggacatggtggcacgtgcctgtaatcccagctactcgggaggctggggcactagaatctcttgaacccaggaggtggaggttgcagtgagccaagatcgcagtactttactctagctggtgtgaaagagtgagactccatctcaaaaataataataaaataaaataatgcatgtgaacaaaaaactgagctatagatattgaatgaggaattcttgacatggcacttttctcctatttaaagctcacacaaaaaccctaggaaacgtggtcttgtcttctcggcacatgtgagaatggtcctgacttctgtgttttccttgtgggaatgtaagacctgtttctgttgattcctttcaaatatggagcatgctcttttgtagcagaagagtgaaaacagcgcctaccagaaatgtcagtacagtagagtgcttttcttgatgtgaattaagatttctcagaacttcgctttctcagtcatttgcccaaagtgtgccccaggaccttgtagtgtatcctttctcttgtatgtgtggcaggaatgggtgggtgacagacatgtatatgataattgaggatcagaacatatgtgatggagtcgattttccttctgccttttccctgctttgctgtttcctcaagggaaatgatgcctgtgcatagactattgtgtggggaggggcgtgggtatggggagagtagcacttggtgaaactgcatttacacaaatctcaatgttttcctgcatgcatttgcatttactacataggaacatatgcacacgctgtcgatagaggcggttacaaaactgttaatgcctcctggaaggtgaaatcacaaactgcaaaggtttcttgccagggaaaatgtagaaatgacactgccacctgttgtttaaaccagagaattgctacaagttctgttgcacccatgaagggggcaaatgctgggagtagatttctcctctctcctcacgtggaaactctacttatttattgataaccggtacatttgctataaaatagtctatcaaatgtgggttttcacagtgtgaaataagaggaaaataatttattgaaaacatgcttgggtctttattgtcatggtgtgtggttttcaacgctttatgtaatggagcctaaggctttctattttgtgtagtttttccctcaagaagacaacaaaggaatttctcttccttatgctaatggtggatgaaaaggtaggaaagtacttggggctagtgtcgttggcttatgttcagtcatcgagcaagcagttggtagccagtatcagtggataatgatattgacagccagtaccagcaagcaattggtagctggtatcagtggacaatgatattgacagccagtaccagcaagcaattggtagctggtatcagtggataatgatactgacggccagtatcagtttcatttgggtgtctgatgaaaaacttagttcttctgcagtgaggaaagggtagctattgagggtactaagagctggtgttcagtttgtgtagtggagcaagcgtaaacttagcaagataaggagtttgtgtgtgatcatgcagatttcagtgagttatcaatccactttaatgctagagccagtgcccctccacccatattaattagttatgccattctcctatgtgaattaccatggcataagttagtggttttaacagagttaatgaactctgttgagatagctgggtcagaaggcagctaactaagagggagcttgcactggggcctttgtaagtaggaattcccactcacagcatcgacagtggtctaggtgatttttaaattctcctcctttttatgtcctttttctaaattttacaggcacataggccaaacctgtagtgttcactttctgaccatgaaaaaccgttatgaataatgttcactttctgaccatgctaaaccattatgagtaaactttaagtcatcttattgaggattgacaccagctgatgattcctatattggtatttaaaattccagaaagtcaaagctcaggcagaatagtaaaagaaaatgaaataatatgaagtcccagagaggaggaaggtggtgtttgaggagtgtttttcaacctttggcaatttcttcagctcttagggccttgatttccccatctatgaaatggggaattcagatcacaaaagttttgaggttccttctgcctatcattttgttgatgtatttgaaacttatcttgctaatacaccattagatctctaaatttgtaatacgatttaaaatgtagatttctagtcccaatgtggtgctagacttcgctcttcctgggccgcatatggggacaagatgacgtcttcagccgtcttcaaaccctgtgactctggaagcatgttatatgtccttcctatgtaagaaagtatccaagttttcctaggagactgtcaaactaggataagcacacctttccttggggaaacaccatctttccttaaccttctttagcttaatgtttttgatattcagcacatactatctaaatagatgacgcagatatccatagacaccatgccatagttaatatctaatgccttctaacagctacatatggaacaattattttagccctctaaaccttaagattggatgagtttgccttttaatccaagaaatattttgggatgagaagtcaacttttccccatttttccttgtctttcctatttggactttctccgtcacactgttcgtttaatgaataagcaaagataactcagctgcttgccaaaaatgcactcagatttctcctgcaaacactcatttttaagtaaaccaaagtagtaggaaatgaagaaaacagagagggagtttattaaattatgtttaggctttcttcctggcatcattgggctctggatacatgttgatcaattcttatccatgagtacatcacgctagagttttaggtctttctctgcatggagaagcttcatctctggtgtgaggtctggtagtgaactgatgaaggagaggagaaaacaagagcagggggtcactttttaaaagtcaatttttatcctgctgtgattgaattgttgccccaatagacagagcatacgattctgtattgtttctcaacagagaactagaagaagtaaagaaacttcttatgacattcacaaacacaatttctactgttatgttttaaaatattggggtttttgttgtttttttgtttttgttttgtttgtttgttttttgagatggagtcttgctctgttgcacaggctggagtgcagtggcgcattcccagctcactgtgacctctgccccctgggttcaagcgattctcctgcctcagcctccctattagctgggcatggtagcactcacctgtgatcctagctactcagaaggctgaggcaggagaattgcttgatctcacgacacgaagcggaggttgcagtgagccgagatcacgccactgcacttcagcctgggcaacagagcaagactccatctcaaaaaaaaaaaaaaaaaaaaaagatcttacatgagacaacgtcatattccaatagcttcttctacttcattctagttactctgcctggggtcacaacaataattttgaaggtattttaatgtctttctccttttttaaataaggagaatactaagacctgattggagagacttgccttacggctctggccatctgcagtgttggaagtagatgatctaacttgaatctaatattctttccactatatgatatatacacaaaccagtattgccttttgcgttgttacccttttatgtacgtgtgtgtatgtgtatacacacatacatgttacaaagtaatcaagtcccagttaaaaatatatattcacaaatatttctgtgacttcaaaaaatgtgaagactcttagtttagacaaaaatgcattaaagttaggattgtagactcttcctagaaacagaagggacactgtagataagagtaggtggtgtcctctagcttcaggctattttgcatcaaaaacaacctagacaaatcacgtatactttgtatatgttagtatagcccccaatacatgaattccaacctgtattgctgacttcgctcctacagtctgcagcattgtgagcgccttgaaggatgctatattaaagtactttgagcgtggtttcacattatggcccaacgatacacacctgtcgatttttgctggttttaccaccattattttatatagttatcatttactgagtgttgactatgggccagtcgtttcatagcaggcccgtttttcatattttgcagctaagaggaggaaaccgaagccaagtgacttgcccaaggccacgctgctagcaagcggtacggctggcacttgaacttgagtctgtgactccagagccgaattcttcatccccggactctcctgtctcacctggggaaggtgctgaggtgtctcagaggatttacctcactctgcaggcctaaacagaattaatcctgtggtttagtgtcttaatagggatgctgagggcaaaggagaggctcttattttcaaaacaaatgactttggcagcatgaaaaaacgaaaccgagaaaattgccagcaccaagctttgtgtgcaaacactactgctttgttccccggtgttgagactcctcattaaacagctccctccctgcgttgctcgagaaaggaaaggaaaacttcagaggtacggctactccccaagcgctgttgctgccagagcctctagtatttatttttcaaaattttaaaaatagtcatggcattcttacagctcttatgccctccaggatcccagccgacttctaagtacagaaatgttaatgggccgagggaggggaagcccagagggcagatcacctcccagaaactcaggctaagccagtcctcggctgagaggagttctgctttcagtgaggcccacctttatttcttatttacgtcgcattacaggatgtgtcaagagcccttagacatcctaggcaagtggtaactgatgtttctccaacaccgctctgtgcgtctgtggataaggacacagtttctccgaggcctttcagaatacaatgcacaggttgtgtttcttcattaccattgaggtttggaacctctggctatttcagccttccattcttgccctgtttacaggtaaggaaaggctgagagaaatgaagggacttcatttttgtcacatcgcttgtgataccattaggacctcctccagatggctgtcttcgtaggacagtagtctttctttggcatcactttgttgaagcccctatggtagggactatgacttaaacacttttcctttggtgtaaaaatcacagccttcttatccatggggaatggattgttaactgattactgtcatttttaaatatttcagtttagttcttttctaatgcatttaatcctgtttcccacgtctgagtacaaattgccccacagtatattttttgtcatgccctactgcctttttttttttggtcagggtctggctctgtttcccaggctggagtgcagtggtgtgatcacggcttactgcagcctcaacctcccaggctcatgtgatcctcccacctcagcctcctgagtagttgggactacaggcatatggcaccatgcctggcaaatttttttttttttctatttttggtagaatggggtttcgccgtgttgcccaggctggtctcaaactcctggacccaagtgatccacccacatagacctcccgaaatactgggattacagatgtgagccaccatgcccggcctccttctgccttttctttagtcctttcatctccttttattcccctaactcttccatctctccccctacatgaaacccaaagtgccaggtgaatgaatctcatttattaaggtgagatcagagagttgtctctgcaagtagatcattgaccagggagctgactccagactccctttcacgaggcacccaaatctttcccttctgggaagagaaagcacctcatcccatccttcatggcatcagttttcctcttgaatagaaacctcccacaaggccaaagacaaacgcacatgcttcagagtcttgctttctacggattgggaaggataagttacggtcctgtgggatgggtagcagagtgctgcctgataatccctagagaaggatgtcaggccccagtcgtggccgcttctccagcagcctctttagaatgtggggagttgatcactttctgtcctcagcttcgggccttagcctcagttctggcccaggagaggaagcccctctcagcagcacctcagaacagaaccgtgtaacaggaaggaagggaggagtgagcaggattgagcagtccagctcctgcccatgccttttctcgagctctggctgtgtctgctcttagatttcatagtgctaattggttttcatgttttagaggctccaggctccttgatcttgtttgttatggagtcttcaatagccccgcgattatgtgttcatgattacgttaagcacagttaatatagctgtggggtctgcgtggagggctccttccgagacagctcacctccctgtggtgtgtgtccctctgttctcagtgggctgaaagacagggcagttttgttaggcgagacaggtcagtatttggcacttgatgtcttttaaattgtctctattcacacatcaggaaggctgcagctgatttccatttattttttagttttttaaaaaatcttctgagaataagtcagaattatacaggggctgcatatcactttccagctttccccctaactttgtaagtatgtggggaaagacagatgtgcagtaagggcttctcacattatcacccaggagttccgtctgggaaacagggagcacgtcccagttcccctttggtaggaagaggaacctacgtgggtccagcctggatatccctggactgttcctcaccacccgtgtctcccctgtcccgccccccgccgcccctccagcaccccagcccctccaacatcccagtccctccaactcgctcatcagttttaaggtagaatagcaaggcgggctcttcctacaaagtagatttttactttaacaactttaaaatccactttggggctttgggggaccatgacatataggttagatttcttttagcagtcaggacgtggttgtgctttcaacacaaacatcaaatcaccgtctttaatttttaaaaccaatcctaaaacagtgtagtagaattgcttcccaaatgtcaagatcccgccttttctcccctttcaatatctagctgtcttcggagtatataaaacccattcacagagcttgggaacaattaggttctcaaactccacatctcatatggaggccaattgaagatgaacatctttaaatgtcaagaggtgtgtgttctggcctgtaaccacggctccatatgtgtgctggttctgacaggggccctaaattcagtgacgacgtctggtaatgattgagagtgactgctgactggaggtttgaaggacctggcttcccccactttttctttctttatcccttttgcagttttcataggattctctgtttgtgagaggattctgcagtaagcaggtacttgtgttttgcttttataacatcactgtaagcgtgcccctttacatgcttaaactatgcccatatgactctctgcagaaaactggacctgtttcctaggccctgctgtattccagctgagaggaggcataggacataccaagggagttttgatttgcttatcctcacatcctctaatttaatgggtagccctttatagagacaggtgactatccgcattttagatgagcaaaccaatgttcagggaagttgcccaaggtcagagagctagttaattgagaaaccaggattgaaaatcaaatccagttccaagtacagcgttggctccaccatatgtgatggtcttccagctgtaagcgtttgctttgctactgtgagaaacatttatacttgtctgctgagtcatagggcaatgggaatatttttggcttgctctatctggctaattaagcaatggcagtaagataggcagagcccacatttttgaggtttttctttgtaaccaacattcttcatgtaatgtttcccccttaaaatgttaaaattaggccagtcccagtggctcatgcatataataccagcactttgggaggccaagatgggcagatggcctgagcgcaggagtttgagaccagcatgggcaacatggagaaactccatctctagaaaaaaatacaaaaaaattagccaggcatggtggtgcacgcctgtagtcccagctactcgggaggccgaggtgggaggatcagctgagtccaaggaggttgaggctgcagcgagtcatgattgcaccactgctctccaacctgggtgacagagtgagacgctgtctcaaaaaaaaaattattatcccttattcttttatttcttatagtgtctgtagcatataggcctccccagggaacagtgctgtccattttctgggttgccctgcctcaacacaactctccagaccaccctctgtctggcctcaaccctacgtaaccctttgtgtgcacatacattccctgggctcccaaggatagagcctcttgcatgaggaagctggatgaaagcctggaaaggttattttgtttaaattcttaccttgaagttcctttggtgagggagccagcctggaaatcattccagaacagtcgtgtttcatagttacagtgtaatcgggaggctgtcattcatggccattaaattgcttcctttgaagtataagaaaaaccaggacaacttttatggccctttaacccacaggattgtagtacacatgaatgaaagtcaagtgtgttgtggactcttgcaggtactgtggctggcagaattccatcttcaccctggtgctcattcattggttgactttcaagtgaaaactggggtgagcggtatcagaatcttggaaggcttttcttctctctcttttttgcatttttataaaacaaatcagaaatgaggagtcttattttgtagcttgactaaaaatgagaattattatttctctggtagatctctttggggctgggcagcaccttctagatgttagcactgtgctggccattttgcgtaccgatttccatttaatcctcacagcaatcctatgaagtcggtaggctcattcccattttacagataggagacaggcttgagaaggccccttagtaagtggcggtgcccgaattccaatcgaggtctgagccaaagcatgtggttttgctcccatgccctgtggcttcccagaactcatacctgagcttatataacagaggaacattggtggagccccaagtcgtgggtcccagtatctctaggataatcacttgtgtaataaatcacttagatttacacgactgtattatattttgttcttaagagaatcacatgggaaaactgtggagaaagaaaggcaacaaagtaaatattagtgtttaatgactagatgtgtgagatatttatattacatattataataaatttaatgcttcatgacattgatctgtatgtaatttaaagagatgctcaaaattcagatcattggaataataagcaaggtagttttacattgctgaaaaaggtacatctaaaggcaatgtatttcttattgaaaattttgttgatagctgagccgttcaaaatggggtgggaagagataaaaaggaatggggagggaatctttcagtatgtggattgtaaagttactctacaattgttctgagaggagataatccataggacgtaacaatgtgtgaacttcagctgtccatattcctcaataatatatcctgtcacctgtatttattgcctggaattgttgcaagacggaattagtcctaaaagagtttgattaggtcatgataagtcccaccgctccaccagatggcgctgtggtagcatagctacacctgatgcccctgccagaggtttgagaagcagatgacaaccttctgtggggatcctccaaagcctaatgacctgtgaattggagccccacagaacaatagagtttttcccctttctggttctgggttcggttcttctgtgtgcctacacatcttcacttggcatttcttcgcccctttaccgtctttccctccgcctcttccatcatatctcttccctgctcaccaatcctcctacctacaacctttctcttctctgccttatccttcagacttcttttctctttggtgagtgtagaacgcacttacatcgtgcggtggtaaactgagatgtttccgtgtgagccatgcagtgaggccgaagaatgggttgggaactactgtaagaggaggtggccgggcgcggaggctcaggcctgtgatcccagcactttgggagagggaggtggaaggatcactggagcccaggaggtcgaggctgcggtgagcgatgattgcaccactgcactctaggctgggtgacagagcaggaccccgtctctaaagaaataataatgggccgggcgtggtggcgggcgcctgtcatcccagcactttgggaggctgaggcggtcggatcacgaggtcaggagatcgagaccatcctggctaacatggtgaaaccccgtctctactaaaaatacaaaaaattagccgggcgtggtggcgggcgcctgtaatcccagcactttgggaggccgaggcggtcggatcacgaggtcaggagatcgagaccatcctggctaacatggtgaaaccccgtctctactaaaaatacaaaaaattagccgggcgtggtggcgggcgcctgtaatcccagcactttgggaggccgaggcgggtggatcacgaggtcaggagatcgagaccatcctggctaacacggtgaaaccccgtctctactaaaaatacaaaaaattagccgggcgtggtggcgggagcctgcagtcccagctactcgggaggctgaggcaggagaatggcgtgaacccgggaggcggagcttgcagtgagccgagatcgcgccacagcactccagcctgggtgacggagcgagactccatttaaaaaaataataaaataaaaaggaggtggtcatcttgcccgtcagaccggagtctcctcacaactggcatgcgcttctcagtggacttatgacttgttcctgcagtgaatttggcaatgtctcaaaaatgatgggtttggttctagtaaacagaatcgtaaggaagatagggactctgcaattacagtggtggatgtggaaagtatacaaagtatctgtgatctcttggggatcgcccagaaccagagctggaaaccagagctggaagactggcggccggagaatctgtcaaaatctcttgttctgaacaaaggaaagagatccagaggatcccaggtctctttctggccagtttaatgctcttctctgagtagctgccagctcccaaaaggcagagcattgatattcaaagaaaggaaccatctgtgaatgttatttactgtagggtctgcaattctgaaaattatcagccagggcaatgacccctgtttgactatcatttgtagttcaaaaagaggatcatggaaaacatttaaactattttctgtcttccccataaaatgttagtcatttatgtataggattattattgtttccgtcttcaaaccacagctcgcagagccagcgaccacatgatgagaaacagccatgcttcttagattttggcaagggtggctaatgtaaaaacggcccatctccaaaacatgatggatgccacataccccatggtttccaggatgaagccagacactgtctcttccatagtacctggagcaaggagaaactttcaaaaacatctgcaccctataaggttgaagatgggttggcaagaggaggacgtgcttgtgggaatcatacttgtaggtaggcagacgtgtttggacttgcctggcatatttttctccttggagcaattcatcttctcttgacataaaactttctcactagtcagaagcaacactttccgagatgtcatttaattcacactaacaaattacaaggaacttcaggtgaataggtgggaaggcagcgtttggagctagcccgataggatcctaaatatggttctgtctgttggccttagagtatcatttgcatcagtctcgtttccctcctcgtcgggggcgcaggacagcggcctcatttcgtaagacttgagtgaagtggtgtaaatgggctgataattggtgggcttcttcttaccatcacagaactttagaaattaaggaaaaccttactcggacaaaataaagcagtctctaagttagctagactttcgatctatgtggaatgtagaaatgtgatcttctgtttccaaacactccatatgtcataagtcaagatgtggctttagcaaatactcactgatagatatgttctgttagatacgttctctgtcttccagcatcttacagtttacttgacaaggtgaactcagcgaatcaccagtgatgagtgtaaggcttgtaggccttgtattttagtctctgttatcttgattagtgagcgccctggaaatgaaactccttaataactgttttggccatgatgcaaaataaaaggtcatcattgaactgtgtgtatggtggtgtccaggggagggggaaacagagagaagtcctgtgtggtccaaaggggctttttagagtctggagaaggtttgtgtcatttttggtttaggggcatggttgatgctatgggacattctagagagaaatggaaggtggacgccccctgcagaccacagccctttctaccccagtgggagagaagggaaggaagtaatatcctatctccatcttcacattctgtttttttttcttccatgttccttttttctcctgtctccttttcctttctcctttctgttgtctcttcccaccccttctgggaagaacagaaaaaaaccgacacttatcggtgccctgccatgtgtcatcatcttgccagcttaagggtaagaaagagggtggggcacaaggagccgagtagctgtgtagatttgtctacagcctggcagtcacaatgcctccattgaaaacccaagccgcatgatttatatatcttatcatcatcacgaatttttattctgagaaactaggcaagagaaaacatcttcagtcaaccattactgagtgtaaactaggagtcaagaacagtcatagcctatctcatttagctttcttaaccctgtgaagtaggtatattattccaattttataaaagaggaactaggattcaaaacgttgagtgaactagccagcatgttccctggtgcctagcaggtactcattacatactcgctaaatgaagaagtaagcaaagtaagtcattgagccaggattttaaagcagattttataacctcgagttccgtgctctttctgctttattgtttgttttctgggagagacttgggtgagcctaaaagatcagtagtatcctgtactatttatggaacaattaatatttgacttttgaaataagaatgcagtatgttggtttcattagtctttatctctctttctctctctcttgctttaggtagtatataattgtttatacatccctatccttaaatcctttttctttctttctttttttctttttttgactcactcttaggtcttttatactggcaaccagcttagttgtttaaaaacatagattccaggtcaagagtttctgggtttaaatctaggttttgccatgtcttgctctgtgatcttgggcaagatacttaaccttgctggttttcagaattattaactttaaaatgaggataataataaaaacctacatcaaggggttcccatgaaggttatacaagttgttatatggatagcacccagaacaattcctggcacagagtaaatactatctacatgcagttaatatggcagcattgctaatgttattattctgtgtgctttttgcaatcttccccttttatttcttaagctcttattttttttttatttccaccttgttttcttctttatagtttggtttcatgtttggttgtttttgtgggttttttttggtggtaaaatatatctaacataaagtttgtgatttgaatgatctctgagtgtataattcagtgatattaattacatccacagtcttgtgcaccatatctatttctaagtttttccttacctcagagaaattcctaccccgtgaagcgacaatcatccactcccctttcacctcaaccctggacaccaccaatctgttttgcgtctctgtgagtttgactactctcagaacctctcgtaagtggaatcacacagtatttgtccttttgtgtctggcttcttccacttaacataatctcttcaaggtttgtctgtgccgtagcattattagaattcctttcctttttacggcaaaatattattttctgtctacaccacattttttctgttcatctgatgacggacccttgggatgtttccactttttggaaattgaataatgttcgatgaacattggtgggcaagtatctgttgagtcgctgctttcgtttgctttgggcatataccgagaagcagaattgctagatcgtttggtagtttaactttttcaggagcatccagactgctttccacagcagctgcaggagtttgcatccccaccagcaatgcacgaggattccagtttctctacatcctcaccaatatttacttttcatttcttttgtaatagccctcctaatgggatgggcatgtggttgtcacatggaaatattggctagtaaataaaaggaggaaaaattgaaaattgaagaatcaaacggtgcttcagacatgagtccctagtcaggtcactgacttagaattatttattcagcaagaatcatgtctctgtaggagctatcacgttccaaaacctctgggagctcagaaaatgaagtttcattgtactctttacccagggttaaagatctccattccctccccaagggtgggtaagagatgagtggggtgccaccgaagcaggggctgatagcaggaagatacttccttatctttatttcttttgatgaagcactgtgagccaagcctcagaggagccagcctgtgactgtacattttggaatctgtctgctcacaggtgttggcaggccctggtcctggtccagcacagcgttttccctggaggaatgccatgctttgaatttccttgtctacagactgtgttattgtccagcctctcagtgggatcagaaagaggttggtttgtctggcaattgccagaacagtgcctatccgtgacctcttgtctgagcatctgccagagaaagctgtgatctctccagggaagtgtagggcttgaagacacacttagcaatggctgatctttctcccagcagttctgatcactccctgaccatcctcacatcctgcctttgtccttccccctttgtcctaaagtgctgtccgctgccgtgactgtgtcttgtttccctggtggtggtggaggtgctgaggtctggggaagggttgggaatcacgatggtgggtgcagggcttgctcctctgtgtaactgcatagcctgctggcctggagaaagtcctttcctgcacagcactgcctctcaccaccctaccccagccagccagcccacatcttggttttcctcaggggagataatccctgccactgctgattcacggctccaaggaagtgaaatcatgtgaggtgaaactgcattgctagccaaaaaaatagtttttcttaataatgtctatcagaagcatgttgaggaggaaggatgtcttctgtgtctcccagcagcaagcgtgctgaaatagcagctcagtagatgctcaatgaattccagttgaaagaaagatgctcgtacttctgatttcacaatgaagttgattttctggggatcactccccagttgacatcccccctgtctgagagtaacactcagttgctttgactgtcttttaacaaattgatctttttctcctgttccttttgcttctctccctaaaggggttccccatatttggcatcattaaataaattcattaagtgtcccgtcgtgtagggccagtgtttcatttcgttaattaaaatccatgccctgaactgagttcggaagccctaagagccagagcagactgcgaggcacctgcggaaaaacgcagcatatgcgcataccctagacacagacgtcatggtgttccgcaccagcgacgtcgcctcagtgccaattcataaatcagaacttctctgagatgcaggtcatgttctggggccgacttcttcatggaaagcacagaggcatcttgctaaagaagaggaggagatggaggaagtgtaaagctggggctggtaaataagtccctctccctcccccacgttcccctcccataggctttgaactttctgtgtttctgtaggtgtccctagtttggatggggacactggaaagctagccagctcttgttctgttgttgcacttcatttgttttgggcttttaaatactgggcttggctttatttgttggagttacgcctctactttgcatttcataggtgaagttagaggcagtattgtgtcttctgtgagttaacattcaccagatagttactgaatttttactctgtgcctagtagtcttctaggctctgggaatgcattaggtaacttgatagatgtggtcctggcctaatgagtatgtgtctatttgttcagttttcaaggggttagagcacagtgtttaaaataacacctgtatcatgaattctattctatataaacccattagcattgcatggagaaaaggtccattcatcacaacacattatacccctaatcccagcccactggttggcaggtgtgtgccattgatctcaagagtctagggaagttatgagctgccctggacaatttgtcacccatcagccaacagctttttatttagcatcctctatgtggctagcaacatatagaaaatcgtttcagaatttatgccctgccaatgctcttttcattagagcagcacaatctgtggtctttttagtcagagaagatggcttctctatatgtatttatgaaattaaacaagaaacatttcttccattgggcattcgttgttaactgccaggaggattttaggtgttgggaagttaaatattataatgggtataaaactcagtccccaaactctaatgtgccaaaaataacatttcatttttttttctatacatctgcccaatttctggctgattgtctttccactggtgtggtggaaaacttcatctcccttctcagggttctgggctcatccccaggaccaagctgttaggggcatggctctcttggcctgccccctgtgcatgtctattggctctctgatgcatccttgccacacataggactcaggagttgcatgtgtctctgtctatccaaatccccctcctggggaagttgtgcttctgggtggcagccctgcttagaactggggcctaggcccctgctccgtcagccctgcaggctgcattagtctctcccccaccccctactgcatcccagattttgcagatggtttctgctttctctactgccacatgcctcccctgaggcactgagcagagtctgatctgtgggagaaaaagaaaggcaatgcaaagagaagagcacaaattgatatcttgaaatatcatccagccctacagttcataattgtatcatctgtaaatatttaccaaacacgttggcataaattacctgtttaatccttatagcaccctcaggcatttgttactgttctccatttctcaggtgtataaacagacttaggctaaatacttgtcatatgggtggacgtcgtaatcaacaaatgaattaatgcggaattcagggtttggacctagttgtttctactctagtcccatgacttccgtgtagcacagggctgcttctcaggttgtcctgaggcttatgaagccacctgtgatatgtaactttaacaagcatgacaatttgtttactggacattagaaacttctaggtaagtggtgttttatttattcatgtgtcttaatcattccatttcttcgaaggttagattttctttttcttttttttgagacggagtcttgctctgtcaccaggctggagtgcagtggcgcaatctcggctcactgcaagctccacctcccgggtagcttggactacaggcgcatgccaccaccctcagctaatttttatatttttagtagagacagggtttcaccatgttggccaggatggtctcaatctcttgaccttgtgatccacccacctcggcctcccaaagtgctggaattacaggcgtgagccactgcgcccagccgaaggttagattttacctgtgtcctttttacagctttttttttttaagtttcttcatctcttactttctcagtctcacttcataccacctagtactgtgatccgcacatagatggataatgagagggaagtgagtggtaaattaaacatatgctcttaactaaggcataaaaagtcattttatgagaaggccctcccctatttctgaaatgaggcaagcaaaggcctcatggaagtagaactttcctcctaaatgtgggagatgaccagagtggtgaggaaaatgcttggagtccccagctccttgatgtcccgggagaaaatgcttatttcagagggtgagggcatccaaagtgctgacctctagagagagtaactctcacagcgtctctagccatccgacacgtggacaacagtaacccgatggccagggcctctcatcgtgtgtcctttacctaaagccccgcgtccctctcagctgacgccttcgctttcattttgtcgggccaatctctgactctcaaaacacacagggcacatccgaggaagggtgtaaataatgagaaccatagaggagttcctaatgtgtatgctatgaagcacctcgtgtgggcagattttcctggctttagaaatggaatgcacttaaattaaaaattcctacttaatgtgacttgggaaagataagagtaacagaaactcttccgacattttattttatttctgtaatgaaaagtgcaatgaaaagaagttgagagagcgatgatggaccaaccagaaaagacaagtccttttggatttcttcctacaccttagaacggaacgattttctatgcatctaaagcgattaaccatggggattttccattttgaggaagcccctggatggaatattggatattgtagtttaatgtcttctttttatggtggtaagatatacataacataaaaatgaccatttaaatcatttaagtgtatagttcagtgacattaaatacattcccactgttgtgaaaccatcaccaccatccatcccccgaactttttcaatatctcaaactaaaattcaatgcccattaaattttaactccccattccctattcccccagccctggcatccatccctctgtctttataagtttgaccactctaggtccctcatgtaaatggaatctatatctgtctgtctgtctgtctgtctgtctgtctgtctatctatctatctatctatctatctatctatctatctatctatctatctatcttttttttttttgagacaacgtcttgctatgttgcctagcctggtcttgaactcgtgggctcaagtgatcctcccacctcagcctctctagtagctgcgattataggtgagcaccaccatgcttggctcctattttttaaccaattttttaaacgtggtttcttcttttaaagtttagtattgctgatgattttatagtgtactgacttgcatcatttccataccctctgttagagagtacagtgggttataatgtggacttagatgccaaaccacttaggttcgaatcctgactacctcttactaatggtgaggctttggcaaatggatgaactctctttgcttcagtcttctcagctcttacacagcagtgaacattgtaaccacctcagagggttatgatgagaagaaagtgagttaataagggtgtaacgcttcaaacagtatctggaacatgatgaacacccagtaaacgttgagtgcagaagcagcagcccttctacctcccaaagttttattaatagatgggactccattgtcattttgcggctttggaaaccgaggccttgatagattgtagagtagctgatccatgaccactccaggccccatgaccgccattctagaagtggccgatccatgaccactccaggccccatgaccgccattctagaagtggccgatccatgaccactccaggccccatgaccgccattctagaagtggccgatccatgaccactccaggccccatgaccgccattctagaagtggccgatccatgaccactccaggccccatgaccgccattctagaagtggccgatccatgaccactccaggccccatgaccgccattctagaagtgggcgatccatgaccactccaggccccatgaccgccattctagaagtggccgatccatgaccactccaggccccatgaccgccattctagaagtgggcgatccatgaccactccaggccccatgaccgccattctagaagtggccgatccatgaccactccaggccccatgaccgccattctagaagtggccgatccatggctactccaggccccatgactgccattctagaaccatgctgattttactacatggctcctttgttgaaatgttttggaagaacatggtgtggtagtcaggcttcaacctgatcccaatgattcctgcatcccgaggttcacacccttgggcactcccctcccacactgcatcacagttggtgtgtgtgaccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctggggttcagttgtaaaacacattggcttctgttttggtcagaatctctctctcgggtcacttgggaagaagccacctgccttcttgtagcagctctaaggggaagccctcctggcaagtaacccaagcccctggcaaacagccggggagtgactgaggttccccagcaaccacaggagtgagcttagatgccccagcctttgtccatctttgagttgactgtggctctggctgacagtttgactgcaacctcctgaaacaccctgaggcggaaccatggcagctaagacactcctggattcctgaccctcagaactgtgtgaagtcacttagctggttgctttaagctgctcagaaacagataacaaatgcacgtggcttagttctctgctggtatctctgtctataacgacataacttttaagctgtggctctattcctttttcctattttaccattaatgaactaatgtgaaaatttttttccacacctgccctggctcagatagatggcaggaaaccctcaggattcttcacagtgcctggcaggtgggagaggctctgtaaattatgtgttgaattaatgaataagtgcattttttccacatataggaaagaaatcattttagttaaagcatgtgtgtattcaggtctcttttgtgaatataagaggaatgtttgatactgaatttttcttgtttggatctttggtaattgttagaattttcttttttctaattgacttcaacttacgattgtgacttcttatgatgcttcatgttgataaacataacaatttttttaaacagcactactgtttggaaagggactagtgtagatgccagttagtggtcactggtacagggaagtcagtgcactcactttctgtttctgtcataacaaattaccacaaatcaatggctttaaaaaccacacacgtgttatcttacagctctgtaggtccaaagtccgacatgagtcccactggactaaaattcaagattgttggcagggccggctccttctggacactctagggagaatctgcttccttgccttttccagcttctagaggccactcttatttcttggctcctgatcccttccttcagaccaagatgattcctgtcaatgaggaatctgggttgcaggaaataccctggtttttgagaaggtaatcaggtgttggagtatgaataacaaatctactcctagtttgtgctgtatacttcctttctcattgcagccactgaaaccatgtcagatccagaaattttattcaaggtcgagatagctgtgtgaccaaaaggaagtaggagtaggagacagttctctctcaccatttttctcacttaaagaaaaagctggccaggcatggtggctcatgcctataatcccagcactttgggatgcccaggcgggaggattgcttgagcccaggagtttgagactaacctgggcaacatagtgagaccctgtctttacaaaaaataaaaaattgtccaggtgtggtggtgcaggcctgtagtcccagctacatccctgtggtcccagctactcaggacgatgaggcgggaggatcactttagcccaggaagtcaaggttgcagtgagccatgatcacaccactgcactccagcttgggagccacagactgaggccctgtctcaaaaataaataaataataaaatctgaaaagaaaaagctagatacaacaaacgtagaagaaacaccttccaactacctcaggtaacacaggatgatattaaatttacagttgttggtgttagagaagaggtcacagaatagatcttttgtatttggtatgtgtaatattttttaaaattgaatttttatatcttaaggtcagggcatctataggatttgagtctctacttttattatagaaaacataatttcattaatagatgttaagctctgagtaagtttaataagattggaaaaaactctaaaccacctccagtccccaaaaccctaccatacccaagttggcctgtaatcctctgtgggaggggggaagccccacttgtcattggaaatcagcagtgcaagatggagaatgtttttctctctaatcccttcaaggtacaaggtaggacacctagaaggttaaggcagaagccttcgttgtgtttgcttctcctttgtatccagttaaccactcatgtggcattgaatgaatgagtggttgtttcttgcaagcctgctgcaggcccagcctcatcttaggcattggacatgtgcagcaagctggatttgtgctactttgctgcacagttggcctgttaacaagtaatgcctagggaagggggtgttgtcttcaaagtgcacacagcctaaacataggtgaagataggagtgagaaaagtacacaatgaaattaaggataagagaggaaatggtcaagtactgggggagtgcacaggaagatggattaactgactcctcttcaaagatcttgcagcagtggacccatttcagttgggtcctaaaaggtgagcaggatttcttaagaagagaaagggggacaggatgttccaggctgcagaaaccagtcgtcagaagtgttataaatgtgaagacaggtattaattggataaagtctaagaagtcatggaatcatgaagttagaaatgatctaagtggttacatctcaccactcccagccaggggattctggataagttacaatgtgttcagccttggccatagaaaaacaacctcaaggcttaaataatatgatacggggaatttattggttcacagatctcaaaaatatggagatagcccaggcttcagacatagtttgataaaggctcttggtagcagaatggctgctgagcgtcagctctcaggctgatgtgtcatacattctggaagaggagatactccctttcctcctactgacaaaaaaagcctttgagttcactctgattggcccaattttggacacatgctcagcctcctcccaaaccgttctctgccagaggaacaccatctgctgattggcctgggctctggtccctgcctatggctgtggcaagggggccaggtgtgggctgattggattaggccagtcagagcccattgctaaaatctgggcttgaagccaataggacgtggccatgtcagtgggtgggacaatggtgggaataaggggaagggtgctgcagaggcggcccacgctgtccacatgcagaggctcgctacagaagctacagaagaagatggttacatttcaagtgggcaggtgccgtttgcttatgagcaccatcagccacatcagccacggttctttgaattttacctaattgtctctaattcttaacaattctttgaggtaagtgttctccaataatttccagttgagcaaactgagactcagagaaaataacttgaccagagctacacacctgagaatggctgaatcagaactggaaatggcagcctctgtttccagagactgggttgtctccattatatcgtggcgcttgagcaggcagctacagctccatttgggaagctctgttggttaggactgggcaggggaggcttgtgtagccctgtggttaggactggtttgtgggtggcggtgtgtgtgtgtgtgtgtgtgtgtgtgtgtgtgtttggtttggtttgtctgtttaataacgtaaagccaaacctgcctcctagtgattcctctgcgtttattctagttctgaggtatggagcggtgattctcaaacccagcagagcattataaaaatacagttttctggcctccatgccagatcagctgaagcagagtctgtgagtgggaccgtagaaactggattttcttttttctttttaagtttcagagatgattctccagtacaaacaggtttggaggactcctgctttagaatacaacgaagctgttctgtcttccatgttacaaaccctcagatgtttaagactggggtcacccatgagcctttgcttcaggctccagtgtggtgcttaagtgccgggactttggaatcagaaagactgagttcagattccgtctccactgttgataagtcgtgtgccttgggtaaatctcttaatattgctaagtcttagttttcatatttataaagtgggaataatcaatttaaattaaaaatcgttgtgaggaataagttaagaaaacgtgaagttcttagcgtgaagctggaagaacatggaaaagtttcagtggatatcacctgttactaatgattgttaaacctccctggctctggcttctttagttcgtttcaattgttttttttctagatcttttttacctctaatttttggtgtttgctaatttatctcaaaacagtaatggtgtgtagtgggtagaggctggcataaaattctagacacctgactacatcagtcaacagcagagctatagcttcctgtggtctgagtgtgacatttctctgggtgcagatatcctctgggtattaaacgtcttggaatttcccatccttgtttaagtccttttctcctgggaaattgatcagtggctgattatgggaacatctggattcttcaagaatttttggacgttctgcaacttggtttcaagcctaagctgtgtttggaggcatgaatatgagttggtttcatcataaaagtgtgttgattccaagactgctgtgatccgttttatctcgcatggatctgtcagcgttttcctattcatccgcaagtggtgactcatttaaaaggaggtatgctctccagcagagagccaagttgttccacaacatgtacattgacatttacataaaatgcaaatatgttcatcaagttttacttatatttgtctctggattttcaaatacatgtttatttgctgtatccacctataccagttttctttaaaaatacttgtaaggcacgattttaactacttgaagcttgatgaaggttgtacacagcctgtttcaatgcacttagcatattctctttgacgatgacccgttcttgccagccttgcatgtgggcgtgggtgggtcacctttaggctggaacaaccgagagtggagacatggagacttcctgttctttgataacgtacagggagggcttttcagggcagtaaaaccgtcactgaagaccatgaaaatgcccaaatgctacatgttccagtcagctagttcaggcatttattactggccttaaaatgttatgtaattttgtttatggcatcataatagtataaaagcagctgggctcactagggggctgtgtgagtaatctataaaacttggaccagctacaggaataacagcacagttgcatacagcaaaaatgtatttgggagtagctgtcttttactgaaatggtagagaacaaactgaggtacagaaaatgtaaaactctcaagtatctgcttccctcagctcccttcattcttctaatgactagaaaggaaacactgttgtaatgagaaaacttctccagaaaatcttccaacaggttcctaacatccccaaactgaatttcagtgggtcctctctcagttccttgaagaaatgaagtaaacaagagatgaaacatgttaaagttgagatgaaataaatgtgatgttagttatctaaaattctgtaggaggagaattaaacgctaaaaacgatcctaaaatgtttggtagactcgcttactctactgccaggggagtgtgtttccttgttcagaatcactgatgtatgttgtataaaagtactttttagtagggctcctattttgagccaggtattatcagcactaggaattcaaggatttacctttgaatggcgcagtgttaggcttggaaacaggtaattgctgtaatggaggcaggtttcaagtggaatgagagccagaaaggagtccaaagtcaagaacatttgggaaggttttggaaagaacatgttggtgcagggattttaataattttccaagcagagggaataaaatatatagaagttttccattgtaagagagcatgccacattcaaagatatcattaactagtttttggtgttattggagcttaaaatatgagaaggaggtgactagaaatgcagttaagaaagggaagaaccaagtattatgatgttgaccgaagttggagcaacagtcttggagacgggaataagggagcagatttgagacagttaagaggtggattggacccacctctgaactgtgattgtgcttgagacgtaaggacatgtttttccttaaggacataaaggtggtttgcatgagtgagcagttggaggagccattttgttaggtaaaaaataaaggaaggggaacaggaacaaggtagaaattaatgggttcacttttaagtattgataactttgagatgcctattggacaaatataattgtctaattgatgatcattctatgtagttgaagtttagaagagaagtctagatttgagagccattaggatatagattataggtgaaagacaggcatggatgagaactctcaggcaaaatgtatggcatcagaagacgagagccaaggacaggtcccaagggatccccagcacttatagggatggtgaaaagcagatattccaggacgggagaccaaaagggaggcagtgaaggaggtggtaggagatccaggatagggagaggttataaaatccaagggaggagggaatgctgtgtggtcaggtgagcgatggtaggtaaggcagagagtcaaacagggacttaagaagtatccattggcctggaaactgttaagttcatgtggggtcgtgagatgtgcacattcagcagagttgagagggcaaatagattacagagcaaggagaagtcggatggaagtggtgtatggagaacattctcttaagaacctacatgtgtacagaaggaaagagaaatacactacattcccagggaggtcagggagacttttgtttatgttttaagatgacaaatttgaacatgtttatatgcttagggaaagaagcaatatgaaaggagagactcaaaaatgtaggatgagaggataatcagtgtagcaggtcttagattagttgttctcagagtctgctctgggatcataaaacatcacctggaaattgttagcaaagtaaattaccagtccttacttcagattactcaattagaaactctgggtttggagctcagcagcctgtgtttcaatgagccttctgggtgattctcacgcacactcaagctggagagctcctgtcctagatgaagaggaacagtgggatccagggcccaggtgagtgcacatgcccttgcacaggaggggaggtgcttctgcgggcgcaggcacaaatagatttgtgctgcatggttgtgaagttgatgggctttgttcctgatgacatactttttctttttgaactaggaagcagttttgtccattgaatcctgagatgagagtagggttgggctgggtcagtagcttatgcctgtaatcccagcacatgggcaggccaaggcgggacggatcacctgaggtcaggagtttgaaaccagcctgggtgacatggtgaaaccctgtttctaaaaatgcaaaaattacccgggcgtggtggcaggcgcctgtaatcccagctacttgggtggctgaggcaggagaatcgcttgaacccagaaggcagaggttgcagtgagccgagaccgcgccattgcactccagcctgggcaacaagagcgaaactccatttaaaaaaaaaaaaaaaaaaagagtagacttgattgagtttactcaaatgaaatacacatttaaggttttggaaatgttgcattctaattgacctataatatgattagttttaagctgaagcatacctttattctctccctcattacactcttcctcctggccctttctcagcaggagctgactgttcttcttgctactgattccttgaaaccgaaacgattccatcatagcctgtgttgggagactcagtcttgaggtgttcaggggctttttgtttgtggtttcaatggggcttttaaatctttgtcttaatctttggatactttcaggagatggctgagatcacatcatttagagccagaataaaggagaatgtttgagcaaggattcatcaaaccaatatgagaaatttacagatgttagattttattaacactcccacacaggaggtttgaaatgaacaacagcaaaacaggacgtagatttttaagaagaaaagtcaaacaatttaaaaatctgccatgggcatctggtcgtgggtcccagggggccacgtgctggacttttgatctcatcaaatgcgtttcttagctggtcatgaaagctggttgtcgtttcatttcatgatttcaatatggtgaagaatttggataaagaagcagcattttgatgtgtttagtttttaggggaaataatgaatttgctgtaactagtcattaattttctttttctattttctttccttttgatgaaaatgcatttatattaattctaatatgggaacacaacccccatggggtgaaagagtctgaaaagttataactgaaaacaatgtcccgaaagctgccacaaaataaggccagggagatgaggcatcttgtctctgtgaagaccttcagtatgaggtcttctcagctggtagcatggggggaaagatcacgttggaagtcatctaccatcatgcagagccccagctccttgctatggaagggtagattggactttttagatctaagaaccttttttccactcagtaccttgagcatttgcgttgataaatgtttggtttctgacagcagtcttggattcaactgtataagggaacctttgaatttgaaccgctttgcaagtgtttcttgtttcgtgtaaagaatgcttggccacatctccaaaggtgtggctacgaaagaaataaggaaatcctacctctaaatggaatataacagtcctcaaagcgaacccagtgagtcaattcttgtctgagtttttgcttattctatggagtaaatagattttgttaatattgtaaacacagtttagtggaatatgcaatgtttccgtagttccttgattttattattgggaatatgaattaaatacaaattaagtgggtttagaaggggattagtaaaaaacaaaacaaaacctgaattagaaaatgttactttaagatttatttgatggaagtatttagcctataagtgagcctttactattatattagatcaactctcagactgacattttgattgtttcacatttgatcagaaattgagactataggatgctacttctatttaaatataaatgtgggacagatgtagtgactgacatctgtaatcccagcactttgggaagcccaggtaggacacttgtttgaacccaggagtttgagaccagcctgggcaacatagtgagacttcatctctacaaaaaactattagccagctgcagtggctcatgctggtcccagttactccagaggctgagaccagaggatcacttaagcccagaaggtggaggctgcaatgagctgtgatcatgctaccgcactccagcctgggtgacagaacaagatcctgtctcaaaaactcgaaatgtgattctattacagctgtgctattaaaactcccacctctttaaagatggaattgagcattacccaaaaactttaaagggagaatgtctctgggctatgtaaagagctacagttccacaaaccctcctaaaagaagaccccacgtgctcaaggtccccatgaccgtgggtctgcacccagagccaggctggagggagggctgggagactcgcctgcccaagcctggtttgaagacctgatgcatggaagcaacagttctttgagaggacaaaatagaaaaagagaaatagtatggaattctttctttctgcaacaagttctatgtaatcgtttcccaagttaaaggaccccttcttacttaactctaaccataaacaactttattggagccagaacttacacatgctttcagtattaacattaaaggatcattctcagaaagtctggcttttctgtttccttctttgcttttgttatggcaggatagattggactttttcttttagatctaaaaatctttttttcacttggtaccttgagcatttgtatttataaatgtttggtttctgacagctgttttgggttcagttgtataagggaacctttaaatttaaaccgctttgcaagtgtttattcctttaaaacatttctaatgtaaatgtatatacatagaaggattctgaaaggttcttcttagtcaggtttaatctgtcctgacagctcaatgctattgaattcttaaaatgaagatgtcctggttgtctgtgcagcccagggctcccagagggctctcaggtagctagttaaccaagggacacccagcagtggcagatcctcatcctctcaaaaagggcagagcttcgggacactggtctagcccagcaggcatccccttagcactgtgtgctgttggcactacctgtcctaaaacctcaatatttatttggcctcatgtttattctttgcagacttattgagcacctactataaatcaggtaggtcatcgtctagataggtctgacccagataaacaaggtttctgtcctcttcaagcttaattttaagtgtaatcacagtgggatactccaagttagggatcaacagacctctctctaaagggtcagatagtgaatgatttaggctttctgggctataccgtctttcttagaactgctttactctgccttgtagctcaaaagcagccataagcaatacataactggaaaggcagggacgagtaccaacaaaacttgatttacaaaaacagtggccgaggtaccatgggctgtagtttgttgactgctagtctagacaatgccaatccactgagacagaatccatatcatacagtctggagtagggatttgtttcccagactgcaaagcagctttccagtcaacgtcggcagccatagagaataagtgcatttctcagcatttgctgcctgttgcagagttactgacagctgcatttgtcatgttcttgaattattttttccaccttggtttaataggtttcccaaaaagcctcagtgaggaagcatcaccctaatttgttctacatgtcatgtgtgtgataagcagaaaggaaacagacaaactcagaccttgaaactggaatgaagcatttaattcctgctcccatgctagcttggcagagttgagcaatacatctacagacgtccttccaacacaatgacttcgttgccctctgtgtggcctcttacctggtgctgggctctagggttgatgtaggacttgggtcctgccctcagggatctcacatcacaggagtggagtcgatgaagtacattcctgccttcattcccgaggcatgtctgactacctgccacacatgtgcaaggagagcaaaagtgaccaaggcctggaccccgtcctaggtgagttcacagtaaagcaaatgaaaaatcatgcacagtaaggtaaaatccagtgctgcagcctgtgatagagatcatgccgcttgggttgctgagttctccccctcgttgtaattcagcaggcttcccagtgtgccctgcatcctcatctgtgaggccgacttcactatcattcccacttataggtggaggagactgaggcacagagctcccaaagccccacagctggcgagtggcagggctagcgtgcgatgtccactagactggtgtctgacgcagaagctgcgcttctcacccctgggatctggaagataattctgatgtgtgagatccaggagaatgcattgtttagccagaaaatgttttgtaactgcatttttgtttttgacagaaatgtgactgcccactgaatagtgagcattggaattagagaccatctagctgccggggctgggtttggtcatcttgcgttttttaagtctgaattgggatgctgtattcgattcttaaaacggccatggtgacataccacaaacagggtagcttaaaacaacaaaatttttttcacaattctgagggtaaaggtctgaaatcagggcgtgtgggcagggtgagctccttctgaggcagactgttccgtttctttcccgtagctcctggtggcagcaggctgtccttggtgttccctgcttgtacctgcatcaccccagtctctgcccccgtcttcatgtggaactctccttgtgtctgtcttctcatggccaccttcttactgggatgccagtcatgttgaatttcgggcctacttactctctagtgtgatcttttcctaactcattctatctacagtgactttatttccaaataaggtcacattttagggtactgggggttaagacttcaacataatcttattggagggaacataattcaccccataacagacacctttagacaggatggaacttccttattcacccctagcccatcccagttgtttttaccctggaaaagattcccaaatctctgttgccattgccctccttgggcatttgagttgactccttctttcttcaagctatttctgtgtgatgacagagagagggtttaaatgactcatctcctatctaggtttctttcattaagatgccgagactcttcttttcactaaatattatttccacccactcatggagcagagagccacgttccataaaagggctctctgatatacggtagtagtcacatgcttttagcaatgcatacctgccaagaatggacagatacctcagattaggctgtactgtcctgaatttttggtctctttcccaggtgtttcccaggaaagaaattcattatcaataaggtggaaaggacttctcagtattgagccccataatttgccttcgtagtgttggagggaacaaggggaaatgggagcagaaatgagaaatgggagaggagtttgggaagtaaggcggaaaggccagcacaggtagcattgctgacgagagacaaagcttggatgaggccactctgcctttcaccaccaaggcctgtaatagactggccaggctccgaaacgctggactcaacgtttaactgcctgctctggaggatttaggacaaacagggaaaaaccttttgaaatagttctctctgccccccgccctcccgcacttattttttttctaataaagatgatttctacccactcgtgaagtagaaagacgcagtctataaaacagctctttaattctggaaacttacctctggattcagatcagctctataaatgactggaatggtgactgttgtacttattttttgtgggaactcttagttgaattttacttcattgcaattgtggttaatttctactgagttttaaatgcctgcacacactaggaaaagttttttgagcgcctactgttgggtatcatgagaggcacgaagatggataaatcatgattcttgccctagatgaacttatcaattagtaagggacagaagatgcctcccagcataaatagtagaactaggaatgggtaagagcacctagagaggaaccaaatgtctctggatgttccgacttggaagcgtttacttcacgattccttctgcccatgttcactcagctcctacaaagagccaggcgtgctggtgtatagtgatgataaacgacagctgacaggagccaggatgctggggtgagactgggcttgcacctggctctgtggcctgatggagggaggggcttagcctccatatgcttcacatcttctttatctgtaaaatgggaataatattaatatctccctcacagatatgctgtgtatacatagacacaacacagagaaagtaagaaagactgcttgccagccgagtgcactataaaagtagtatgttccctgcatggggccaaccttcagaggtgttaataacagggcaggaaggaaacaaaaagaggaattattataaatggtggtaagtggagggcaaataagattctcatgcaagggagaatcttttaagttttggggttttttgttttttgttttctgagacagtctcactccgtcacccaggctggaatgcagtggcacgatctcggctcactgcaacctccacctcctgggttcatgtaattctcctgcctcagcctccagagtagctgggattacaggcatgcaccaccacacctggctaatttttgtatttctagtagagacgaggtttcaccatgttgcccaggctggtctcaagctcgtggcctcaagtgatctgcctgcctcagcctcccaaagtgctgggattacaggtgtgagccaccgtgcgtggcccctcctttcggttttgtgattaaggatggacttcctccaatggtggcatttaaagccatgccatgagggagcaaggctagaagagtggggatggctgttgtgtggtagaggctggatcaagcggagccgtgttaggccatttgaagaagtttcaattttcttctgaagtagcagaaaaccattgaaatgtttgaaatgtgggtgtgactgaatccttcatgtttgtaaaaagatgattctaattctgtctagagaagtatatagagaatggattcaaggggtcaagcatgagatgaggttaagagtgtcacaataacataggctagagacgatggctttccctgggccggagacgatggctttccctgggctagagacgatggctttccctgggctagagacgatggctttccctgggccggagacgatggctttccctaggctagagacgatggctttccctaggctagagacgatggctttccctaggctagagacgatggctttccctgggccggagacgatggctttccctaggctagagacgatggctttccctaggctagagacgatggctttccctaggctagagacgatggctttccctgggctagagacgatggctttccctaggccggagacgatggctttccctgggctggagacgatggctttccctgggctagagacgatggctttccctgggccggagacgatggctttccctgggctggagacgatggctttccctgggctagagacgatggctttccctgggccggagacgatggctttccctgggctggagacgatggctttccctgggccggagacgatggctttccctaggctagagacgatggctttccctgggctagagacgatggctttccctgggccggagacgatggctttccctgggccggagacgatggctttccctgggccggagacgatggctttccctaggctagagacgatggctttccctgggctagagacgatggctttccctgggctagagacgatggctttccctgggctagagacgatggctttccctgggctagagacgatggctttccctgggctagagacgatggctttccctgggctagagacgatggctttccctgggccggagacgatggctttccctgggctagagacgatggctttccctgggccggagacgatggctttccctgggccggagacgatggctttccctgggccggagacgatggctttccctgggccggagacgatggctttccctgggctagagacgatggctttccctgggccggagacgatggctttccctaggctagagacgatggctttccctaggctagagacgatggctttccctaggctagagacgatggctttccctaggccggagacgatggctttccctgggccggagacgatggctttccctaggctacagacgatggctttccctaggctagagatgatggctttccctgggccggagacgatggctttccctgggccggagacgatggctttccctgggccggagacgatggctttccctgggccggagacgatggctttccctaggctacagacgatggctttccctaggctagagacgatggctttccctgggccggagacgatggctttccctgggccggagacgatggctttccctgggccggagacgatggctttccctgggccggagacgatggctttccctgggccggagacgatggctttccctaggccggagacgatggctttccctgggccggagacgatggctttccctaggctacagacgatggctttccctaggctagagacgatggctttccctgggccggagacgatggctttccctgggccggagacgatggctttccctgggccggagacgatggctttccctaggctagagacgatggctttccctaggccagagacgatggctttccctgggccggagacgatggctttccctaggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctaggccggagacgatggctttccctgggccggagacgatggctttccctaggctacagacgatggctttccctaggctagagacgatggctttccctgggccggagacgatggctttccctgggccggagacgatggctttccctgggccggagacgatggctttccctaggctagagacgatggctttccctaggccagagacgatggctttccctgggccggagacgatggctttccctaggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttaggaggttggcataggagatgtaggagatgggaaaaatgaaatagattcaagatacattctggggtcagaattgtcatgactctgatagactggatgacatggattggggagaaatgggggaaggttttataatactgctcatgtattagagaaaaataaatactgtcatctctcagatgggaatgaatcttcccatctaaggagtaggtttgggggcagaacttagtcatattaaatttgaaaaatgtcatttaaagagagattttttctcattgaaaaatcatcttccagtacacaagtgtcagagtgaggatactcacagtgggagtggctttgagagaggtgggaagaggaaaggagggtgcctgaacagatagtggcatctgttagcaagtcagggtctggaggaagggcagcctgatttagtttgtgacttgattgaaactgtttagacctataagcataggtattaatgatgatgattttgttaaaatgcaaaagtctattttacaaaatgactctcatatgagaaaatactctgaaattgaatttaacatccaggaagtcctatcatatttaaaatttatttttctggacatttacgtttccgaatgacttggtgagaaataggtctgtgagtgactcactgaaccccccaaaaaagtactcatataggtagatttcctcgtgccgatcaaaagacgttattaagggaagtgttctttagccatggctaactgggacatttgttcttgagttgggatggtctgatgctccttggacagtgtctggttacaagagcaactgatgggtgcactagaactcttttcgctgagaaaataaagcaagattctttggtatgtttgctctctcgtgcagcctcacaacatgggtaggttttgttcctctcctttttcccttgtcacatgtacacaataagctacttattttcatttgattttttttgtgataaaactcctgtgaaagttgagggtgaggctattatctgtacctccatttagcaaatacctggtacctcgttggtttcacaaatatttggtgaatagtttaataaacatttgcagattgggtgaacaccctgtgtataacatggacaccccgattatatgccttcctaaatttccttcttgtgctgtgtctataagctttcctgctataacctcaaaaacataatacctaacaaaagcaacaatgatgatggctgttttagctaagtgtttgtccttcaatagggcatgtgctttaagctatttcttctagagttgaaagttttgattttgttttcctccagagccatcttcatttcattaactttcctttctgtagctaagggcagcagtttgtgtctgtggccgtggaaccttcaatgtgtgtaagaagggaactgctttgcatggtaggtgtggcagtagtggtaacagcagcagcaatgacatcatttatttattgagtacccaatttgtgccaggcattataataggtgggaaaaacactgttggcaaaggtaaggccaggttctcgtaacaaagggacataatgataattgagtagcttcaaaggagatagacatttatttctttttcactgattgtgtaatgtatgtaccaggtgggtgggtgactccactccatgctgttattcagggcccggattctttccatggtgttgctccaccgcccctcaggccttcacaagaagtggaaaaaggagcccagcagggccagcccacagtctcaaggcttagctccagaagcagttcccaactctttcacttccactcagttggagcgaacttagtcacgtagctgtgcctgattccaggggttgggggaggaactgggaaacgtagttcaggcctgtgccctgggagcaagggagaacagatgttggtgaacacctagcaatattcaccacatcctgcaatgtgcagattattctgtacactttccagatgatgaattagaaatttgagaggttaattaactcaacttgccctagatgatgaggttgtaagggggaggtgcagattctaattctgttatatctgatttaaaaatctgtgctcttttcaccaccgtgataccattgaacactgtgttgttgtcatagagccatgtggagtttacagaggaaattcacatatgttaacttgcttatggcttcaggagcaggtctcccaccaccagacttacctagccagctaaggtgtctcaggacttggtatccgaatgaaaatagagtgcaattctaatctatcaaaaactggttttcttgcctgcttttaggagacaggagtaagaataatgaaaacagtcttgtaccagggacttacatcctagggcatggtctgttgtcagaatacattcagatcagtgcccccttcccacttggttcagttatagtgaggcatcagtggtgcccgagacatggcaagatcagcagtgactataggtgactagactctgtacagcgtagtgtttgcttcagactctgcaaagctgggctttggagtttgaatcttttactcactgaccaggtatgtagctgtggacaagtttcttaatcttcctaaatctgagattcctcaactgtaaggcaggatttgttagcctccttcacagagttgttttaagtgttagtgatcatgtaagcaaagggcctcccacaaagcagcatctggttaaatgacagctgctatttttaaaaaaataaacccaccaaccatgaattgagtgactgctatgtaccaggcaccaaggtaggctccagagatttagagataaaaggtagagtccctgcggccttcaagggacatccccgttagtggggatgtttcagagagaacaacctaagctcaggttttccctcaggaagaagaatgcgttctaaccagacgagagcgtgtgcgttctcttaatagattgtataaactgaaattgtgcaatagccagtttgggtgcaatgagctactcaaatgacacattgatttttttttttaattatactttaagttctgggatatgtgtgcagaacagtgcagctttgttacataggtatacacgtgccatggtggtttgctgcacccatcaacccgtcatctacattaggtatttcttctaatgctatctctcccctagccccacctccagacaggccttggtgtgtgatgttccactccctgtgtccacgtgttctcattgtgcaactcccacttaagagtgagaacatgtggtgtttggttttcttttcctatgttagtttactgagaatgatggtttccagcttcatccatgtccctgcaaaggacacgaacttatccttttttatggctgcatagtattctgtggtgtatatgtgccacattttctgtatctagtctatcactaatggacatttagattggttgcaagtctttgctattgtgaatagtgccgcaataaacatatgtgtgcatgtgtctttatagtagaatgatttataagcctttgggtatatacccagtaatgggatcactgggtcaaatggtaattctagttctagatccttgaggaatcaccacactgtcttccacaatggttgaactaatttacactcccaccagtagtgtaaaagtgttcctatttttccacatcctctccagcacctgttgtttccctactttttaatgatcaccattctaactggtgtgagatggtatctcactgtggttttgatttgcttttctctgaccagtgatgatgagcttttttcataatttttggccacataagtgtcttcttttgagaagtgtctgttcatatccttcactcactttctgatggggttgttttttttcttgtaaatttaagttccttgtagattctggatattagccctttgtcatatggatagatggcaaaatttttctcccattctgtaggttgcctgtttcctctgatacttttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggcctaacattgaagtctttaatccatcttgaattaatttttgtataaggtgtaaggaagggatccagtttcccctttctacatgtggctagccagttttccaacaccatttattaaatagggaattctttccccattgcttgtttttgtcaggtttgtcaaagatcagatggttgtagatgtgtggtattattcctgaggcctctgttctgttccattcgtctatacgtctgttttggtaccagtaccatgctgttttggctgctgtagccttgtagtacagtttgaagtcaggtagcatgatgcctccagctttgttctttttgcttaggattgtcttagctatatgggctctttttgggctccatatgaaatttaagtagttctttctatttctctgaagaaagtcaacattgacatttttatatgttgttttaatagtctttatgataaatgtcaacaaaaataatactttttagagacacttggtttttatacacacttagagaggtaataaaatctgccactaatgctaatagcattctgatggagtgaagacttagtggtatgtcaaaaagtaaggcacctttctcttttcctaatgtagtttgaatttcaaaacaacacgaaggaatgctgttggtatttattcagggatttgtgtgcagatttgatagctaccatttatcttcagcagaggaatccgtgttcctggcctttccccccttggttagtttggatttcctcaaaccactttgccctttgaaggattgtgtgctgttaagtaaatgaacgggtatgtttctgagtttgtgctgactgatttacaacaggatggcaaattcagcactgaaaacagggtcagacaaataccctggctatgagactcagctgactcagacaagcgaggctttgcttagtggtttttacccctccagtagagaaaagtcttggctaaggcctcaaaggcctgtggactggaaggtctggcagaacagtgtccatgtcattattgttagtagaagttgtgcagttgtattgttgctgatggtctcactaacactagctatcttttatgttctagccactgaagagtcattaattattgtggttcattctcacagcaaacccgtgttgattttcattgatcccaggctctcaatttaaataagaaagctagcaaagttattttcttttgcctccccttctggcttaacaaagagaactcagaagtacttacgttttgagaaaatagagacccatttaaatagtgttaccagagtgacacattattaactaagaaaatcagaattacatactttttagaggttgcctccacaggacacagtggtaatctctgaagcctggaggtctcatagccctatgatgcagaatattatcaatgataggaagagaaagcattgcctccttaacagtgtacggaggcatcttccaccagcactgggaactaagcctccactgatgaacggcacaggagaaagacacagacctgagaaggctgaaatttacaacgcgggaaagacgagggcagcacagaattattaaatggaatatgggaaacgcgtggtttgtgtctacagtccacacttgcaacacaggtaccattgtgtccattgtatagaggagaaaactcagttccagaagacttgagtaacttgccccgagtcacaagattcaaagatgccagaccagggagctaaatccatgaatatctggctttaaagtccttgccttttctttacctcacagtggtttacatgaggtgcattgttactcgtacactgaatttccttcactacctgcctttttcaatataaggtgaattctgcatcattttgttgaaatggaaagttctaaccattattgttttaatataggaggcacttgggccttgaaggagagttgtcattccagtagtctggtaaagggcatttcagatggaagacacagcctaggcaaaggcactgaggtgagaacgctgcagcttagtcagggaatggagaatagattcatttgaggagaactgagtgtctcagtagatgggggttatatcatgagaaggacgtgagagcctcagcatggagctggtgagcagaggggggccatttttgagggggggattaaagtgctcagatctgtggtctaacgctgttctgacagcagtgtgtagattgaaacagagtagagataaattgagggggaagtagcattatctatataaactgtcagcgagtagagaaatctggattttcatgtatttcgttcagggaacagtaactttcccataggtatttcccagggttgtgaataaatattgtagtgtactggtcaaggatgcaaagtttggggaagttaggaacatccttaagccacaaagtggatgctcaaaagttaaatattcactggaagtgacaagtaagcaatggaaatatgaaaataatagttcacgccactctcctgcctgttgccttaaattattccactgaaagctgctttctgctattttatttgggtaaattagtcgcaaatggaattatctgcatttaatgctctgccgttatccctctgtttaggtttttgtctctgttcctttaataagaagcaattcttgggttatgtctgccctctggtctgagggctccaggaagcatcccagtcatgaaccttccagttgaactaagtctgttccagatgcttcattgactcaacacatttcacactaggtagacaccggaagtaatcacaggccagcctttcttgcctctcaggctgaaacaagttcacagtgcaacagcttttcagagacaactccacacttccacaaatgcccctatgcatttgacttttcttggatggcttgttcacaatcactcagcagttactgatcataggtttgtgcctggcattgtctgagttgataggaaggtctacatgtgaaaatttaggattttgaatttaggatattgaacttcttttcaacttatctggtaagttgcccataactttaaagacaaatagaaaatacttttttgaaacattcagtcaaatttgaaatgaccatgttcctgccagacagtgaaatatattataaagccagattaataaagataatatggtattacaataccatgtaagaataagaattgtgatggaatagagagatttctacctctttcttctctcagaaatcatccatcaccatagaatggcaaggagaatgaggaatggaaaaacaaattctacttttgatggaatcaaaagtcattataacacattgatcaataatgaagacaaaaagcagttggagttctgatgactgaattaacagtggggagctaggtgggatctgagtgcctacagtggtggatatcgatgagaagcaagcatatttcctgctcagaaaggctcagaaattaatgaagtgaggtcctgaggggggataggttcatatggggaccttaaaagaaaaggagtatttgaaagactgcatcagatcctcccctgtactccctacagccttgaatgtgcctgctcatcttcagagtgacggtttctggagaggggccctgagcaccaggcacagcagaggttgggggtagaaaggaaataaggactcgagatgatctgaaagcctgtcttcccaagggccagatcttgagcactctggttgatattctccatgaattaagtaatgtttttaaaaatcagcctgtagaaaagattagaaggaaatagtccatgattttagtcatgattggagaacttttgttgatttatttttctttttgcctttgtttttcacatttaatttaatgtgtgcataccatgttatgctagaaaatagcaaaattgggtctggcatcgtgatgtgcgcctgtaatcccggccctttgtgaggccaaggtgggaggagttcttgaggccaggagttcaagaccagcctgggaaacataatgagacctcatctctacgaagaaactgaaacattagccaggcatagtggcaggcgtctgtagttctagtggggaggctgaggtaggagaattgcttgagcctaggaattcgaggttacagttggctgtgatggcaccactgtacttcaggctgggcaacagagtgagaccctgtctctaaaagaaagagagagagagaaggagagaaggaaaatagcaaaataatgcggaaaaataattatgatgaagaagaaagaaggtaaatgtttatcaaggcttagttgtgtaaaaatcctttaaaaaattaataaactttttatttgagaaccgttttatgttcacagcagaattgagcatagaggtttcccatataacccttggccattccctgccccacccctatctcccatcatcataaacatcccaaaccagattggtacatttgctaaagtcgatgaacctacattgacacattatctcccagactcccgagttgacattagggctcacccttggtgttgtgcatcctgtgagtttgcacaaatgtagaatggcatgtcttcactgttagagcgtcatacagacttttttcactgcccccaaaatctttcatgttccacctgttcatctctccctcccctctcatctctggccaccattgatctttttactatcttcatactttcgccttttccataatgtcatacagttgaaatcataccgtataaagtgtttcagattggcttcttacacttagtaatatgcatttaaggttctaccatgtcctttgatggcttgatgactaatctctgtttagtgatgaataatctgttgtctagatgtaccacagtttacctgttcacctactgaaggacatcttggttgcttccaagttttggaaattatgaataaagctggattttatatgatactgttttctctcctttattagcatattaattatacttctttttactttttaaaatggttgccgtagagtttgcaatatacacttactactaatccaagtccattttcgaataacatgaaactgctttatcagtagtgcaaatatcttataataacaaaatattcccaattcttccctcccatctttggaatcatcactgtcattcatttcacttatacataagcatatatatgcatacgtaattgagtacattgttgctattattttgaaaaagatattgtgtgttgatcaattaagaataagaaaacaaaagtttttcttttacctccactgaagtatgttcttcttccctctggggtatttttttaaatattttttttctttatctttgattttcttagttgtaaatatgatatgcccagaggtagttttcctggcatcctgcttagtgttctctaagcttcatggatctgtggtttggtgtttgacattaatttggggaatttctcagtcattattgttttgaatattatttcttctgttcctttccctctttattctctttctaatattcccattatatgtatgttacatctttcatagttgtcctacagttcttggatattctttttttttttttacaatctttgttctctttgctttttcatttcagaagtttctgttgtcgtatcctcaagctgagatttttcctcagttgtgttcagtctcctaataagttggtcaaaaggattattcaagtctgttaaaatgattttgatctctagcattacttttgctttcttagaattttcatctgcttatacttatctgttctttcatgtccttttttcattaaagcctttagcttattcatcattttcaaaaattttcttgtcgaatgattccaatatttctgctgtatctgactatgattctgatgcttgttcaatcttttcacactgtgttttttgccttttagtatgtctggtaagtttttgctgaaagacggatgtcatgatgtactgggtaaaaagaattgtgaatgggtctttagtgatgtggtggtaaatcactggggagtgatactgtttggatgttttgtcccctccgaagcttatgttgaaatatgacccccagtgttggaggtggggcctggtgggaggttttggatcatgggggtggacccctcatgcatggcgtggtgccttccccttggtgatgagcaggttcttgctctgttagttcacacaagagctggttgttaagagtctggctctccttcccttttcttgctccctccatcaccatgtgacatgctggcccctctttgccttctgccatgatggtgaacttcctgaggccctcatcagaagcagacgcctacactctgcttcatgtatggcctgcagagccgtgagccaaataaatctcttttctttgaaaattagccagcattggttacgtctttatagcaaatgcaaagtggactaactcagaatggaattgttctcctgtagtcctgtgagtgggtctcagtcttctagtgagcccatgaccctggactgtgagcttcactcagtgcttctcagtttgtttgtttgttttcttgtgggacaggatgactagagtggactggagttgggtattttccttccccaggtaggttaggctctgccaaagccccagcaagttagggtctggttagtttctctggagggcaaaaccttgttaagaacataattctctggtgtttttttctttttcttttttccttttcctatggtgctgatctctggtgttttttcaaaatggtccttttcctcctttttccactggaagcataagggaatttttctctgatactcactgcgaggccctgctagagctcctggaaaaaaaaaaactcacaaaagcttatccctccctactccccatgatgggcacctctggagttttaaactcgaagagttgttcattctagacccccagcagtatgtcgagtacaattgaggtttctaccgggtactgatttccatggaggtttctgttgtagtaagttgcaatgctctgtatgcgcccctctgtctctctagtcttgggggcagcagcttgccctgtgaccttatttctttggcagatctaagaatttttttttaacactgtatattgagaaattatagttgtgtatatttataagatgcaaagtggtattgtgagtttttaatacaatgtggaataattaaattaagctaatatatctagcatctcaaatgtgtaagaagaatggttgattttttagtttgtttagctttttacttgttgttaggatggaatggtgacttctaagcttcttacataccagatcagaagccagaagtctcatcctgtttttaaaaacaggactttgaacatttttatttttcttagtgtgctaagaaaataatgccagcggcagtaactgcacggcaatccagtggtctctagtcttataagagcttataaagaaaggcttcgtgtcttacctgataaactccccttgactgttttacagttaagtgaaaccccaatttctggcaagatctgaaacttggtttttcttttttgttgcctgtttaaaatatcagaagtaagcccgtgaaagctattaacatgtattcaggccgactttggtttctcctctatggatgtttctagaaacatagtgaaacaacacagcaatgattggttttgcggttgttgaggtcaaaccttggcacaagatttttggtctctgttttctctttattgttcgacgcaacccacatgcaggtttgtttctccatctcttcacctcatctggctgacatgttgataggagcttagccaggctgtctggccacgaaacctaaaatcatatggcttgtttagttggtaaggacatggaggaataaaataaccatgtggacggcactgtgcaaggtcttcaatgacagaggcgttgaacttcaggcagagtttagcgatcatctcaaccgtgtccttgtttcacaattctgggatcaacatccgcaaaactacacttctgacaacatcaggatcctctaatatttcatgtatactcatcttgcaagataggttgtaaaataagatgaggaacctgaaacaatgagcagttaagccacttgcgtcaagtcccaagggtggcaggaaaaacagagcaaggagtgagattgattacttgcagcctttggatttcaccatgaagttggtggtttttaaatggttttttctcccctaacatcgacctttctccagtcaaatggtgggaaacctcacatgtaaaacagatgaaatacagctgctggctcacgtgggaggctgtgtcatgtggtatgatgtttagaaggagggtcttggaagccaggctgctctgagcctcagtttgcccatctgcaaagtgaggataactactatacgtgcctcacagggttaccgtggaaatcagcgaaatcagttcccagctgtaataaccgtgcagtttattcagtcaaaaaacttttatccggcagcttactgtattctgggccctgttaaaaggacgaggtgatggctgtgaggaaacaggaatcccggctttcatggagcctacattctcagtctcaaaatacatgttaattatagtaacatgtgtcgaaggggcatcagacccctcctattgatacctcctctgtgtgtctggctctaaaggttccttagagcactgtgtgaaaaccactgtcctaggctacacatcttaacatctaggatgtttttaagagctggagtggggaaaaaaaatggaattatatgacagtgtttaaattttccattactgacataaactattccagaaacaacaggtagaagagaaggatgatttaggcctccagtttggagagtaattagtgacttgtctgcttttccttccttagtcatcttgagcacttgcagctgtgcatcttcctttgtgcctgatgcaagctgatattttagggtgaaagggtgagaaggaaatttagattcaaagtgctgacaagataaagtacattctgtaaagattcattccccttaaaattggagttcttaccgagatatcttcacttagcagactgatgtcaggaaagtaaaaaatggaagggaactttgtggttgaaaattatgttcctagaaatgagggttgaccctgtttctatgagaagagagagcatgtgcggctctgctgatgggtacagagaagtgcctttgtggtagcgcccaagggagaatgcagagtagaccaccatctctactctgattgttttcaattctttctcagatgcctacaaacatttaaaccttgtctgactctgccttcccttggtagttttaaggcatatggaagaatttcaacaaactgaattgatttgggggagaaggaggttagatttttttttaaatgttgccattttaaggagctagataatatacaagagacctttggccttcggccttcctgtggaataggtcccgagggagttatgaacttccaaatgtgaaaatgcctatgtaattatttttctctctgtgaaaaatgcaaagtatatctgaaaaagttaagtaattcctctagatgtgtaacgattctataaattcaggattaaagtaatttataaggctaatttatgccatttatttatttatttatttatttagagacagagtctggtttctgtcacccaggctggagtgcagtggcatggtctcagctcactgcaacctccacctcccaggctcaagtgatcctcccacctcagcctcctcagtagctgggactataggcacacactaccacacctgactaatttttgtgtctttttttcgtagagatgggggttttcccatgttacccaggctggcctcggccttctaagtgctgggattacaggtgtgagccactgtgcccagccctatgcccattctttagtgctggtaatagaaatgaaccaatctatcagttggttttcatgtcggggtcattttcaggcagaaaaatagattgttgtcccttgacctaaattgtctgctttcataacagaaagccaatgataacaaagccatgtgaatcagtcttttcctgtggagtcaaccttacaacaaggaggattcaaacatcttcagtgaagtagcaaatgattacatatcacagatctttgcatcaagcaaggtcaagtatgcacgtgttaactcagtgaattctaagtatctgattaaattttgtaagtcaatgccaatttccctttggactcagagtttacctgcataattttgttttattaatattttaaaataaaaagatatgtggccgagcacatgtggctcacacctgtaatcccagcactttgggaggctgaggctggtggatcatttgagtcacgagtttgagagcagcttgggcaacatgatgaaaccttgtctctacagaaaatggaaaaagttagccgggcatggtggcacacacctgcagtctcagctactcaggaggctgaggtaggaaaatcacttgagcctgggaggtccaggccacagtgagctgtgacggcactaccatactacagcctgggcaacagagcaagaccctgtctcaaaaatgaaaaaagaaaagtgatgttgtccagtgaactaaaaaaacagagattttactcattttgttctgtgaatgttatgctttatttagagaaatgagccatcaaacagggaagacagcactggtataagatgagctggcagagaccttcaggtggtcacaagagaacacagtgagcaatgggaaaataaggcaattctcttagcactggaaggcgtttaacagaccatctagttggtcagctccccctagcttacctttcaccctttgttttataaatagggaaactgagatgaaatcacccaagacttttgggactgtctaccaaaaatcacacaaccaagtcagagccagaacccaggttttctaactatgatagttgtgttactgttgtgccatcctgtcttctgagatgttggcccatcttcatcagaaaactttgatctggagctgtcgggagccgtagaataacagagcaagcatggatgtcttggcttgcctaacactgctcctcacttagtgtaaagagctcttggccgggcatggtggctcatgcctgtaatcccagccctttgggaggctgaggcaggtcaatcacttaaggccaggagtttgagaccaacctggccagagtttgtttgtttgttttttgtttgtttgtttgtttgttttttgagaaactccatctctccttaaaaaaacaaaaacaaaacccaaaaaattagctggacatggtggcacacgcctataatcccaactacttgggaggctgagacgtgaaaatcgcttgaacctgggaggcggaggttgaagtgagctgagatcatgccaccaaactccagcctgggagacggaatgaaactctgtttcaaaaaaaccaaacaacaacaaaaaagagttcttaatgctcctgaaagttattatctagcctctgcttaaatactggttcatgagatagcccactcccccagggtggtgatcccagatatactaccctttgatttctgtcccagttcttctatttggggtctggagcacctatgatgtgtcagtcactgtactatatgaaagagatacaaagtaggataaaatgtagcttcttctttctaggaataaccctagtagtaaaagaaacagacaagtaaatcagcaatgatggttcagtggggtaagtggtattgttaggggtatgtactttgctacggaggaggagaacctaaatcagactggagaatgaggaaaagcttcctgaaggaggcaacccttgagctaagttttggagtaggagatagatgaagcaagagaaagggcagtcacacgaatgaaagagcctgtggaaagtacattcatcagcacagcactttagaaaatggtgtatggtgttctgtagggctggaaaaagggagatttgtggccggtgatgagaggaagggtgaggaaaggatgcagaggccagattgtgaagggccttcatggataagcagtctgcatcgtgtatgattgtattgtcagaatgttattttatagctcattcctcttaagatgctttcagatttaacttgtcctgctttggaacatgaggatcagaaaaacctggattcaatatctggcaccacttaagcctctttgagccttagaagcctcgtttgtgaaatgagggtgatagtagcttctcccaactttcgtggtaaaaaaagaatctagacaggcacctcataaagtgctgggctcattgcagatagaaaacccgcttgtttctcccccccgctttttttttctcaaagtctctgaataattacattcagcgtccctaccttgtctgctaggagttctaacattagattaacattttcttgcaagaattctgtcattttttaaacctaaccacacaattctacattttggagtgaaggtaagcccaaagtaaaggtttcccttattactttttatggcttgatagagaaaataatgaggaaggtaagttatgacttttccacatatcctgttttaccaggccaagagttagatgatgaggatactcagaaggcaaagaaagtagacaaaaggtcagggaagctatttaatttggttgacgtatatggaggaaacagtactgatatgacagatacgttttgtttgaaaaagcattttgtgcctactcaagtatagacacaatatatcctgagcagcgagtgggcatgaatccaagcgggtgtaagaaatacagcaacgctagggaagattcagaaaagaaagagttgagttattttagtgaaatgatagctcaagttagagaagtgcatgctgagagaaacgttgacgttaaagagtaaggactggccacattttaatttcctctaaggatcttttctaagagaggagaaagaaatgttacagtggaagtgagtgtagtaggtgatgggaaagggaaagggggaagattgaatattgaaaacaggaatgaaggaaagggtgacatgtcagctttatttttacttctattgtgtgtcaaagcgatggtctttctttttttagctagtcaggtctaaactgtaataaaatgaagtcagagtgagatgaaccgaataatactcaatttcatggaaaatcttatctgtagttggcagtcgtctctttacttttggatttaattccttttcatcattttctgtatcagttcttttgagagtagttggctggtgctgcagatgaatacatgcctattggtggtttggtataatttgtcttacattgcatcttcactggcagtgttagcctgatgattcgtttctagtttagcaaaatgagaattagtttaataagatgttgagatggtgatcagttttccaggggtttggttctgctcaagagctggcatccaatatgccaaaaaggcaataagcagggtggatcaactgccttaagatgggtatgcaatgttcaaaccaaaggatggcatagtgagagacaaatcattgctccaacagaatggaagaagttgctggaagatgacttcgctggcaggcaaggaaggaaatcaagaagtcagtttttaccaccatcactaaacccttcccagagtaccgaagcaggctcatacccaggggagtaggggagtagtacaggaggaggaggagaagtagaaggagggagacaaagacagggagagggaattagctgaggctggggagacagagagtcacaagagaagaaaggaattcttgtgaactacagtggtttgtaggactcaaaagtaagcaggtggaattaacctcataaaaaataatgctctgcctgcctcgctaggggtaggcacccaacacgtcacacgtcctgttttgctccctcacttgtgtcagctcagattatttcctgcctgtccactgctagccttttgtggctgaatatcagatcttgactgagcatctgagcatgtgctggcctctatggatgaggaagccacaatgaatcagacataacttttcttctcaaattcgtttatcttaaaaagcatttattgtagagagtatactatgtgccatatacattagtaggtgctagtatagaaaataccaagaggctgaatactgtggctcacgcctataatcccaacactttgggaggcccaggcaggaggattgcttgatcccaggagtttgagaccagcctgggcaacaaaatgagaccccatctctgaaaaatgaaaaaatagaaaataatgttatctatttgtataacctagtaatgaacatagggtcatttgtaattttttgcatttacaaacagtgttcctatggaaattctcttcataagcgcctcctagaagacacatcaagaggtctgtcagctataaactatagcaacatgcatcaacataaatgaatcttaggatataatgttgagccaaaaaaaaaaaaaacccaaaacaaattgcaaaatcatcaatgcagtatgattccatctgtaagtagccaaaagtatgcaaagctaaacatacaatatgttgcttagtgcctccttatccatgggggatacattccagtaccccagagggtgcctgacaccatggatagtactgaacctcatgtatactgttttttcttatgtatacatacttacaataaagtttaatttataacttaggcacagtagattaacaacaataatactaaaatagaacaattataacaatatactgtactatctatactcaggtatcaggtaaatctatttggatgtaggaaagtttcttgaaggaggtgacatttaagccggatcctaaaggatgaataaaattatgagcgatcgcagtagtgaaaaagatatttttaaaagaggaaactatgaataaagatataaaagctatgacctggcaatcatatgccaaaaaaaaagaaaagacataaaaccacatgggcggccaggcgcggtggctcatgccggtaatcccagcactctgggacgccaaggcaggagatcgagaccatcctggctaatgcggtgaaaccccgtctctactaaaaaatacaaaaaaaaattagccaggtatggcggcgggcacctgtagtcccagctactcaggaggctgaggcaggagaatggcgtgaacccgggaggcggaacttgcagtgagctgagatcgcgccactgcagtccagcctgggcgacagagcgagactcaaacaaaaacaaaaacaaaacaccacatgggcccacaacctgacttgggaatgacagagaagccaggataactgaaatacgtgttgggtgcagggaaacacaggatgggagtagattatagggggcgtttgatgtcacacgagagaattttgtctttattctgcaactactgggtagatctcctgtttctcttttgtaaaatcaaatctgtttttaaaaaagatttatctgatgacaatttaaagaatggtttggaaaaagacagggaccagagagattgacttggaaagttgcaagtaagagataatgaatacaggagacaaatacctgcagtggaaacgggaagaaagggctgaatgtgagagtggcacagagatatgatttgattagcacatgaatttggaataaactaccactgttttaaaatttaatttgcgacagtcttgctgtgtcaccaaggctggacagtggctgcagtggtgctatattggctcactgcaacccctgcttcctgggggctcaagcgagccttccacctcagcttcctgagtagctgtgactgctggtgcctgccagcatgctcggctaatgttttagcattttctgtagagacagggtttcaccatgttgcccaggctggtctcaaacatctaggctcaagtaatctgcccgcctcagtctcccaaagtgctaagattacaggtgtgtgagccaccacacctggcctaccactttctttatcgtccccttttcttcctgtttttctttggcctgttccttactgcctctggctcatcttgatctgcaattttattggtataattgccatattgactcaggaaactagctaccaactacattttaactagcatctttaaaacgcttgtctgagaaagagtaacaatgtttactacaagcatttataccagggcaaatggtataaggactaaggagaaatacacttttcctaattacagtgttgaccccttaggacgctgagcatttgtaatttaattacatcagtgagttaatgtggaaaagtacctgatacacttcgtgttagtttcattttgcttccaagtattactttcactttcttctttaattttttgaagtaaagaggattatcagatttaaacaaagttacacaaaatcctttttaaaattaaaataatcattgttgaaaatcttgctgaagttctgttgtgtttctgtaggtacaatgagctaaacacgttttaatcttattcagcattgaacatgcaggcttcatttgtgaaaagtcctgtgtttgtttgaagaaccaggcacaagagtaatcacagaacatacttttgaaagtacatgtggggtttttgttgttgctgctgtttatttttaaaaactgaaccctacttggccaggcacggtggctcatgcctgtgatcccggcactttgggaggacaaggctggtgtatcatgaggtcaggagttcaagatcagcctggccaagatggtgaaaccctgtctgtactaaaaatacaaaaaattagccagacgtggtgtcaggcgcctataatcccagctactcaggatgctgaggcagagaattgcttgaacccaggaggcggagcttgcagtgagccgagatcacaccactgcactccagcctgggtgacagagcgagactctgtctcaaaaacaaaacaaaacaaactgaaccctacttttaagccagtttactttatgtttgctttttctcactttttatttttttcagagttacatcctaaaaaatgtttttagttaattgaaagattttggtctagttggagttgatatattaatgtgcagtgaagtttcccaatgtagcaaatttaaactatggaagaagaagaagaaaaggtaatcttgctttgtttctttctccagatatactgataatatatattatgaccaaagagatctaactagcttcaattcctctttggggaaataacactttacccaaaggtgtttatttttatcactttctggaatgttttggggatttcatgatcacatgccgaccaaattccttttagattcttagagcctcctgctcagcctctaattgccacctactctgtctgataattacctttctgtttggaatctagtattttatgaaaactaaagatacttgatcttcaccttgatatagcatctagatacagactatcccctgcacaaggaaacctcaatgggtagaggcttttgcagagacacaaccctgtatgcacttgagggtatgtggggagttcaggctcatcattttagtatgcgttttcacagcgttctgctcgagtgcgtagccaaggctgtatctccttttagcttagtaaaaacctgatctgtctccattacactacaaaacatattatgttgactttcagtgtttttgcacagaatgtgagacctgctaagagtagggtacatgccattaacaggagcatttggggagctagtatcacaatcttctcaagttaggtgagaacagtggtaacagtgatgcccatcaaccagtactctcagcctttacccagaggcctcttcactcatttgcttctgaggatcggctttctgattgattctagttaggttgacaatggactgaactatcatcaagcagccataaaaacgtcattttttttcctatgcttgtcagtctttttctttttctttattacaatcggtaattctcatatttctttttcctcctggtctttgtaacttttttgtcatcaactcatctgttcccttaatccttttcttttcatgccttgtttcctggtgtttgattttgcttcatttcccaaagtgatccttacgtttcagctttttagtcgtttattgataatgctttggttaattttttccccttcaaacaagttttacagtaataatctccctcccacccagctttatcatggtataattgatagatactcatctttatttacaggtatttctgttttattttctttgacaccaacatttcttttcctgtcattgataacattttttttccagaaacggcaaattctaatctaaatcattttgctatttattgtctttgaattcaaagttggaaacctcacatatgcaaatgcagttgtttgctgtaatcatcaaaccctgattcctttagtgaatatattctgttttgcatttagatgtaggggggaaatgagagcatttgtgcaaaataaagctagagggaaagaaaggatcatgtggaattttattttttattagaaataactaattaaatctgtatataactcaagaaaaggagaacttgaccttttgtttgtaataatgaagagtagggtgactggttgaatctcacacatgagaaagttgagacgtttcttcttggtggaagtgattactaagcagggattatgaaaaaggacaacacaggggaaaagtggagagttctcctggtcagatcacaagcagcacagtcagactcgtaggaggtaggaattgactatatcatggcaattgtttttttttttttttgagagagagcctcgctctgtcacccaggctggagtgcaggggcgcgatctcggctcactgcaagctctgcctcccgggttcacgccattctcctgcctcagcctcccgagtagctgggactacaggcgtgcaccacctcgcccagctaattttttgtatttttagtagagatggggtttcaccgtgttagccaggatggtctcgatctcctgacctcgtgatccacccgcctcagcctcccaaagtgagccacgacgagtattttcaagagatctgacgtgtactgtgcatcgcggtaaagcagccatggagtgggtaattcacccccgcatctttctgtaaccaaggaaggtaacaggctgtcggctgccgtggactccgctggtattttaaattatccatcccctggtttgcaggtaataagagtgatgcagaaacaatgtgcctccttgtttttcttcagttcttgtgtagtttctctaaatgccattgtgtatccttcatcacttaccttatatgtcctgtgatcttgagagctggtgctctcaataacaaatagccaactaatatgccggagtgttcaatccctaactcaaagacttgtcaggctaatgatgaatgactgtgaaatccatccccagtttccctacccaaattatctgcgtaagtgtttttactctgttatttagagagagcggtgtgataggtgaaaaagaaatgtgaatttacgtttgcaaataactaatttaaactctgtgccaagggaaatggcactgcttaactgagcatggatagaaaatactgggaacatatgtgcacaaagtcacctccagagtatggccacatttggcaagaccactgacttggcataagcagtgtaactttatatcggaggcatattttggattttgagtgacatatgatagcatattctatgacgaccgactcggaatggtgaaagcaaagaactatgacgctgaaagtggtggtgaatccttctgggcaatgttaagagtcaagaaggccagagcgagccaatctgtgtagtgactgaggctccaagaacagggggtggtcagacgttcagggcctagtgtggctgtggtgacaccaacaacctgtactcagatcctgctgttacagaaaaaaatactcagtcctgtttgttaaagcacaggaccatggcgataggtacagggaccactgcaaccaggtcttgcactgggggagaaagattaggctcagctccaaatacattgtgggcacgtgggaattggtagccaaggggcagtgtgggggtcggtagatggaaaattaccaagaggaaatatccaggtaagggggattctggctaacctcacctaacagtattaggtcaggcttcttttactacttaataaaaatgttttaaatttctttttctttggaacctgttgctggagaattaatgtatttcttagtcatatgtccttgcttttgtcatgtttcttgtgtccttaaattgatgtctgcactcctggtctaacaattgcttcttccatttatttattatccatttttaaattgttttatttatttttcgctttctcttccacagacagtgacttgtgctccttccagttttttaaatttgcattcacaggggaggatttttcctgaagataggtctatagtggtgtttgggttgggcactgtgttttttaatttgttgtttcttggttggttgggtgggggtggggggggtgggtttcttttttttggagacagggtctcactctgttgcccaggctggagtccagtggtacaatcttggctcactgcaacctgtgcctcccaggttcaagagattcttccacctcagcctctcaagtatctgggactacaggtgtgtgccaccacgcctggctaatttttgtatttttagtgaagacagggtttcaccatgttggccaggctggtcttgaactcctgacctcaagtgatccaccgccttggcctcccaaagtgctgggattacaggcgtgagccaccgcatccggccttggttgggtactttggttttggttctgggtgcgcacggtagtgtagtctccatatgattttttttctttttcttttttggctgtatcggcatccgtggtgtctataatttcctcagtggctctgggtggtgtggttgttagcagaagctgcagtgaaattttgctggggacagggaccccgggcgcaccagtccttgggccccacggtggcggtggtgggctaaatgtgcctgtccttggcctcaaggctgtgtacactggcatccacgttagcaagtctaggcatgtcagttcttgggcatccagttggcttgcttgggtgctggtggtaggtggcatcagtgtgctgggtgggagggtccttgggcgtctgggcaatgggcgtggcataggcaatggcagtagcaatggcaggaggatcccctggctcccaagtggccagtgttggtgttggctgcacccggctgggcagtccggtccttaggcctgcagttggcacatgcaatggatgctagatgtgctggtagcggcaggtcgggcaggcccatcctcaggcttgcagaggaactgctcagctgcccacagtggtggatggacggggtagggcaatccccaggcctttgcatggcttgcctggtcactggggctggtggaactgggccaggtgtcctgaagagtgtgtgctttggtcctaggtggtggctgcaggtgggttaacctgtcctagggtacttgtatgtgcatggtggccttgctgctggggccacagggtcactgctagtggcttgtgcttcagccctggcagcagcaggagccagcagtggctgtggtggaggatatcaatggggctccaggaatgtggacattcaagggctatttggggcccagggcaggatgctgcctggtggaagctgggccctcaaaatggtgctgtgctgtagctgcttaggactcgagcagtatgtggggcccagcacaagctccctccctggagcagtgccacagcgtggtccccgggcagcactctgttagtctaaggaccacaaggggctctcctgtggctcggatcacaggagtccatgtgggaatgtggacggctgggcatctctcacttactctctccacacagtggggagcctcttcagggtcccagccaaagaggctgccttgcttccctctcctttcttgccttaggcgtctcctgtcacttccatgttgaattccactgttctctgttagatgatctgttccagttgtgattccgtcctgctgtttccagttgcgattccgtcctgctgtttcgattcttctttgtggaggaagcaagttccagatgcatcttctcagtcaccttgaggcccctcttacctaactggattcttgctgaagacaggccagggtgatcagacagcacccgagggtggtgaaggatgaggaacatgaagattctgagtaccgaggttctggcgaaaccggctaggcagggttcttttgctaaaactggattttgaggaacaacacggatggacctaggagattcagaggcgtgaatctcctctgaatttggccaagtaaagaatctcctctgagtttggccaagtaaagaatctttgtcactagttacgtacactgtgacttacttctggaaacctagaggtatatgtagtgatactgtatttcattaattctgagatatctgatttataatacacaggctgacagtttaattggtagtgttttttcttagtggtacgtaacataatggtgtggactgtttattgagtgggtcttacagttgatcgaactatggtaataattatgatcttgctaccatttactaagcttcctatatgccctgagtcattccaaggcccacatgtattttctcatttaatcctcacaatccctccattttatagctttctggtaaattctggtaatttatttctgggctcttcctaataaaatctcattagccgatggtttagaaatgcaggcacatttaacacattttaccccacataaagcaactgaatccctgatgttttaaaatacggtgacatggggtagcagaaggcattcacaaaacaggaaacaattgggttcgttttggggggatatggaggaggaccggggtaggaaggaagcttacttttctattctgtctctggttgtgccgtgtatgaattcctgcaaatactgtgacattcacatgacagagtgccaaggcttcattttctgtttcttcctttagctacttgctcttttgtagccgatttatctttgcagcctgccttaggagagaatatctctctctctgtggcattaatttgggaatggcggctggctatagttagacaatgggagagtggaaaattcaaaggccatccattttagttgacgcttcccagctggtcttcagtaatccccagcaattcttcctgtggacgatctgacagtacgtggaggccagcccgcctcccagggccacggaagagcagcagactcatttgtttctaaattgatctggcagattcgacgctgccccgcattattgcaacttatgttttgacagagtgacttaacaaagaaatatggccaatagtcaggaaaataatctttggctgaggaaggctaaaatttgtcaaaattagagagaaatggggagttttttacatttttgttttacttgggcggtgaaataatagcaacatgattaaaagggacaatttttcctcttttcttcctagtgcctggcgctgtgcttggtacataatagacccttaatgaatgaacaaatctatccttctgatgggtctagtgtacaacactgtgtttcagacccgacctttagcttaaccccctccccactctgcctgtacgtacttccttcataactgagttttctgcaaaggttattttgaccaaatttccttgatgcgtgagaacatcggaccatgtagcctcagaagcgtctgttgagttctcttacctttctttcatgaagatactgtactcatagcttctttgtgaggggattggagaactggaagaggtgaggtgaagtgctttgaggcgtgagtggcgtgggaacgtcagatgttcctctcatggacaacatatttgggatttagtgtaaagacctgtttgatagaaaacaatgtgttgagtggtgtgatttttaggtggcctccacatgcggtggaggaaggtggtggaggagagctttgaggacaagtaagtttggaacaactctgagaccatctctcctctcctgttcagattctttgtcacttgtattcagctcttcctgtatctcctttctggctcttcagagaaaaaacctaaattgtggtatttcaggcagtactatctttaatattgctgtgctgtttccttttttaaatttaactgcgggggtgcatgtacaggacgttcaggtttgttacatatgtaaacatgtgccatagtggtttgctgcagctatcaccccatcacctaggtattaatctaatcccagcgtgcattagctatttatgctgatgttcttccgcccctcaatccccggacaggccccagtgtatgttgttcccctccctgtgtccatgcgttctcaatgttcagctcccacttataagtgagaacatgtggtgtttgggtttctgttcctgcattagtttgctgaggatattgacttccagttccatctaagtccctgcaaagaacatgatcgtgttcctttttattactgtgtagtattccatggtgtatatgtaccatgatttttttatccagtctattattgatggacatttaattccttgtctttgctattgtgaatagtgctgcaaagaaaatagacatgcatgtatctttgtagtagaataacttatatttctttgggtatataaccagtaatgagattgctgggtcaaatggtatttctgcttctaggcctttgaggaattgccacactcttgcacaatgattgaacaaatttacattctcatcaaccatgtaaaagcatccctatttctttgcagccttgccagcatctgttgtttcttgactttttaatcaccattctgagtgggtgagattctcattgtggctttgatttgcatttctctgatcagtgatgttgagctttttttcatgtttgttggcagcataaatgtcttcttttgagaagtgtctgttcatgtcctttgcccatttttttaatggggctgtttgttttcttcttgtaaatttgtttaagttccttgtagactctggacattagaccattgttagatggatagattgcaaacattttcttccattctgtaggctgtttgctctgatgacagtttcttttgctgtgcgaaagctctttaattagatcccatgtgtccatttttgcttttgttgcaattgcttttgatgttttcttcatgaaatctttgcctatgcctatgtcctgaatggtattgccgagatttttttctggagttttttatagttttatgttttatatttatgtctttaatccatcttgagttaatttttgtataatgtgtaaggaaggggtccagtttcagttttctgcatatggctagccagttcccccagtaccattttttaaataaggaatcctttctccattgcttttgtcaggtttatcgaagatcagatggtggtagatgtgcagtcttatttctgagttctctattctgttccattagtctatatgtctgtttttgtaccagtaccatgctgttttagttacagtagccttgtagtgtagttttaagtttggtagcatgatgcctccggctttgttctttttgcttaggattgtcttggctctacaggctctcttttggttccatatggattttaaaatagttttttctaattctgtgaataatgtcaatggtagtttaatgggaatagcattgaatctataaattactttgggcagtatggctattttcataataaagatttctcctatctatgagcatggaatatttttccatttatttgtgtcctctgattttcttgagcggaggtttatcgttctccttgaagagattctttattttccttgttagctgtattcctaggtattttattctctttgtagcaattatgaataggagtttattcatcatttggctctctgcatgtctgttggtgtataggaatgcttgtgatttttgcacattgattttttttttaatcccgagagtttgctgaagttgctcatcagcttaagaagcttttaggcttagacgatggagttttctagatataggatcatgttatctgcaaacaaagacaatttgacttcctctcttcctatttgagtaccctttatttctctctcttgcctgattgccctggtcagaacttccaatactgtgttgaataggagtggtgagagagggcatccttgtcttgtgccagttttcaagaggaatgcttccagcttttgcccattcagtatgacattggctgggtgggtttgtcatatatggctcttaatatttttgagttatgttccttcaatacctagtttattgagggtttttacaatgagggggtgttgaattttctcaaaggcgttgtctgcatctattgagataatcatgtggtttttgtcactggttctatttatgtgatgaattacatttatttaccgatttgcaaatattgaaccagctttgcatccctgggatggagcctacttgatcatggtgggtaagttttttgatgtgctgctggatttggtttgccagtattttattgaggattttcacactgatgttcatcaggagtattggcctgaagttttctttttttgttgtacctctgccaggttttggtgtcaggatgacgctggcctcataaaataagttagcgaggagtccctctttttcaattgtttggaatagtttcagaataaatggtaccacttcgtctttgtacctcttgtagaattcagctgtcaatatgtctggtcctaggctgcttttggttggtaggctattactgcctcaattttggaacttgttactgatctattcagattctacttcttcctgctttagtcttgggaggatgtatgtgtccaggaatttatccatttattctagattttctagtttatttgcatagaggtgtttatagtactctctgatggttggttgtatatctgtgggatcagtggtgatatcccctttatcatttttcattgtgtctgtttgattcctctccctttttaagtctagctagtggcctattttatttaaaaaaaaaaaaaaaaaaaactcagcccctgtattctttgattttttttttttttttggaaagtgtgtgtgtgtctgtcctcagttcctctctgatcttggttatttgttgtcttctgctagctttggggtttgtttgctcgtggttctctagttcttttagttgtgtgatgttaggatgtcgatttgaggtctttctagctttttgatgtgggcttttagtaccataaattcccctcttaacactgctttagctctatcccagaggttctggtacatagtttcttcgttctcattggtttcaaagaacttcttcatttctgcctcaatttcattatttacccaggagtcattcaggagcacattgttcaatttccatgtagttgtgtggttttgagtgagtttcttaatcttgagttctaatttgattgtgctgtggtctgagagacggttatgactttagttattttgcatttgctgattagtgttttacttccaattagtaaaacaattagaagggatcaattttagagtgagtgccatgtggcacagagaagaatgtgtattctgttttggggggttagagatttttataggtatgtcagatccacttatccagagctgagttcagatcctgaatagctttattaatattctgtcttgatgatctgtctaatgttggcagtggggtgttaaagtctcccattattgtgtgggagtctaagtctctttgtaggtctctaagaacttgttttatgaatctgggtgctcctgtattgggtgcatatatagttaggatagttagctcttcttgttgaattgaaccctttaccattatgtaatgcccttctttgtcttttttgatctttgctggtttaaagtctgttttgttaaaaactaggattgcaatgcctgctttttttctgctttccatttgcttggtaaattttcctgtatccctttattttgagcctgcgtgtgtctttgcacgtgagatgggtgtcttaaacacagcacactgatgggtctcagctgttcatccagcttgccattctgtgtcttttaattggggcatttagcccatttacatttaaggttaatattgttatgtgtgaatttgatcctgtcatcatgatgctagctggttattttgcagacttgttgatatagctgcttcatagtgtcatcggtctgtgtacttcagtgtgtttctgtagtggctggtaacagtttttcctttccttatttagtgcttcctttaggagctcttgcaaggtaggcctggtggtgacacatttcctcaccattagcttgtgtgaaaaggattttatttctccttcacttataaagcctagtatggccagttatgaaattctgggttggaaattattttctttaagaatattgaggcagggtgcagtggcttatacctgtaatcccagcactttgggaggctgaggcaggcagatcacttgaggtcaggagttggagaccagcctggccaacatgttgaaaacctgtctctactaaaaatacaaaaaaattagcttggcatggtggcatgcacctgtaatctcagctactcgggaggctgaggcaggagaatcacttgtacctgggaggcagaggttgtagtgagccgagattgttccattgctctccagcctgggtgacagagtgagactctgtctcaaaacaaacaaacgaaaaaaatgttgaatattgatccctaatctcttccaccttgtagggtttccactgagagatctgctgttagtctgatgggcttccctttgtacgtgacctggcctttctctctggccgcccttaacattttttctttcatttcaaccatggagaatctgatgattatgagtcttggggttgatcttctcatggagtatcttactggggttccctggattttttgagtttgaatgttggtctgtcttgctaggttgggcaagttctcctggatgataccttgagttatgttttccaactcggttttgttctccccagctctttcaggtaccccaatcattcgtagatttggtctttttatataaaccaatagttcttggaggttttgttcattccttttcattcttttttctctaatcttgtctacctgtcttatttcagcaagacagtcttcaagctcagaattctttcttccacttggtctgttcagctgttgttacatgtggctgcattgtgaagttctcatgttgtgtttttcagctccatcaggtcatttatgttcctctctcaactggttattctgcttaatagctcctgtaatgttttatcatggttcttagcttctttgcattgggttagaacaaactactttaactcagtgaagttcgttattacccaccttctgaagcctacttttgtcatttcatccagctcagactctgcctagttctgtgcccttgctggagagatgttgcagtcatttgaaggagaagaggcactatggctttttgagttttcagcatttttgcattgattctttctcatctttgtgggcttatctacctttgacctttgaggctgttgacctttaggtggggtttttgtggagtcttttttgttgatgatgatgtcggtggtagtggtgctttctgtttttttttgttttgttttgttttgtttttttaacagtcaagaccctcttccatagggctgctgtggtttgctgagtccattccagaccgtattcacctgggtgcttcctgcacctggaggtatcaccagtggaggctgcagaatagcacagatggctgcctgccccttcctctgggagcttcctcccagagaggcactgacctgatgccagctagaatgctcctgtcagaggtatctagtgaccccagttgggaggtctcacccagtcaggaggcacaggatgagggatatgcttaaagaagcagtgtggctgccccttggcagagcaggtgcactgcgctggggggagttccccttgtccagactgcatggactcttcagagctagcaggcaggaaagactaagtctgctgaacatagagaccatagctgcccctccccccagtgctgtgtcccggggagatcagagttctgtccgtaaacccctggctggagttgctgaaattccctgaggggaaggtgaggagggatggatctgtgacccacctaaagaaacagtctggccatgatttgccatagccgctatgctgcactgtggagaattcctcccagtccaaaccacccagtctccccggcaccgactggagccacagtgattgcagctgtccctctctcttcttctttttcaatgacatgaaggcctcccacaggaaaagactttcgaaccgttcttaagggaccagtggtatttcagtagctagaggaaggaggggagaacattctaagcagtgggactgttccacctggcagagacatgaaggtgtgaagacaggaaaactgagaggaaaacatgagaaggcagacactagagaagagactagaaaagttgatggggaccagatctggacccaacagtcagcctgtctcctctaggccagggtttggctatttatttatttatttcttcctgagacggagtcttgctctgtcgccaggctggagtggagtggtgcgatcttggctcactgcaacctctgcctcctgggttcaagcgattcccctgcctcagtctcccgagtagcttggactacagacacctgccaccaccatgcctagctaattttttgtattttagtagagatggggtttcaccatattggccaggctggtctcgatctcctgacctcgtgatccacccgccttggcctcccaaagtgttgggattacaggtgtgaaccatggtgcctggcctgtctatctttttaaaccgatacttctataatgctttcttagtcaagagggtcctgctaactagctaagaagagtttgtcaaactgtattttcagcaatgtccattacaaaagaaaatatgtttaatctacttttctaaattatctattttcttcacattcttttttttttaaatttttttattttttaattttttttattgagatggagtctcgctctgtcgccgaggctggagtgcagtggtgtgatcttggctcactgtaacctccacttcctaggttcaggtgattctgcctcaccctcccgagtagctgggaatatagcctcaggccaccacgcccggctaatttttgtatttttagtagagacagggtttcaccatgttggccagggtggtcttgaactcctcttttcttcacattctgatgaactcttgagtcaggaaaggggaaccttccttgcaaattgctgcagcaactcactgaagcggtgtaggggcagtatgctggtgttttagctacttaccaactcaggaatctggtcaggaaagaggctgggaatggcactatttatgtattcatgatggtgactagttaaaaatggtaccagaagagaagacaaaagatcaaatgatatccttgcattgaaatcccaccagtctgatttgtgtatctggccatctataaaagtgtctggaagaagaaggggaagaattatgagctacttctgtacaaaggaacagtgtaggagttggaatgaagccatgataaatttcctcttttatttctttctatatttccaaaaataaaggagcatacctggagagatcaaaagaggggctgtctgacctcagagactcatttcttgatgcctcttgactgcataattaaagttgtgactctctctcgtctgatctgtgtttgttcttccctggctcctgcccactaggttatcgggctgtatccagggatcaggcatgcttgggcaaccaaagaaggagtggccccccaaggtgctccccatctagcctgtcattggctgccagaaacagccacgcactagtccccaaaataccttcatgcgggcccgcacagcttgtacacgagtcatgcacacttcagctactgtcatgtgaaatacctgcttctgggtttcactccctgagatgtcaggcatcatcggtatggcaaacccttgcctgccaaaagttcacccggagagaatattcaccttaatttctacatagtgaaaggaacctcagcacgcactgtatctttcatttggggattactttaagcagttgattagtgtgcagtcttacctttcacgtgtaacgtttttctgtagtttccttttctccattaatttgacggaaaaacagataacttgagccacacgctgccatatctaattcaacttcagtcaggtgctatgcagcacctagcatacttgatttaggaatttagtactgggagtaagattacagtgaggcgtcctggtactgctgggggtggatttccacaccacttacttagagaataatgaaactagagtatcatagaagagaatgtttttgaagatttaagctgaacaaaagaatctttaagtgcgatacatgggagaaagttcagttcattgtgataaaccttttgggtaggagcacatctaaatgaaattggtagatgtgaccgtggagctatggaaacctataatgatgtcttgtaataaattattgaagaatttctgagcctcaggatatgggaagaaaatgaaacaatgaaaatgatgtgtcagagctttataccttctctacgtatttgacagacatctgtggtaagtgcttgtttcatcagatggctttaaggaggtgaaatgccaggtaagagcctcagggaaggaacagtggacaaatatgtgactattttgctattagcaaggatagttgtttataagttctgttgtgagtaaagcttttagaaaatgaaaatctgtggattttagaaagcatgttatctaaaggggcttcatttgctaacatttggcagtttgactgtgggagagagataaaatagaaagcacaattttatgattgccattccttatgatattggccttgatattgattttagccttgacaagtgattgttgaggattttgtgtgtctagtgtgcactgcagacttatttgtggccagagcttgaaatgggacagacaccactgcagttgtgaaaacagttggatgtatctcagtctagaaagacaaattcccaaatatattgtcatgtgtggtgggataaagagttttcttaaataatattattattttattttttacttgacttgtattacaaagtgaatttgtaaaatctttaataatcatagcatataaagacaaatttttagttttctcctttatcacgtgatatcgcatggtttaacctgctgtaaattagttttgtaaaaacattattaccacaacatttttttttgtggcggggacagtcattggagtgcagtggcgcgatcatggctcactgcagcctcagcctcctgagtagctggacctacaggtaggtgcatggcatcatgcccagctaatttttgtattttttatagtggcgaggttttgccatgttgcccaagctggtctcaaacttctgggctcaatcgatccacttgccttggcctcccaaagtactgggattacaggagtgagccgctgcgcctggccttaatcaacacaaatttttaaatgaaatattattgctttgggccttaggttgcatattgctttcatgacctgatgcttcacattcttataattaactctttaagaaaccagctggattatgtttcatgacttctatgttctttttctcgattataagacaagaaaggttttaggtagcaaagtgcaagcacattccaaatcacacactggggactttcgtggtcttcacgccatctgcaaaaaaaaaaataagattacgtattcagtgtatgttctcctcctaacattttttcaaatattagagatgtcttgagatgctctataagaatttcaacctggtaagtcatgatataaagcatcttgagacaaatttatagaattatcattttatgtattttcccttgtttttcaacatccttgctttctgtcttattaaattatttaaaattttaattaacgaataacaattgtatatatttagagtacaatgtgaatttttggtaaatgtatacaaggtggaatgattaaatcaagctaatttagcatatcccttacctcatgtcattttttacggtgaggcatttgaaattttttcttggaaactttgaaatatatatacaatttattattaactgtagtcatcatgctgtggtgatctcaagaacttattcctcctgtgaagaaggtgaaactttgcaccctttgaccaacatctccccatttctctccccagcccatgcctctggtaaccaccattatactctattactatgagtttgactttttaatattccacatataagtgagatcatggattatttgtctttttgtacctggcttagttcacttaacatactgtcctccaggttcatccatattcttgcaaatgacagaatttccttctttttaagggctgaatattactccatttgtgtatctatactacattttcttgatccatttgttgatggacacttaggtcaattccatatcgtagctaatgtgaaaaatgctgcagtgcacgtgagagtgggagcacggatatctcttattttagttagttgagtacagaaatgggattgcttgattatatggcagttctattttgaggttttcgagtaacttctgtacagtttttcataatggctggactaatgtagactccaccagtgtgcaggaattcccttgtctccacatcctcaccaaggtttatctttcatctttttgatgaaacaggcatgaggtgatacctcattgtgattttattttgtattttcctaatgattgagcatttggtgatattgagcattttctcatgaatcttttgaccatttatatgtcttcttttgagaaatgtctactcaaatcctttgcccattttaaaattgggttgtttgttttcttgatattgtgttgcttgagtttcttatatattttaggtattaacctcttatccgttgtatggtttataaatactttctcccactctgtgggttgtctctttcttgaccatttcctgtgctatgcagaagctttttagtttgatgcaaccccatttgtctacattgtgctttggagtcatatctcctacttgcttctgtctttaatcaggggtccattaggtttgcaaatgaaataacgtgactaagaaacaatggaaaactataatgtcaaactgtcgcaagactagcagtgtagtgaagatgcagcttagtgactaagtcgtgagcatgggcctttgtccccgcaaccttacagcatgctccctggtaaaacttgagaccctccagcaacttcctggcaaagggaaatgtagttggtcattgtttctattatggattttttttttaattgaaattgaaacagatgccgaaatcacctgtactctcgtaaaccttccggtaacactttgtggattctgggatttgcgaatcatcatttaagaagtatagcctctcctctcctgagctgacctccgtcgccagcctggtcccctcccgctgttctggtttggagatttcaaaccctttaactatgtgaccaaaagaggcaatgggacaggcaaggactgaattgggtcctgaaggatggataaatatttgccatacagataaggagggattgggagatacaatttttaatctcttaaggtttatgagaagattctggaaaaaaatctgtacttaataacctgtcatattctgtgggtagagaaaaatataccctgattaaaattcttattgtgcttttaaagttagagaaatattagttctaggagtcggggtgccggggggcagaggcagttatgtagtgtaaaagcttctgcttctggttttcgtacctgccaactcttcctccttccagtttttctgtccagggtttaataaaactaagtacattaaactccgttttgaaaactcatatttagtccctctagttagtaaacttgatgtgcctaaagtcttctgtgccagacactgtactgaacattttagacagaaaagttttaaaggagatgcagatggtcttggaggaaacctctgtatagttgtgttcagaaactgaatccccttctttttaaatgtgttttaaaatttgtatatatattgggaaattgaaagtattatttgaaataggctgtgtagaattcagtaattgggggagggggctgggaagtggctgggttcttgtcttatggtgtagaattactcagctctgattggttgtgagtttgcttatggctgttctgatttttaccgttgcaagataatggcttagtagtgattttctcttgtgttgcaaatatctcagtttaactgctgctacaatacaaagcctttagtcctaagaatttcaggaaaaatatgaaatttgaatacatggtaatacactcattttgtaaggtattcactttgtgtgttggtattgattttgctatttgtgtctaatctaccggggaattgctaacctcaggacacaaatgtcagattctggacctagactctgaaccaaatgacataagaatttggttcacagaacattttaagtttcactgtagttgtttttataaaatacagaggctcaatgacaactcactagatttttgtcatctagaaaaactataatattatatatgaaggctttcaattagtttaaaggaaaaattacagaaagtaaatataactttgcattcaataataaaacaatttaaatatgtgttttagttttaagacatggtaaaaatttctaaagtaatactcaagcttaatttttagaaagaattcattaacccagttgcatttattttttattgaagtagtaccattaatatttttttctaaatgttatctttttgtgaagtaagcattcattaattgttttaacctgtgcaattccctaagaaaactgttttcacaaagacagtactttgaaaaatgtttaaacttttatttctgggctttatttccattcttttaattcttgatataaagagcaattcctttcaaattattgagcacacatggacatattatctacctattcttgcactaaaaaaaagccagagagcttctgcatatccactgttgctatcagttgtgtatgtcaaaaatatttcctgtcaggttgttaattgagatagtgctggatggagccagcattttaaataaaagtgagagtaggcaaaaaactaaaccttctgtttactagcccagaaagactaacacgtaacactcagactaatatagatgaaatccaggagctatggctcactcctgtaatctcagcattttgggaagccgagacgggaggaccacttgaggccaggagttcaaggtcagccagggcaatatagcaagactcctgtctctgcaaaaagttttaaaaaattagtcagaggtggtggtgccagcctgtagtcccagttaccccggaggctctgagggtggattacttgagctccggagttcgaggctgcagtgagccatgatcgcaccactgcactccagcctgggtgacagagtgagaccttgtctctaagaaaaggaaatagatttattagtgtcttctgtttgccaggctttgagccaggtacaggactagagtgatgaatgaaacactgtgtctgccctcccaagtattttacgatccagttgtgtatgatggcaagtaaatgggtaaataatgatccagtatgataaatgctgctaaagagggaagtcatcttaggaaatcaggaagagtttcccagtggaagagacaagcaagctgacatttcctcttgttagcttttccttcttaaacattccatcagaatccatgaaataaaccgatggaaaaaaactgataaagatttttcctattttgaaaaaaccgttaatttgcttcatagtccaggaaaaaaccatgctggtttgattcagaagttaacagatcagatgtgtttgacctggtttttttgttggtggattatttcaactaaagttctcattatactttaaaatatttgttaaaacttgtatcccttcccaaattatacacatttaaaaatgtttaaaatttcaaaaattaaacgtaggactttctgtcttatatttttaccatccaatttatacataagtatatatagacaatgtactgttgctgcttaatgcaaaatagttgtccttaaagcaatttagcatttgtttacaaatatatatgtataattttgctcctgatttgaaactgcaattttatatatttagagggaaaaaagccaaatcatgctagagtgcactagatttcatgtaagagctgtttggagcagtggaagagtctcagaggactcagtgtgttttcatacttcgtgttctttcatgtaaacctgatttgagaaattcgtcatcactttttcctttacagaaactttataacaagtcagcatccatttgtagtctctggttcatctcaaatgtttagcctcttctcctttttttgttttttgatggcctttgtcatgtttcatcctaaatttatatctctaggcgcaactcctcttgtgaactccaattgttcattcttagtcttggcttggatttcaaatttaacttaaccaaaacagaactgttggacttgctctcaactccctgtaaccaaatttgttcctgttaaattcttcctcatcttaataaatggtagctatgatcttccacttgcttcggccaaaaactcgagcattatcctgactcctttcattccccacaagccgtcccgcagtaagtaaggcctgttggctgtgctacccagttctcctgctaccgacatccgagtcaccattgtctatcacctgggctatagcagtgacttcctaaccattttctccacttccattcacctttttatagcccattctctacacaacagccagaatgatccttttaaagcagaagtcagactccttcatgccttggctcaaaatccagtggctttctatcttcttcagagcaaaacccaaatatggcagtagggccgtaagtgatcccactccgtctttgagctcgtgttttgccccctactttcttgctccgctttggtcacactagcctctttgctgttcctctgttaccacgggcattcctagcgtagggccttcgcacttgctctttctcctgatatgagcctttatcgcctataaatacacacgttcatttcagcagtcccttcaggtcattgcttaaatgtcaactcatcctaaagagctttcttgacaactttttttctctgtaaggaccttgtttctctccttggcatttatctacatgtgacagttttctatcattgggttttttaaaaaatctgtgtattcaactagaacttgagctccacggaggcaggaacttttgttttgtttttcttcactgctcttttcctcgcacctgtctgaagcagtgattttagccagaatctagatttcctgattctggtccagtgctctttccatggttctgtgtgacctcatacatcaaccttatttcacaaacgaggtttttaagttccttgagcacagtcgattgtgttttttactgcttctgctccgtccctgcataagacaggactgtgtcatgtacccagtgatggactcctggtaaataccatggcttgactaaatgacctccagtgctccctgtggtcttcaccaacacgcatcagacgacaggctcagtcacgggatacttcgctttctgtaggagtaagagacaagttgctatcactgaacagatacacagtggcatttggaaactgcatgcagtttgaaaaaatcgtgatacagcaggagtctagttttcaataaatagcttattcatattctggattttgaacagttcatgtaactgtaactttggggtagtggataatgagactgaaattaatggttcctctgctggtttccgtctgttttttttttttttctcccaggaggttggtatttctgcacttaaccacctgatgtttttagggggagtatatcccagataaattctgttgtaagtcaaagagcatccatgattggcttggctctttcttaagcaactactaagatgctcctacatttgggtttgaacgttttttattctcttggctatgaagtttcttaagtgactctagtaatactgatggttccccttgtgtttacaggtgatctgcaactctttcaccatctgtaatgcggagatgcaggaagttggtgttggcctatatcccaggtatggtgtatggtacttcatgtactggaagacacactttcattcccacccaaatccccagccctttggaggtagttagaaaggcagttgctgcagcttgttcaagagccaagcttaaaacttagcaataaattacaaaaaaatggaaaatgttaagttgaaagaaaacagttttataaccccacattatatgctgtgatattaacaaaggggcagatctcagaactaaactcttgttctcagggggactttgggtgaagaagttgaggacggtgggtgctaattaaccatcgggctgatttttggttattccccagtttcctgagctgcagcacatgctgatttcaccggacttgccgtacgtatcagttgggttcatgttgtctttcgagttggcacactctgagccctttcactcaaggaggcaagaaaactctcaggctttggcccctgaatgctctctccagctattgctgagctgactcttaccactgagctatgaaaccgtctctccacaagcactataggcacacccagtttcattttgtttttatgccataagagtccaaatacaaatttagactttctaataattgtgaatctaagaattcagccttttttcttatttctcacaattgtcattaactgtaggtcaggtctactggtaggtggttctcaaaaggcagtaacataggatgattcaaagcatgggctctgcgttcaggccacctggtccaaattccatcaccacttactagctgtatgtccttgagcaagtcatttaatttctgtgcatcagtctctttacctgtaaatgatcctcataagattgttgtgaggattaaatgtgatgaacatgctcaagtgcaagaaagtgtttctacatagtaagtgctcattctaattattaccaattcctgatagcagcttaaatccattttgtttcccagatggtaagaaatgtccctccaaggtaataaaatgactggaccatggcccaggatgcatcaggatgtaggtggcaaaataacgtcagctctctatttaagagcaaatagtcctaattatttttcagtgtggatgttctagcaaaggcggccatttctccaaaggagctcaacaaatgagatcctatgggagaggtcagtggtatcttggctgctgcatcccattatgtctgagtattttttttttttgagatggagtctcactctgtcacccaggctggagtgcagtggtgcgatctcggctcactgcaacctccgcctcctgggttcaagcgattctcctgcctccacctcctgagtagctaggactacaggcatgtgccaccacacccagctaatttttttgtatttttagtagggacagggtttcaccatgctgatcaggctggtctcaaactgctggcctcaaatgatccacccacctcggcttcctaaagtcctaggattacaggcgtgagccaccacacccagctgtctaagtatttctttctgagtcagtttctttctgaccttcgtgttgggttgccttattgactgttatctaatcagtcaactatgccccaatccccaaaaaggactcaggaaatttttttattattaaatgacggaattccctagttagcctgcatcttgaggagaattgcacttcgtgggaggtgtgctagtgacatttctgtgaatgcatccccgagtactgaacccctggcatcctgtcaaccctacctgctgctgccccccaaaggaaggtgtattttacccactgcatttgttaaatttagttgactctacctgctgagctgtgacagtcttcccccctttttttttccagtatctctttgctcaatcacagctgtgaccccaactgttcgattgtgttcaatgggccccacctcttactgcgagcagtccgagacatcgaggtgggagaggaggtaaggaaactcatgcttcccagcctggccttctttcctatcaaagaccctctcagctcggcccgtccctaaaactgattgtgcctgaggggacaacttttcattgtccttctgccagtgagagtatttgtagttcagtcacctctccccagcaacctatcctttcttctcccaaattacaaatgggctaattttttaggggagaggtcaccatatttctggatgatgacagttcctgtcctgtgtgtgagagagagaggagtttgtgtatgacagagggtgtgtgttttatgcacacacagggaattcatgaaatctcctcagtggcaacagctgagcagcctctcatatccttccgtgggcaggggggggcatcccagcttgtgagtgggatccccaagacttcttcactcggaaggccactggctacattgaaggtaatgatgcatgttaactttgtgctagtaaagcaaacagcttatactgtctcaggctgacattgggacttgacaaacccatcagcatctctgggtgatcatttcagcaaagatgcaaagggaatagaggacagggaggatgacctccagcagtgaactggccttgacccctccagtttgacagactgtccagccagcctcttttggtgcagaaccttcttacaagacagctgcaaacgggctgctccagggctctgaacctaagcttgcactggtttgcacagtgactacccatgctgagttctgagttacagatatttctactttccagaaccccgtttccttctcctttccaatttgctaaagtggatatttattgcaaggaaaacagtactgaaagcttttattgcatttatgcagcactcagccaataaaacctcaactcagaggtaccatattttatgtagacagggatttggctttgacaagattctccccaaactgattttcagtggaaggagccacttcttatacaactactcgctaaatttccagattttaggaccagtgtatgaaatatactgggatagatgtcagtgagatggacaatgtagttttttctcttttttttctggggccgcaaaggacttcaaggcaggtaagagatgaaaccgctatctattttcagcaatattcatttgggggctgaagagcggctgctgctgttgtcgatgatgacgatgtttttgcaaattaaaaaacaaaccaagtaacttgacaaaagcaattagagttggttggaattttcagaaacaacaaagaaagtttcttctattttcctaggctcggctgccagtcattctcccgtggttgcttttcatttagttgaataagacaccttgtctttaggtgctgctttcactttttcacatctttctctttccatctctggagcaacaagcaaatcctccctcttgccaaatacgagacatttccactcagtgtaaagcccttcagactcagatatttttccctgtggtacttagcaaggcatcttctcaacaaaaagaaggttctccccacaagtccttcatatataccagtttaagagaataaacatttctccattccattttgtaggtcttgctgaacagtgtttcccctgattcatcatcgtttctgtccactgtgtctctttgtcttaatgttatatgcccttcgaggctgtttgttatgatttaaacatgtcccccagattccatctgttgaaaactttatccccaaattcttgctgatgctttgtggaggtggagtctttgggaagtaatccagattagataaggttatcagggtgggaaccccatgatgagattggtggctttataagaagaggacactcctgctgccacctcatgtgacgccctctgccatgttatcaggcagcaagaaggccctccccagatgccggtgccatgcttttggcatcatgcttcccagactccagaactgtgagaaatttatttataaattacccagtctgtggtattctgttaaaacagcagaaaatggactaagataccctttcaatcacatctcttgtgtaactctttccctgatttcccatattagaagaagttcttttcctttgagttctcgcttatagtggttattaatacatttttggcacatattatggctgttttggagacctctctatttagagctttatgaggacagacaatcgtgtcttatttctgtatctcttagcacttagctttgcatccaggaggcatttgataactttttgttgaatcgactctctattatattgagcttactctaatgaccggcagtatttcttgtggggacactattgccattttgaatgggacagttcttcatcgtgtgggattgttgcatcattggagaagacttgtgtccttggcgtgtgcttaactaatgcctgtagccatcccccaacaactaaaatatatcctatgcctttcaaactgaccccttggagcagaggtaggggagagggagagccatgagaaaagacagtttgaggcattgattaagcagggtaattcctatttattgtacaaatattagctttaaattaaggaataaatctagacattttgtgttcccaacatacaaaaatggtaaatacatgaggtcgtggataacctaaataccatcacttgatcattacacatcgtatgcaggtagcaaaatagtacctggaccccataaatatgtataaatattatgtattaattttttgaaagttaaaattccttgggaaaaaattttagacattttggtaatttcctatcatgaactttgcatttggctttagtgctcattagggcacccacagttttaatatgagctatttgggatctgagtgtcagaatatgggattcacaatggaagactcaacagcaactgaggcagaagttcctcaatcaacatttgttgagtaaattaatgagacttcttaaagataaaataagagctggaatagggctgggcaccgtggctcatgcctgtaatctcagcactttgggaggctaagggaggtggatcacttgaggtcaggagtttgcatccagcctggccgacatggtgaaaccccgtctctactaaaaatacaaaaaattagccaggtgtggtggcgcacacctgtaatcccagctactgaggaggctgaggcaggagaatcgcttaaacccaggaggcgcaggttgcggtgagccaagatcgcaccattgcactccagcctgggcgacagagtgaaactccatctcagaaaaaaaaaaaaaaaaaaaaaaagctggaatagagtctcagacatttacaaatgactggcagtcctcagtggtgtcccatggctcctgaaaggaagggaatatgaaagccagtctactgccagtttaagatgggagcatttcaaacctcacacaaggagagctggaaaattgcacaaggtctgtgataacagaagttgccatggaaatttctcaccccatgtttctctctatataaatccatcctttggaccctctttggacagtttccttgcaaaccagcaacatttataatactttgctatttaaggctctccattgtaatgctgagttattgggtcttttttttttatttgactttggatttttgtctcctcattcagccgcctcctacagagagagatgtgtaatatcatttaagtcatggctcacttgactggattgctgatggctaccttttcaaaattatcttaaatatgagattcatttgttctgatagttttataaaacatggatcagggaggaaagctgggtaggccaaagcagtcttatggtagttcctggttaaaataacttgtagctgttacaaataatgccattggctgccagcattctctggcgccatatcaactgggagaaatgtgattgacacaagttgaatgcattagtatccctaatgtcagtcttaatctgatgtcttttgggattaagacagtctgtttcttctgttagtcatcttatttgctaaaccattaaacgaattcactgcatgtttactggatgtcaggagttggtagcagttttagaaaccttctctaatacaaagattattaagacccagccctgacttcaagagttcaaggtatagttgaggaaactgacagagaacagaaaacaataatagaattaagatgcacagtggtgtaaatgggcacaggcttacagcagctcagagcaggagcactcgagtgattagtaaggggagggagtggagagtggttaaggaatgcttccagaggactgactcctagactctgaaaggatccatggagttagagttggatgaggctggaaaaggcattgtagacatagacacagaggccagggacagaatggtgagttcaaggagtaggaagcagttctcatcaatagacgacgaaagaatttagatgtgacccgaatttgagggaagatgtagggatcagactgacaaaccccatgggagccttatcacagaccttggtttagctgaaggtttcataacattggctggtctataggaggcgcccagtaaatatttgtgtaagggagaaggacgagcagcgggacatgattgaagggtttcagcaaaggaactgcgtggccagattttcttgttttttttttcctgcatgtttacaaatgttactgttttttattgtatgtactatacataaaacacttgaagaaaacaatttttaaaaccccacccaattctaacccctgagttagatttgggatatcacaaacgaaacattttactcagtgtacattcaattttacctcagtcactgttgctgtagtgtgagtttttctcaactcgttgaaccatatgattgaaacgtgatgtttcctttgcctttcattcactttttgtatatacgaccatggctatgatgatagggaatatttatagggtgattcaatttaggaagcaatagatgaagcctaataggtaaaaacaaaaaacaaaacccaaggactacaaaattgagtaagacctaagtagtctgtaccatctttggaatcttagaaaactcagataatgttacatattcattttttttattttatggaagaaaatgtaaggtttaaactgggaaatgatttgttcagtgctacacttactactacgcagtgtggagggggttagtaataaagcttcattctcaggattgaagtaacaaattatttacctaggacagtgcccagcacatgatgcttactacatagtgattttcttcttccatttgtgattagagtttcctgaagggaaaagtagagctcaaatggtgagtgtccaaaaaaaaaatatgacattagagatttctcataaattgtggaaacatatttagagaatctatcaaaactatagtaaatctcatcttacgtatcaaagcagaataattggtctttggtggaggtggtctggctgatgtttggactcggcaagaaagattgctacaactgttgaataacatttggtttgtgtatagaagtgttggtccatgatgacatctacacagattattttccattcttaaattaacattttctataggcagtctttgttctaatacatgctcctctgaaattgaagctgaaagtgttatgaccagtttcactttaaatgaaggtacctttaagtctgaaatgagccggtgctttcaggtttaggctgttgaatacaaatacatacaagtttgatttttgtttttggcttaagatgataaaattacttttaacggggttttattaaattatattcaataaataactaaattgtgatttcacagttaaattcattataaaagtccctgccccattcttaagaatggataagtgtaaaagaaatgtaatttcatttaccttttgaattaagctaaaagaatatttagtaacctaattgtgatttttaaaaaaataatttcaacttttattttagattcagggggcacatgtgcagctgtgttgcatgggtatattgcatgatagtgagctttggggtgtgatgaatcccatcaccctggtagtgaacatggtacccaacagtttttcaccccttgccctacctccctctctagtagtgccagtgtctgtcattgccatctttatgtccatgagtacccagtgtttagttcccacttataagtgagaacattgggtgtttggttcgatagattctctaaatatttgtttccacaatttatgagaaatctgtaattgctgggtttggttttctgtttctgcattgatttgcttaggagaatggccactagctgcattcatgttgccacaaaggacatgatgtcattcttttttatggctgcatactattccatggtatgtgtatatatatatatatatatatacaccacattttttagctcactgttgatgggcacttaggttgattctatttctttgctattgtgaatagtactgtgatgaacacgtgagtgcatgtgtgtttttggtagaatgacttattttctttgggtatatacccagtaatgggattgttggctcaaatggtagttctgagctcctctccaaactgctttcaacagtgggttaaccaatttacattcccaccaatagtgtataagtgttcccttttctccacagcttcaccaacatttgttatttttggactttttagtaatagccattctgactggtgtaagatggtttctcgttgtggttttgatttgcatttctctgattagtgatgtggagcatttaaaaccatgtttgttggctgctggtatgtcttcttttcaaatgtgtctgctcatgtctttggcccactttttacttgggttatttgcttattgaattgcttaagttccttatagattctgggtattagacctttgtcagatgcatagtttgtgaatattttctcctattctgtaggtcgtttgtttactttgttgatagtttctcttgctgtgcagaaactctttagtttaggtcccacttgtcaatttttgtttttgttgcaattgctgttgaagacttagtcatatgttctttccgaaagctgacgtccagaatggtgtttcttaggttttcttctagggtgcataaagtctgtggtcttacatttaaatttttaatctttgtattaatttttatatatggtacaaggtaggtgtcttctgcatatggctagccagccgtcctagcaccgtttattgaacaggatgtcctttgctcattgcttatttttgtatgaccacttttctatgtgtaggcaaggttgggagaatgagcgtcggggtgatgtaataatccagggaagagataacagtggtagcctgaagtcggggagctcaggtggtggcttgtgatagggtacctgaagactataatattaagaagataaaattagcaggatttgtgaaacaaggacacaacttgtgaaacaagagacacaaagatactcaggtttgactttaaaaagaagtgacatttttcaggcttttttccagttcagagccagtattaacagaaacattcataactgtgatcacggaattctagaaatgaaacaaggtctaattttaacttggtcatcttttttttttttttttttttttttttgagacggagtctcgctctgtcgcccaggctggagtgcagtggcatgatctcgtctcactgcaagctccgcctcccgagttcacgccatcctcctgcctctgcctcccgagtagctgggactacaggcgcccgccaccacgcctggctaattttttgtatttttagtagagacggggtttcaccgtgttagccaggatggtctcaatctcctgacctcgtgatcctaccgccttggcctcccaaagtgctgggattacaggcgtgagccaccgtggccggccttaacttgctcatcttatccactcagttgtagacaatgaaaagatggtttcatggaaaaggagttcattttgtcttgagattttaatgtaagctatgtattcaagatctagaaaatctccttcattatattactctaatgtcagaaatgatttactgcattttctataagagctgcactaaaatggcagagcagtggtcaatggcattaatattttaatgcaattttgttctgtgccattaaggtgtctactgatcaatggccaagtttcacatatacattcccactaaatgagccttacatttactgagcagatattccattacaactagtgagtcaatgagtctttaataaaggtttttatctttggctaataacatgattttagctgtcattaccagttagtaatctggctgttttttcccaaaaatatgaataaaatatttttgccattaagcacttcacaattgataaccagatattctgcagacttcattggcataaaagaagcacaaaaatgggtggctttctctgaggtaatggggcagtcgccataggaagaggtgtatttgagccaagcttggaggatgagaggctctcaggaggctgagtgtggaggagaggctcgcttagccagtgatgcccagacacatgttggcatggtgttcattgtttcagaggtctagcaatgtacataactgtgacaggctggggttcagggagagacatggaggctagaaaggcagacagaaaaacagctgagggaaatccttgtgtgcctttattcaagggcagtgagaaaccatcgcaagtttttatgtagagaaatgacgtgatcacatgtgagttttaggaagatctctctcaaagcagtttagaagatgaaaggtacactgcaggcagcggggaagccagttagaaagccattgcgtagtccaggtaatggttccaggcagttacagtatgccgagggaggctttaggagcccatttattggggttaaatgaaataactagtctcctgttggccattcactgcctgacaagatcactcatgagttttggcccttgtaataaagtcttgggttagtcaagcacatttttttctggcatgacaggccctggagttagtggcttcacactgggcacactgtaatctcccaataactactgtccatttacctgctctgataatgggagttgatgactaagagccattgggctggattcagaattagtgtcctagagttaacccaagaggggacatagggatgcgctcatttgctacctcacctcctgtaaggaaactgggacccacagagcctgatagtataagatgaatctatctactgtcccagacttactcataggctgtttcaaaaagtgagcttggaaataggttatttggaatttggaacatagcattcattagaaacaagaggaacttgcctggtataggtgaccctttgtgcctcagaggcaaccctggcttcagatcatgaagcaagagaaacatggaggaaatcaaaaagtggctgttgtctcagctgaaggatctcagttgccacagaacattctctaacacaggtgtgagtattttaggtttgacggtgctacggacactccttaagggacgccagcttcttctacagccctctctccctgccaagtatgagaagcagccatgtaaaagtaaaaagagcatcagacttatcaagagatctgggtgcagtcttcagtgttacctgaacccaagacctttgccagtttttactgtgctatgctgcctcgccacaaacagtagatactcagtaacgtcattgtctgtatctcttaagggcagatattcttgtttctgtgtgtggagcagcatgttatggttgcctaatgtgaagaatctatggagagccagccagccagatcaggctgtgactcctgtcccgttggtgatggtgacggccatggtggatttgacagatctggctggccagcccagccatccaccatcacccctacagcttgagagagtccttcccaaagctttgttttctgccagagagggtggctgcctttgccctactatgatttcaaacaagtaagatcatgctttgtagacatgagatgctttcttttaagtataacaaaaaccacatggagttttctgctctagggagttttttgcatcccttcagtggataatcctgccttcttgctctgccaaagtcttcacttctccccccaccacacataccgccatgattactttctacttttaaaagcaaagaagtaatttctacagtctggtacaagctgatatatgatacaggaaaagaaaaactagagcaggtaagggaattgggttgttactcttaatagggcattgaggttagacctgaacgagaaagtgggatttgactgaaactcaaaggcgatgagggaggttgtcatagtaaacggggcagaagggcagagggaacagccagtgcacaggccttgaggtaggagtgtgtgtggagccagacgggaggccagcctggtggagcagcagcaatgagggaaactgggaaatgagagggaacaggtgggattatgtgaagccattgcttctctacctatgacgaaggaccagtttttcttttccttcataatctattgcagaccagtatttttataaaatctagtgaaaataaattattagaaaaatgaagggctgggtgcagtggcttacgcctgtaattccatgggaggtcaaggaggaaggattgcttgagcccaggagttcaagaccagcctgggtagcatggcgaaactccatctctacaagaaatacagaaaattagccagtgtggtggtacatgcctgtagccccagctacctgggaagctgaggggtgggaggatcacccaaacctgggaggttgaggctgcagtgagttgtgatcatgccactgcacaccagccttggtggcacagtgagaccctgtctttttttttttttttaaagcccaatgttttattattagagtcacataaaattacccttaccaaattagtaaaaaacatttctaaatattgactttgtttcttgactcatgtcgtcatggactggtaacccacagtgcgcactggcaccaatgcggggaccatactttgaattgcacttggggagttagaaggacctggccttcactcaggcaaagtggggagctgttgtgatgtttcaaacagaacatgtcatctgacatattttatgtgaatcactctggctagagggtggagtgcagggggcctggagaaagaatcagagagaccagttgtgagactattacattttacaggtgagaggtaatgatggctcagaccaggatggtggcactggaaaaggtaaaaagtggttgattctgggtagtttttaaggtggagcccgcagaatttcctggtggattggatggcaagtgtaaaggaaagagtgaagtcaaggatgactctgaggcttcaacttggataagtcaaaagatgagttactgtcaactgagagtgagaatgctctagccgagatggaacaggttgaggggaagatcaagcattctgttttctggattttgaattagactttcataagagatctaatcaagtgcaaaatgctcaagcattatgatgttgcctaaagacccgtgacttaatgggactcagtgttagagagtgtccgaggagtcctttaaatatatcctctcatttataacccttcaccatccgaggcaggggatattactctgaaagggtgtaaggcagtcagtttgaatgcttccatcagtggtggtactctcaagttaaactctcccctatttggaaattattctacccccccttttttttccaaacctagatacaaataagagaactgttttctcatttcaaagataccaaatttggatgaccttaaattccatgaggcagctatagaattggttagaatttaagagcaatctggctgtatcatctgccaccctttcggttgccaggattaatttggcttctctgattgctaatggttatagaatttattagcaaaccttagtaaacatacaacagtttttgatattttcctgtagtgaaaaaaactaagatacaaaagtgggtagagatcataagacccgttctttaaatatatgatacatatatatttaccacatagcaaagactgaaaggaaatagattaaaaatttacgtgtgatcatttgggtagagaaactataagcagtaccttctctcttatatttttggtttataataaaaacaagttttactccaataattagcaataataataaccatttgttaaagaaatgagcacagcagatgtttcagcgcttccctctctctggcctgcacagctcaccatctgctacctggatatgctgatgaccagtgaggagcgccggaagcagctgagggaccagtactgctttgaatgtgactgtttccgttgccaaacccaggacaaggtatgtagtatggaaccagattgaaacacctccacggcaaaatctcaatgatcttcagagaactctgcctagatttcataaacccaaaagtaatgaccctcagtacatggtaggaaacagataaataagataactcattgaactgcatatattttgtttcctggaacttttgtcacccaccaagctgagatttaaccgatttaaccaaaggtaaggatctgtggagtttagagtcaagtgggaatgtaggcattaaatatttaattaaaaggatgggtgaaggccagagtgctagtagaacatatgtagtaagtgggttgaattacgttatgattgacaagttattgctcggtaaacaacataccaagttttacctagtttatttctttaaaaatgttttttaaaataaaatcaggtttgttgaggtacaatttacatgcaaaaaatttaccctacttagtgagacagttctatgatttcaacaaacccagtcatgaaactgccatcaaaatcaagatacagaatggtttcgtttcccaaaaaagtgccctcatgtccctttatagtcaaccctaccacccctaccccaacccctgataaccgctgatctgttttttatccttatagttttttccttttgtttttagttgacacataataattgcacatattttgggatacagagtgatacttaattatgtgtatactatgtgtagtatcaaatcagggtaattagcatatctgtcacctcatatatttatcatttctttatgtcatgaatattcaaaatcctcttttagcgttttgagaatatacaataaaataaagtgaaccatatccccctacagtgctgcagatgagcagattcgttcctcctaagtttgtgttcattaaccaacctctccccaccttcttagcctctagtacccacagttctgctctctacttccatgaaatccattttttttaattcccacatatgagtgagaacacggagtattttatctttctgcacctgactgactttgcttaacatagtgtcctctaggcccatccatgttgccatgaatgacagaatatcattttcatgactgaataatattccattgtgtatgtatgccacattttctttatccatttttccattgatggacatagaggttgatttcatcttagtttttctgaatagtgctgctgtaataaacatggggctgcaggtatcccttggatatactgattttctatcctttggataaatacccagtactgtaattgctagattgtatggtagttctatttttagttttttgagaacccctcatgctgttttccataatggctatactattaggtgggtgcaaaagttattgcagtttttgccattaaaagtaatggcagtggcctcattgtagaggcctttcacctccttggttaaatttattcctaggtgtctttttttgggagtgggtagctattaattttaatggcaaaaaccacaattacttttgcaccagcctagtatgagagtatgttttccccacatccttgccagcatttgttatttttattttttttggtctttttgataatagtcattctcattggggtgagatgacacctcattttggttttgatttgcattttcctgatggttgctgataagcatttttattggccttttctatatgtgttagataaatatctatttagatcctttgccctcttttgaattggaatatttgtgatatttttgctgttgagttgtttgagttccttgtatattctggatattagttcctttttgaatgcataatttgcaaatattttctgccattttatagttgtctcttcactctgttgagtgtttcctttgctctgcagaagcattttggtttaatacagtctcatttatctatttttgtttttgttgcttgtgcttttgtggtcttagccataaaatctttgcctagaccaatgttctgaagtgtttcccctatgttttctttttttttttttaaattatagtttaagttctagggcacatgtgcacaacgtgcaggtttgttacatatgtatacatgtgccatgttggtgtgctgcacccattaacttgtcatttacattaggtatatctcctaatgctatccctcccccctccccccacaccacaacaggccccggtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctgttgtgaatagtgccacaataaacatacgtgtgcatgtgtctttatagcagcatgacttataatcctttgggtatatacccagtaatgggatggctgggtcaaatggtatttctagttctagatccctgaggaatcgccacactgttttccacaatggttgaactagtttacagtcccaccaactgttttcttttagtattatagtttccaggctcacagtagttaattaattttggttgatttttctgtgtggtgacagataagggtttagtttcattcttctgcacgtggatatccacttttctgatgacaaataattgaagaggtgtcctttccccactgtgtgttcttggtgcctttgttgacaatcagttgcctataaataatgtgtatttaattgtgcgttttctgttctgttccattggtctatatgtctgtttttataccaattccatgttttttttgttagtataactttgtgggatattttgaagttaggtagtgtgatacctccagctttgttctttttgctcggtattgccttggctatttggggtcttttgtgttttcatgttaattttaggatcattagttctatttcttgaagaatatcgttggtattttaatagggattgcattgaatctgtagattgctttggatagtatcatcatttaacaatattaattcttccaattaatgagcatggtatgcctttccatttgtgttctcttcagtttcttttatcaatgttttatagttcttattgcagaggcctttcacctccttggttaaatttactcctaggtgtctttttttggggggtgggtagctagtgtaaatgggattactttcttgatttctgtttcaggtagttcattattggtgtatagaaacactgctgattcttgcatgttgattttgtatcttgcagctttactgaatttatcagttctaagggtattttggtggagtcttttagtttctccgtatataaggtcatgttgtctgcaaagggaggacaatgtgatttcttccaagttaaatgctctttattgctttttaaacatttttattgatatatgatagttgtacatatttgtgtggtatatgtggtattttgataccagcatacaatgtgtaatgatcagatctgggtaactgggagatccatctcctcaaaaatttatttatgttgggaacattctaaattttctcttctagctattttgaaatatacagtaaactattaactatagttgccctattgtgcagctgaacactagatcttactcctcctattgagctgtaatcttgtatgcattaaccaacccctcttaatccctctacctactactctttccagcctcaaaaccactattgtattcactatctctataaaatcaccttctttttagttcccatgtatgagtgagaacatgagatatgtctttctgtgcctggcatatttcacatcatgtgatgtctttaagttccatccatgttgctacaaatgacaggattttattacttttcatagaggaactatattccgttgtgtgtgtgtgtatatgtgtgtgtatatatatatatatggcatttttttttttacttattgatggacatttaggtcgacccctgccttggctattttgaatagtgcagcaataaacatgggagtgcagatctctctttgatattctgatttcctttcttttggatctatatccaacgtttggattgtttggttatatggtagttgcgtttgtagtttcttgaggaacctccttactgttgtccatagtggttgtactaatttacattccaccaacaatgtgtgagccttcccctttctccacatccttgccagcatttgttattttcttacttttttatagtagccattttaactggggagatgatagctcattgtggttttaatttgcatttccctgaccattaatgttattgaacatttttttatatatctgttggccatttctatgaattcagcatattttgcctgttcttaattgggttgttttttgctattgagtttgagttcctatatattgtgattattaatctcttgtccaatgaatactttgcaaatttttttttcaattctataggttgtttcttcattgattattttctttgctgtgcagaagctttctagcttgatttgatctcatgtttctatatttgctttggttgcctgtgcttttgaggtcttgctcaataagtagttgcccagctcaatgtctgaagtgtttacccaatgttttcttatagtagtttcatggttttaggtcttatattcaaatatttaagctgttttgatatgacttttgtatatggggagagataggggtctagttttattcttttgcatatgggctatctagattttcctttctcaatgtattttcttgatgactttcttgaaactccattgactaaatgtgtggatttgtttctacgttctttcatgtgttccattggtccatatgtccatttttatgctagtaccatgcttactttgctttttgtaattttatagagcattttcaagtcaggtaacgtgatgcctccagctttgttcgttttgtccaggattgcttttgttgttccatatgaatttccggattgcctttttcttttcatgtgcagagtgtcattgatattttgatatggattacattgaaaatgtagattgctttggatagaacggtcattttagcagtattcttccaatccacatgggctatctttccaatttattatgttctcttcaatttcttttatcaatgctttatacttttattgtagagatctcacttttattaagtttagtcctaggtgtttatgctattttattgtagctgttgcaaatgggattgctttctttatttgttttcagatgtttgctgttggcatatagaaatgctactgatttttgtatgttgattttgtatcctgcgacttaactgaatttatcagtttaacagtttttgttggagtctcttggttctagatgtaagatcatgttgtctgtgaacaaggctaacttgaattcttcctttctaatttgaatgccctttaattttttctcctgtctaattgctctggctaggaattccagtactgtgttgagtaaaagtggtgaaagtggacatctttgtcttgttccacgtggtaaaggaggggctttcagtttttcccaattaagtgtgatgctagcttggggtttgtcatatatggcccttattttctgaagtatgtttccctcatacccagtttgttaagatttttttcatcatgaaggcatattgaattttattgaaagtttttttcaacatctattgaaatgatcatatggttttgtcattgattctgttaatgtgatgtatcacctttattgatttacatatgttcaaccatccttccatccctgagatgaacccacttgattatgatgaatgatctttttaatgttgaatttggtttgccagtattttgttgaaaaaaaagtgtgtctatgctaatcagtgatattggcctttagttttttgttgttgtgcctttgtctagttttagcatcagggtaatgctggttttacataatgctggttttatatatatactttggaagtatttcctcctcctaatttttctggaatagtgggagtagaattggtattcattcttttttaaatgtttggtagaattcagcagtgaagccatcaggtcctaggcttttctttgatgggaggctttattactgtttctatctcattacttgctattgttctgttcacgttttctgttttcttcacggtttaaccttggtagtttgtgtgtgactgggaatttatccatttcttctaggttttccaatttattggcatacagttgttgctaacagtctctaatcatgctttgaatttctggggaatctggtataatgtcccctttttcctcactgattttacttatttgagtctttttctttcttagtctagcaagtcgtttattaattttgtttatcttttcaaaaaactttttgtttcattgatcttttgtattgtattgttctttaatctctgttttgtttagatctgtttggatctttatttcttaccttctactaattttgatgttggtttattcttgtttttctagttccttgagatacattgttagactttttaacttgaaatcttcctacctcttttatagaggtgtttattgctataaacttccatcttaacactacttttgctgtaacccatacattttgatatgttgtatgtccattttcatttgtttgaataaagtttttgatctttttctcaattgcttcactgacccaagaagcatgtttaattttcatgtatttgtacagccaaagtttcttttactgatttctagttttatttcattgcagtctgaaaaggtacctgatatgatctcagtttctaaaaatgtgttaagccttgtttagaggactaatgtatcatttatcttggagaatgttccatttactgatgagatgaaagtatattctacaggtgttggatgtatgttctgtaaacatctgctggattcctctgtggtacagattaagtgtgatatttttctgtagattttctgtctagatgatctgtccactgctgaagtccccaactattagtgtattggggtctctctgtctatttagccctaataatatttgtcttgtatatctgggtgctccagtttgggcgcatatatgtttacaatggttatatcctatcgctgaattgatgtttttatcatttttaatgaccttttgtgtctctctttgttttttgacttaatgtctattttgtgtgatacactacagctactcctgctcagctttggcttctgtttgcgtggagtattgtttgtcatcccttcactttttttttttgagatggagtctcactctatcaccacgttggagtgcagtggcgcgatctcagctcactgcaacctccaactccctgggtcaagggattctccggcctcagcttcctgagtagctgggattacaggcacgagccaccacgcccagctgatttttatatttttagtagagacagggtttcatcatattggccaggatggtctcgatctcctgacctcgtgatctgcccacctcggcctcccaaagtgctgggattacaggcgtgagccaccatgcctggccatcccttcacttttaatctggctttacaattgaagtgattttttttgtaggcagcacatagttagattctttttgttgttgttattcctacctatccagccaatcttttaattgggggaatttaaaccatttacagttatggttatttatatgagaggacttagtcctgacattttaaaaattgttttctgattgttttgtaaatcctttgttctcctcttcctcttgtattgtttgcctttacagtttggtggttttctgtagtgataacatttgattcccttctttttcccatttgcgtatctgttctatcagtgagttctctactttggtgtgttttcatgatggcaaatattgtccttttgctgctggatataggactctcctaagaattttttttagagctagtctagtggtgatgaattcctttggttttggctgttatttcgttaaataggttttctctgactttaaattattttattttttaaaaaatttgtgggtacatagtaggggcatatatttatggagtacatgagatgttttgatacaaggatgcaatgtgaaagaagcatgttaaggaaaatatggtatccatcccctcaagcatttatcctttgagttacaaacgatccgattacattttttaagttatcttaaaacatacaactaggtaatcattgactatagtcaccctattgtgctatcaaatagtaggtcttacccattctttctatttctgttgtccccattaaccatcctcacgtcccctgtaaaccacgtacgatttgcagcctctgggaagcctccttctactctctctgtccatgagttcaattggtttgatttttggataccacaaataagtaagaacatgtgattttttagtaataaataagtaaataaataagaacgtgtgatttttcttagataccacaaataagtaagaacatatgtttgtctttctgagactggtatttcacttaatggaataaccttcatttccatccatgttgttacaaatgactggatctcatttttttctggctgaatagtactccattgtgtatatgtaccacattttctttatgcattcatctgctgatggacgtttagtttgcttccaaatcttagctattgtgaacagtgctgcaacaaacataggagtgcagatacctcttcgataagctgatttcctttgttttgggtatatacccagcagtaggattgctggatcctatggtagttatatttttagtttcttgaggaacctccaaacagttctccatagtggttgtattaatttacattcccatcaacagtgtacaagggttcccttttctccacatcctcaccagcatttgttactgcttgtctttattataagccattttaactggggtgagatgatacctcattgtggttttgatttgcatttctctgacagtgatattgaacaccttttcatatgtctgtatgccatgtgtatgtcttcttttgagcaatgtctattcaaatcttttgtccgtcttttgatcagattattagatttgttttttctatagatttgtttgagctctttgtatattctggtgattaaccccttgtcagatgggtagcttgcaaatattttctcccattccatgggttgtctcttcgctttgctgattgtttcctctgctatgcagaagctttttaacttgatgtgatcccatttgtccatgttttctttggttgcctgtgtttatagggtattgctcaaaatatctttgcccagcccagtgtcctggagattttccttaatattttcttgtagtagttttatagtttgaggtcttagatttaagtctttaatccatttgattttatttttgtatatggtgagagatagtggtgtagtttcattcttttgcatatggctatccagttttcccagcatcatttattgaagagactgtcttttctatgttcttggcacttttatcaaaaattagttcaccataggtgtgtatatttgtttctgggttttctgttgtgttccattgttccatgtttctgcttttatgtagacctgaagccagcacagtgctgggtctcgcccaagacctgctgtaaccactccctggctgctgactgtgtttgctcaagggtctggggctctacaatcagcaggtggcaaagccagcaaggcctatgcccttcccttcagggccatgaggtcccccaggccccaggtgggtccagaagtactgtctgggagtcagaccttaaaagtctacctggtattcttttgtattacgactgagctggcactaaaactgtaagactcaatctttctcagtcttccctcctttttccaaaggcacaggagcctcaccccgcagccacctttacccctggccacatggagtattgccagattactgccaacattcccttaaggcccaaggtctctaaagtcagctcgtggtgaatgttgcagggatttgggactctagtcaggggagaggactgccctccggccgaaggcaggcccagaaatgctaagactcaagtcttggagtcagggaccccaggaacccattcttggggttcttggtacctaagatgttggtagttgagtcccttttatttttctctctgcttttctcaaacagaaggagttttgccctgtagctaccacagctggttatgtgctgagtctcacctgaagccagcaagtcccggagactcacccaaggccttcgatgtaattcatgggtgtcactgctggttattcggggcccaagggttcttcagttagtaggtgatgaatgctggcaggactgggttgtttccttcaaggcagcggcttcccttccggctcagagtatgtctagaaatgtcatctgggagctacggtctggaatgggggcctcacgactctgctggtgccctctcctgctgtggctgagctggtatccaagatgcaggacaaagtcctccctactcttccctgtcctctcctcaagcagaaggaaggggtctcttttggagccaggtgctgtgcaccctggggccaggggaggggtgacgccagcactctctcggctgtcccagctggtgcctcagtatgtcgcatgccccctaagtccactgtctctgggcctagttcagctgtaggacttgcctacgagttgcagtcgttatggcctagactgcctttcaggtttacttagaggccaacagtactttggccctcagtggtgaggtttgcaggcactcaagttcggacctctgggattggagattgccccctggctagggctagtttaaatgctccctctgtgggcaacatcaggtgagtttggtttgcttttcctttctcctctaacaggacagcactgagttcagtgcctcacaattgctgtattcttccttgtatgagtctgttttcacactgctatgaagatattacctgagactgggtaatttacaaagaagagagttttaattgtctcacagttccacatggttagggaggcctcaggaaacttaaaatcatagtgaagaggaagaggcatgtcttacatggtggcagatgagagagaaaacgaagagcaaagcaggaagagcaccttataaaaccatgagatctcatgagaactcacccccgtctcaggaaaacagcccccatgatccaatcacctcccaccaggttcttcccttgacctgtgagaattatggggattacaattcaagatgtacttcccataatccccacatgacctggatgtgagacatggagtcaacatttgcagcctgacgatgtggtagaaaagaaaaacccatattctggggagaaattcaagctggctacagaaatttgcataagaaacaaggagccaaatgttaatcaccaagacagcggggaaaatgtctctagggcatctcagagactttcacagcagcccctcccatcacaggcccagaggcctaggaggtaaaaaatggttttatgggcagggtccagggcccccctgcagtgtgcagcctcgggacttggggcatcccacctgctccagctgtgggtaaaagaggccaaggtacagctcaggctgttatttcaggggatgcaagccccagttacaattccagatgagatttgggtaaggacacggagccaaactatatcatcccttccctagcacccagagatgctcttgtcaccacgcaccactgctgggggtcagggagaggtggcactggcgattcaggacagtttgttctatgtcttcagtgccccttttcgcaataggaagttaaaagccagtactgtgaatgctcatctggcgtttggttctcatgaaggtgtttttttctgtgtggatagttgttaacttggtgtccttgtgggggtgggggcaattggtgaagctttctattccagcatcttgctctgcctgttttctctgacttttataatttcttctccttttggaaatttcggtatttgaatactttttactttatgatgtccgatatgtcacttaggctttcttcattcttttttgttagattttcaccttttttggactgtgttatttcaaaagctctgccttcaattcagaaattccttcttcatgatctagcctattgttgaagcttctcgattatattttttaattttgttcattgaattcttcagtcttaggatttctctttggttctttttacgatatctctttgaatttattcagatcattaactgcttttctgagtttttcatattgttttacctgtgttctcttgtatatcactgagtttccttgaggtcattattttgcatttcgtttcaagcatatcatagatttccttttctttgatatctttttctgaagaattattgtgttgctttgtaggtgtcatgttttctttttcgcatttctcgtgtccttacgtctgtgcatctggtgtcataattgcttcttctaagtttttggattggctttcatagagaatgactttttcatgtagatatatttacagtatttgttgggtagagttctttagctctgattttgggtaggaacagtactgtggtcttcatattatttctttgtccataatcagtgtcagcagtgatcacaggttctttagtggcttaggctgtgattgttagtggaggcttgggcaacctttgctggggatggagacaccaggtgggctggttcttaggccccttgttggcacatgtaggtactggtgatggtggcagtgggccaggcattctggtccttaggtgtctaaatgacatgagactgtctgcaggccttgtaatggtgcatatggcaccactggagatgggttgacccaggcctgtcctcaatttccttgatgccatgtgcaggcttatcctatcttccagcccccagataggatacagatggggcctctggacattgtgccccagagagctggttctcaggtcccctgaaggcatgtacaggtgtgtggtggccttgtccttggaaggggtggcatcgctgtaggtggcagtggccccaggcaggcagctcccatgctttgaggaaaatgtgcttcagctccatttgtcatgggggcagcctccctggtgcactggttctgctggtccccagggtataggacacagtgtgggctagagtactggatatctggctgtaccacttggtccagctggcctcatgatactgcagccctctgagtggatatgggggaatatcagtggcattccagggatgtggaatggaggggcttctggggtccagggcaggatatagtctggttgttgctgggctcttaaaatggtgccatgccacagcaccttgggtcctgaggggtgactagaatgcagcatgaatgcccttgggaacaattccatgatggactccagtcaactccctatactaggctcagggcctgtgaagctgagcagctctcctgtggctaggatggcaggcatctgtggtggtaatgtggacaactggagatttcttgcttaccttttccctacaatggggagcctttcctggctctgagccaatcccggctgagactgctgcttatcttccctctttctctgtgccttggagagtccctgtcccttttgtgctgaattccattgttccctcttagatgctctgtttaacctgtggttatctgctgactgttttccttctttttggtggaggagatgagtgccagctgcctctagtcagccatcttgatgatgtctctctgtttctttaacatttgctccataaggcttttccactgcagcacattattagattgagatcacttatgtaacaacttttactctgagaaaggagagacaaagtaaatgccatgaagataatgaatggacttttcttctgttactcatatacctttttcatgttggacctacttatttttaggtccaatatgaaatatttcacataatcagattgtctaaagaaatcttactttggaagaatgtttacctcactagaattctttcgtaattgttatctttcttggtctgagtaattataagtaaattaggaagtgaaactcggaaaggttcagagatatgcctctgagacttatcccaggacttacccctgggacttaaaggaaaaagtggcaaaaccaagtctgacacccagatgtcatgactaaacctaatgctcctgccagtataccacaactcactgtaactcccattggcaacatgaatcaagagaggtagttgctctcactgcatgagaaaggaccctgagctcattctaatgctgcaggagtccatgaacatgatccattttgccttaagaagaacttttgaaaataagggaattaagtgggaaaagttgaatattctaatagctcctgaagattcaatctactttattgttagccttttgccacaggcaagaatgacagaaatcatgggaaactgccctgggattcctcccagaccatgatctggaatgttagcaaggtagctttccaccagcatccttggttggaaatgagaaggctcttgaatttagttcctcttaggtgccatgaatatggtggatcttcagaaaattcttgagtgaatgaatgatgatcttttattaaaatgggggtcatagtgatcttagttttattgtaacaggtgacatctgggctgcaatagtatattaggaaaggatttggctataaataacagatagcccaactaaacgtagctttagtaggtggggtgcatgttctaaaaattctggagaagtaatccaagatgacagcagcgactcatagatctcatcatggacctgaaatccttctgtcttcctccatagtcatccctagcatgtgggtttgtccttacagtctgaagatgactgatgcttccaaaccccagtcagtgtatctaagctctggagaaaaaagatggggtaataagaggcaaagagcaaagggaagacctcctaaggatatctacctacactttattgctcaaaaatgatgtcatttactttgttgttcagaatggtgtcatatggccacctttagctatagaagaggctaggaactgtattttagctttttagcctttatgcaagaggaagtcaagagaaaagagaggtgttaaatggattttgggtagctagtgcataatgtctaccatacccactgagaccattttctttactctattgagctaaagattcgtttaatattaaaattagggtttttcagagaaggagaaccaacaagatggggtggagaaacagatttattctaaggaattgtctcacctgattatggaggttgagaagtctcaagatctgcagttggcaagctggagacccagaagagccatggtatagtttcaggacaagtctgaagccctgagaaccaggagagccagtggtgtaagttctgttccaaaagctggcaggcccaagttccaagaagaactgatcagtccaactcaagcagtaagccaggaggaattctcttttgcttttacttgagggaattgcagccttttggttccactcaggccttcagctggttagttaagtgccaccagagagagcagactcctttactgagtctgtggattccaatggcaagctcataaagaaatactctcacagacactctatgaataatgtttgaccaaatatctgggcaccctgtggcccactcaagttaacatataacattgaccattaaaatattgagatgggtctaatggtgtcatgaaaacagtacttgattactctgctggattatagtccatgctgtatctaacacattgaatggtcctgggcaagtcattgaacctctctggattcgttccatcctctgtaacattaaagaattacactagacagccatagggcccctccccgctcctgttttcccatgtttccatgaaatattttctagtggaagagagtagagtatgtacttagatgagaatataaacttagtttgcaactaatttttcagttgtatttttaagtttctatttgagaattttgtttagtgatataaacactcctctgagatctctgtactatcaatttgcctcaaaaaaaaatacagaggtaaattcagcttagtgcattcccaaaagatcataaattcaacattagttcaatcaaaattaattttcagttcctggatttaaagtttccaagcttatttttctgcttttcttggaacctagaaaattcatctcaccagttttctgcatcaagcaatatttattatgtgtctacatctgcatattattggacttacacagtattttgtttcaggaaggcaggaacccttttaatagcaagtataatttgcatatttacagttgtcatttgtaatcagctgcagcttaatttctggaaaaaaataaaacttaccttctgagggaggtttttgaatgatttgggtcctcatggcttgcccaggtcagaatccaaggcaataggagctgaacagaccaaatggaattgattgtttccataagtttgtggcaagaacatagcgtgctgctttggatgtcacatgccttgttgcaaaaaacaaacaagctatgattacttgccatgtcaatttttctttcctaagtcctgttagagttaattcttttgaaacaccatgtctatcagtctatcaaagctctgttgcctcactgctaggttattgaaatagcccctgattattcaccgggctctcaatttctttcttttcatccttggcacacactgttttaggtaaactctctcagatgccactattctcatgttgttactttgctcagaaatgttcaagcattcagcattatctttagcactcaggatcaacttcatactcataggttgccattcagtgctctctagttgcgaccctaacattcaacctgcttttgttccctttttctgtttcaaaataccaatttcctttatctaattgttccctttcctccacccaaaagattttgaagtagcttacacgcacacattcacaaggatacatacacatgtatatatgtatctacttgcatatgtaatacaacagcaataaattttattttcgtttgagaaataaaagtgacaaataagatgaaagtagtttagtatgcagaatttataccatatgatcctttatgtaacagctagaagtactacacttgagcttaaccaaaaggcctagaagcaatatataacagctagaaaaatgatgaatttacccttaatgtatcagcagccaaacctaaaagactactttcaaaattcacagtagccctaagaaggaaaacacagccagagcagtttttccctgcactgaggcctgaggcactcacaaagcattcttactggacttccacagcgagtgaaatcactgatttctataatattcttcatcatagctgattgacaatactttttttttttttggagacagtctcactgtgtcttctaggctgcagtgcagtggcacaatctcagctcactgcaacctctgcctcccaggtttcagtaattctcctgccttgccccctgaatagctgggattacaggcgccgcgcaccaccacacctggctaattttttatactttttggtagagatggggtttcaacatgttggccaggctggtctcgaactcctgacctcaagtgatccacccgccctggcctcccaaagtgctgggattacaggtgtgaaccaccgtgcccagccaaattaatacttcttaataaaagaggtaactagaagcgtgaaaaattaggtaatctaagatcatatctctttgatggtttgtttctttccaagaatacaatttagtctctatggaggaaagcagtgactgcaaatccttcaggtaatccttcactagtgttatttcttgcaaatgggcttttacatttcttattttgattttttattaaagtaatacatgtatatagtttgaaaaattaaagtactctaacacagttgaaaacaatggtacccctttcctctcttgctcctgcccacgacctactcctcagagagaacccattttagcttctggcattttgtccgtgtttttaaacttagagctcccttaagtcaggtgctagggatactttctgcttactggttcagcttaaagaccaatttttatttccaagatttcaaatttgttctttttcacgtctctgtgttttatttctgcctattttggttttataacttcttttttactttaatgcatgctactacattattcatctctttgggtattctaatcacacttcttttaagtgttagttccatgaagtttattttactggagggaatttatgttctgattgttttcagttggttagcattgcatttcactcagtgttctggaattttgtatggcaggctcatttttagtggacagtttttttgttttgttcttttcactccttctgtgctcttcccttctgtctggtagttttgcctcccccaagcccctcagcctccagttcaaaaccagaacttaatggcatttggacctcttgcgccccggtgatgctgaggctagtgcagaagtgttgcctagatggtgggcgtcatggctgtgtacctagacaagagagcatggctctgtttggccccttcaggcccacagcttcctgtaaatatctagcacaggggaacaggtcatcagccctggttttgtttatcccggcctcttttgtcaagcaaggtagcctcaccccattctctggctttaagctttaaggttgactgtactcaccatttttatgtgaaacatttgtattccctgtttaaccaccagcactcagcttgtacctactgccacctacttccagacctcaggccctggagcttcagctttgtttattgctttgcatttctgttctatttttggtccagggagatcattgcctgtttttttttttttttttgacttggcaaagctatttttggttcctgtttttatattttacctgtcattactatggatttggagtagaagggaacgcttccaggtttgaacttacagcatcttgattggaagtctgcagttgcttttcgagtacataggtaaaaatctaagtctttggaggcaaagaaaaaacgagaagataatgatctaattttcctgagggcttccaagtatgtgtgcatcttttacccagtgtcagccgtctgtggagcaggggatctatatcttcttttatcacagagccttctatgaagagagattgagtaggatcattgtgaaaatgtatccattctggaaacagtttaataaatggttctgtagtggggagaagccttaataaacttctcattccctgatgctacaattctaagcctacttcctcttagtttcttctgtaaatataaagcaatgttaatttttgtctctggtaattatttcagcttctttttagaaaaactctttttctgcaacacagaattgccttccctcgtttccttctgagaccctccacgacacctatgagttacacagccctgaagaagcccagcttctacaaagaaatgactttgtgctggtgctgtgtgggaactgccttgattcccatgtgggctgtacatcacctgggctatgccctgtaaaccgtgaaaaccggggaacagaggcaggtttgagtgaaaggaagaaacaatgattgtctgaagaagaagaaatgaaagaatgttagcgcaaaagttatattcaaaggaaatgaaagttctcagcccaagaaagtttttatggtactgagtctatttgaaatgggagcacttacttaaaggtcactaggaaaccaagattttttctgctgccttactctattttgctagataaattgtaagcagaactgtctcctggtgggatgatgagcccaaccagctctgcgttgttctcaattttaacaatctaagcagaatgtttcccgtttctaaagttttcatcataaccaaactatgttgtcctcaggaagatttgacagggaactgaagaagtgtgtgcgtgcgtgtgcgtgtgttcattcccatttttaattagttgaaacctaacattgctgtatgttacctgtgtcttgcttctccagacaagcagaaaaatgggtttcccccagagtgaatgactgtctgtttgagttcatgtttaatcaaggaagggagttactgacttcataatcacataatcccgtctgcagtgttgctatgacatacggggagaggcttctgggcatgctacgatgggctgtaaagttggctgagagataaacaatgtagctattgtgtttgccttggactgtggcgttcaccacatcacaggatgtggcacttcttctctgccttctccccagaggacaggcagctgtgctcaccaggctccttcacgtggccctgttatgtccacctcgggtaaaagatggtctctccacaatttgtggtgtcgtgaattctgtctcacctttccagttcttgcacacacattcttttctaccatctttggggcttcataagcctccagctcagaggatagattgagggatggcagctaatgtgatacagagtatgtgttcttgtgtaccaagtaccatccccagcccaacacatggtccacaggtacgcagtagtgttcaggaagtctagtacaataaggtgattcttcctcagatactactggaaattagaatacctgctaaagcttatgggggcacttattgtgtgctagtgtgtccagagttggttccttccggtgggttcatggtcttgatgacttgaagaatggagccgcggacctttgcggtgagtgttagagctcttaaagatggcacggacccaaagagtaagcagcagcaggatgtattgtgaagagtgaaaaaacaaaagcttccacggcgtggaaggggacctgagcgggtttccgctgctggttggggtggccaggttttattcccttatttgtccccacccatgtcctgctgattggttccttttacagagtgctgataggttcattttacagagtgctgataggttcattttacagggtgctgattggtccattttacagggtgctgattggtccattttacaaacctctagctagctacagagcgctgattggtgcgtttttacagagcactgattggtgcattttacaaacgtctagctagctacagagcaccagctggtgcattttacaatccccttgtaagacagaaaagttctccaattccccactccaccctggaagtccagctggcttcacctctcacgaggtactctgcagacttctctgtatgcctcatctcatttctctctacaaccatatcaaagttagggttactcttactgccgttttacagatgaggcaacgggagctttcaagagtatagccctaacctcttcactatgctgtttctatagtgataagagtaacagatagaccttccctatctttttaaagaattggagtgtaatttgcattcagtaaaattcaccctttttagtgtacagttctacaaacttggataaatgcagtctgtgaccacaaccaccaccaccaccatcaagatagagaagcgttctatcaccaccactcccaaattccttcgtactgcgttgtatccatgtctataccccactcccagcacctgctaacccaaatcttctttctgtcactaccattttaccttttccacaatatcatatacattaaccagccatttcatttggcttcttttgcttagccatgttatttgtacacacatttataatatataacctcaatagttggttcatttttattgccaagtagtattccattacatggctatttcatagtttgtttttctaagtgaaggatatttgagttgttttctagttttggtggttgtcaaagccactgtgaacattcacatacaggttattgtgcaaatataagttttcattttatttggacaaatacctaggagtggggttgctgggctctatggtaaatatatgtttaactttataagaaattgctgcactttttttcaaagcagcccctattgttttgaattcccaccagcaatgactcagagttccagttaccccaaatcctcaccagcacttgtttttgtcagattttctttttgtttttcatcctcctaatacatttagtgtggtaacattgcattgtggttttaatttgcagtactgtaatgtgttttctcacgtgtttgtgtgccacatgtacatcttaattgttgatatatctgttcaaatcttttgcctattttaaaaattgggtgttttcttactgagttttgagagttctttatcctgtacacaggtcttttgttggacatatgttttatacatgtttttttcctcagtttgcagctggtcttttcattctcttcacagaatgaaaagcagaagttttaaattttgaaatagtttagtttatcagtatttttctttcatggatcagtcttttgaagccatagctgaaaatctttacctaattcaagaggagaaagatatttcttctgtgtttcatattagattttatagttttaggttttacatttaggaatttgatccattttcagttaatttatgtgtatgcataatgttcttttttgtatatggatagccaatgattctagtaccatttgctgagtcaatatcttatttaaagccacaggatattatacaaagagtacagagttagatttagcagaagttgggttctagttccggagcatcagcaactggccagagacatgaaatccaaatggtggataagaggacagcttgatacggtggaaagagcatgtgctttgcagatagatggttctggtttctgctgttgaccaaccctttgacatcagcaagttaccttccctgtgatggtcttaattttctcttttgtaaaatgagaatactctaaacctggcaaagctactttaagggttcaattagataattagataatatatgtatagattgggagatggtagatgcttggtaatggtagccattattattattgaatgatctggggaaatagtctatttgggaggttccaagaaatacagcatcctcagttcccatcatttgctgatcagagtctctgaattgttcacataattttcttaacagttttttaactcctcctgttccaatttttagttgtctctgctttcttccccctttttttgtgcctagtgcctcttgtttggtttggttccagtggtcactgtgctggggtggttggtgtttttctttctttcttttttctgttttgagacagggcgtcactctttcgcccaggctgaagtgcagtggtgtgttcatggctcactcctgggctcaggcaatcctcccatgtcagcctcctcagtagctggggctacaggcgtgtgccaccatgccctgctaatttttaaaaatatttttgtagagatggagtctcactgtattgcccaggctagtcttcagcttctgggatcaagcagtcctcctgcctctgcctcccaaactgttgggattacaggtgtgagccaccatgctcagctcagcttgtttttcattcttgtattcttcctggcttgctcccctgcacttcctaacctgggctctccttccagaagtaagctgacctttgtccagacttagggggcatatcactgtccttcatcactactcgtgctgtcctcttcacccctacagttcccgacattgctgtcactgagggggtgtacatagcagaaggaagggaagtacagctgagtaagaagacagcatgagtggcactgcacagagtcacatccaggtcattgctcccctccccccagattcctggacaaagtggatgtcatcctgggctgtctctgcagtttatttcccaagagaccaatcctcttttgtaaacattatttatttttgtatttttaaattttgaatgtttatggctacagagtaggcgtgtatatttatgggtacatgagataaatattttgatactgtcatacaatgtgtaataatcatgttaggataaatggggtatccattgcctcaagcatttatcatttcttttgtggtacaaatattccaattatatttcttcagtaatttttaaatgtacagtaaattattgtagactctggtcaccctgttgtatcaaatagtagatgttattcattctatctgattatatttttgtacccattaaccatcccccgttccctcccttgcccactaccttcccaggctctggtaaccatcattctactctctatctccatgagttaaattcttttaatttttagctcctacaaattagtgagaacatgtgaagttggtctttctgtgtctggctagtttaattgaacacaatgtcctcccattccatccttgctgttgcaagtgataggatctcattcttgtttatggctgactagtactccattgtgtatatgtaccatgttttctttattcatctatcaacagacactcaggttgcttccaaagcttagctattgtgaatagtagtgcaataaacatgggcgtgcagatacctcttcgatatactgatttcctttcatttgcgtatatacctaccagtgagattgctggatcaatggtagttctattttagtttttcgaggacccttcatacagttttccatagtagatgtactaatttacattcccaacaatagtgtgcgagggttccctttttttccacatctttgtcagcatatgttactccctatcttttggatcaaagccattttaactgtggtgagatgatatctcattgtagttttgatttgcatttctttgatgatgcgggatgttcttatacctgttcaccatttgtatgtcgtcttttgagaaatgtttatttagatcttttgcccagattgttagattgttagatttttttccttattcagttgtttgaagtccttatatatatcctagttattgattccttgtcagatgggtagtttgcagatattttcacccattctgtgggttgtctctttactttgttcattgttttctttgctgtgtagaagcttttaacttgatgtgatcccatttgtccatttttgttttggttgcctgtgcttttgggatgttactcaagaaatctttgcccacaccaatgtcctggagagtttccccagtgttttcttttagtagtttcgtagtttgagggtcttaaatttaagtcgttaatccatcttggttaattgttttatatagtgagagatagaaatctagtttcattcttctgcacatccagttttcccggcaccatttattgaagactatccttcccccagtgtatgttcttggcacctttgtcaaaaatgagttcactgcagatgtatggatttaattctggattctctatttctttccattggtctgtgtgtctgtttttatgccagtaccatgctgttttggttactatagctctgtagtataatttgaagtcaggtaatgtgattccttcagttttgttctttttgctcagaatggctttggctattctggaccttttgtggttccatataaatttggggattagtttttctgtttctgtgaagaatgtcattggtattttgagagggattgcattgatgcctctttcagaatttgccatgtaagaattattgttcttttctgagtaagaccacatttggaatctcacaatgaaacaaataataaaatgccttgggacagagaccagacaaggcttctattgacatttattccttcattacagtaggtgttggaggtcacccacactttgaccctaagtctgaaaacagacctcttcagtggtcacagaaacttcagggctgcagggttggtggagagtagctcactctgcagtgggtgtgggcagctgtgggctctgattaaaacatgtagttggcccctccagtgtcaatgggaaggatgtcctagaaggagaaaaaggtattctagtcacttctgttatctcactctctatagaaattaagagaacatggtgccatgcaaaaataacctatttatttttctcaaaaagtacattttccccttatctgttaatcgggctcaacagtgaacttgaaggcttatgcttttggtccatagtacatgctcaaagcctttaaaacatgacatgtttgaccttacctaactttggagttctataggtctctgccacacaaagttccactaacagctcactgttgggatatggaaagaggttaaatttcacaataactatcttggggctcactatttatatagtcattaactgcgccctctagtgacattgcatccttggaagaatgaagctggggaattggtggcattggtaagctacagggagtatgtaatgcagctccgtgtattagggatggtaggtgaccaaatgtggttccactttctctttccctgctctgagaagttgctgttgggcttcaggtagacatggttgatgtagaacacatgcatttcttcactctgtctttaaaacctgctgaaatgacactcagattgggctctttctgcatgttattgattgcataccttcagagcttaaaaggtagacgtgagagagcatactttgtacttagatccatcgaatatcacacaagctaagtggtttgtcagaaagtcagttaaatttgaatagctagaagaaacattaggcatctaggtcaatatcagcattttgcagagaggagaaatgacttgtgtcactcacaaatagagtgacgctggacaatccggcccagaaaatacaagtatcataattctggggcagtgctcttttgataaagcactgtgggtactgcccttggttgtggaagcaaggttaaaaggtaaataaaggtaaaataacatcaagagggaacttttaggcctatttatttatttacattatttttcttgagagatcacttccatttatgtattcattttcaaatacttaacatactatctttgtccaatttctcaagccctttagatggtagaattctagaaatataaacaggaaaaatagatattttgggttggctttactactgaataatttagtatatttaagtgtccatttaagaccctagactgacattggccagtgcttttacaacccacttgggtgagactccatgacaggtctatcatgtaagaagagactgaagcattagctgctgtggagagtccagggagccctgactcaccccaacaaggactagaattaggaataagtcttttctgtttatagcttgaacattaactctctggaaataaggcgtcttatattgcttagggcttaaatagacttaagtctccttttttttgcttattactcacccataattaccattttcatctccagtctttcagcaaacctgcttgaatctctccctccctccctgtttctctccttttgtccctttctttcttcctcaagtatttcatgatgtgagacatatatcataggccaaccatgggaatcctgagattgaaagatgtccccttcctgtaggtggcttccattctaatgtggagatagatacccagacacagtttaatttggtgtggcagtgattttactggaagcctgtttgaagtatagtggcaatgaaagagaaaaaaaatccctggtcagtctagaaagacttcacaggagacattgacctgagatgtacaggttgtataggaattttcattgagatggtttcaaagagattcagtctggggatgttactggaaaaggggtcccaatccagaccccaagagaaggttcttggatctcacacaagaaagaattcagggcgagtccaaaaagtgaaagcaagtttattaagaaggtggaggaataaagaatgactcctccacacacagcagccccaagggctgcgggttacccatttttatggttatttcttgatgatatgctaaacgaggggtggattattcatgcctcccctttttagaccatatagggtaacttcctgacgttgccatggcatttgtaaactgtcatggtgctggtgggagtatagcagtgaggatgactagaggtcactctcatggccatctcggttttggtaggatttggccagctcctttactgcaacctgttttatcagcaaggtctttatgacctgttacttgtggtaacttcctatctcatcctgtgacttagaatgccttaaccatctgggaatgccacccagtaggtcttagcctcattttaccaggcccctattcaagatggagttgctctggttcacatgcttctgacagggacacaccctgtgaaatgtcccagaggcttgagagaatatggcgcatcagggaacagctaatggtttagtattgctggaggataaaggctggtaaggccagcagtgggtggtgagggatggcctatgctgggcagagggtttgcattttcatcatggagggatgggaagtcattgttagaacagtgaggttggcctttcgacccgcaatagccagaaaaacgtgagtgtgtgtagaaccaagaagtcagaaatgattgcatgaagaataaaaaattcaaatatcgggcaaggaaattagcatggttttcacatcattacacccagaagaagagcttgtagagagctgcttatgcatatctatgatggcagctttcttcctcccccacaaagaatgagatgcttttgggttcgattaatacccggggatatggcaaacggtttgtttcaaatactcatctgcttacaggctgtttctgggtgcttctattaaagattagaacatttaccaattgtactgggtattaattgctgaggtgagggtgtgatggtctctaaactagctgtacttcccagtaattaggatattgtattgcttcagttgcagccatcagcatatcttctgcttcctcttctttcaacctttgttgacaagccgttttcagaccccgagaactctaataagtaaggagagatgtgggctttctctttctcttgttttgatatgtaaattagaatcctggaattatgaaagcgttgataatgttttcctgtctataacattaaaattggaaagctgtagctaaaggcccataaaacagttgtctccacatttgtcattaaactcctttatgtaataaatttactcatccttaatttggaattatcttgcttttctcagaatttagtcaatcttggcattttttcaataccttcttatgctaatttcttatttattgtgccttttaaaatggaacacataaagtagcagccaattaataaattatgttttctacaactgaaataaaaacatgttaattatttctgaacaattaggttgcgttcaacatgggtgagtactccaatgggagtaacaagcagcctcagaggatgaggaaaattaccttagtttgacatcatattaaatgaatatctactttttacaactacttcatgttatgaataaggtcagttaaaatcattgtaaaaattgtggatactaacctccttaattttatgtaattgtcttttagctcaagaaaagaccatgaacgtttttatgcagctgccccataactatatagtggccccataacttaaaaagggacagagagaacctctaatagagaaacactgtagaaaagtaagactttaaagaaagactaagggcatacaaactcttcagcctgcaggagaaaggaggggccttatctggttgatataggagttaaaaagaaattagttgggcagatagtgagggtaaggaagtcctcggtaaggttttccctttaatgaaaagcagtccccaaatcacatcttttctaacaaagaacagcctgtaaaatcgagtcacagacatagacaagcaagctggaagcttgcaggggtgaatgctggcagctgtgccaataagaaaaggctacctgggggccaggcatgttcaacatggtggtgtgtccggaattggttccttccggtgggttcttggtctcactgacttcaagaatgaagctgcagaccctcatggtgagtgttacagttcttaaagatggtgtgtctggagtttattccttcagatgttcagatgtgtccagagtttcttccttccggtgggttcatggtcttgctgacttcaggagtgaagccgcagaccttcacagtgaatgttacagctcttaaaggtggcgtgtacagagttgtttgttcttcccagtgggtgtgtggtctcgctgacttcaggagtgaagccgcagaccttcgcattgagtgttacagctcataaaggtagtgcagacccaaagagtgagcagcagcaagatttattgtgaagagcaaaagaacaaagcttccacagcgtggaaggggacccgagtgggttgccgctgttggctcaggtggctagcttttattcccttatttggccctgcccacatcctgctgattgggccattttacagagagctgattgggccattttacagagtgctgattggtccgtttacaatcctttagctagacacagagcgctgattggtgcgtttttacagagtgctgattggtgcatttacaatcctctagctagacagaaaagttctccaagtccccactcaacccagaaagtcctgctggctttacctctcagtggcaccatcttcccttttgtcaatcacgtgtacagtaaggaacagacaacatggctacctcccagatagatacctgcataataaaagattagggtgggatggccagcttcttcaggtgctatgcaaacatcacacctggtccacccaatctctcaggccctatgtaaatcagacactgcctcctcaagcttgtctataaaaacccccatgcatttcaccacaaaaccggaaggaccactccggttcctctctgtccctgcagaagagagagcttattctcttttctctttcttttgcccattaaacctccgttctcaaaatcactttgtgtgtctgcatcctcgattaccctggcatgagacaatgaacctcgggtatttaccccagacaaccatgctgcatcatggtcagggagacctatagttttcagtcctcactaagattgggagaaatagacttcagctataggtatttggattcgatgtactgaccttttgggcttttttaagaagatatggtggcatttgttttgtacaggtcttctaagaacagtctttttcatctgtctgatctctgcattgctaaaaagcttcctaatcctcaagttctggaatcctctgacctggatatccctgtataaatttaatatttgagattaaatagaaatattagacatcctaccgctaaaggaaaaaaaatcatgaaactttataaaattggacaatttttcttttttacatcacccactctgggttttggccattttcacctttatctgttgcttcccacgacaaccagcatttactaaatacctactatgtactcaatagcctagaagaagttcctagtatatgaagctccctgaaaagccaaaaataggcaagaattagaaaaggattcatctcgctagatttgtacctaaattcttacagtgtcaggtccatggacctttcatgatactctgtgggccagcatgggtaaaggctgctttaaaccatgaaggacagtgaagagcaggggcttgaatggtcagaaagaagtaatagtcttttagcgttgggaccccaaaagaaagaaattattatacaggaaataaacttcttgactccagtcctgatgttttggggtttttttcccctagtttttaagaaagaagtgagaatgaatttaaaaatgaaagaaaagtggtagacttttgttttttaacccaaaataagtggaaaatagcaaaataattacgggatgttgtgggtttcagacttttccttgggtggttttgagacttgaacaaggcactcttgtcaagtttatttagagtatgtcttccgtctttgtgctgggagtctactttacatattatctcgatttttccaaggtcatttaatattgcttatacagtttggaaaaaataggctgtttccataatgcagttggtttagtatctagttacaagggtacactcagtgaagagcacaaagattttttttagtattaatagagcttcaagggattgtttttacccttttcacatttgtcttttctgaccctaaagattgaacagacagattcaaatggaaaattgctaatattgtcaattatgggcaattactgggtatcagtctcagtttctttctctaacaatcacagtgctgctacattagctattagcgaagcacagcctaccctttctaaaaagagtgtactcttgaaaacagtttgcccatataagtctctttattgattgagcttttcatgctaccataagctcatctcaattatttctacccaggaaaattactactcctgccatccagcctttcagtgaagtatgctttgctatgtgatatatcatttagatttttttattaatttaaacgttttgtgtcaacagaaggtagatcattattaactggtgcaatgtggtgtctcacaaaatacatacatgtcatagaaaagtaattaactccctcattctattgcagaacagatgtgtaactgaataagaactgggacccaagggtacactagtgcatttatttatttattttgtagtcattaaattgttgactgagagacttcattgctagtttctcaaacttcattcactttttcctctcaacacccctcacccccacatgattgaaaatagatttagaactattacccaaaattataaattgatttttggctcattgtagtgattcaagccacagataggctctcttttcagatgagatgaaggtttgatgacttagggagctgcgaatacataagatatatgggggatttttgttgaaaaccagaagaaggtttagcagctgctgttggtggcaaccacagttgggttaataaacctagctagtgtttcccaagcagcgtgccagaatgaggttaagtcaagacctcacgattgacagaggtcagttgtcacttcttgcctctctccccttccagcaacatgtataatcctgtgagtgtttcttcagcacccttctctgttgtttacactactgcaagagcctccctaagcggtctgcctgtttccaccctgttgtcttggaatttagttttctcgcaaaagccagagaatgttttcagaaggtagctcttgagcaacttcccactttcttggaggggagatccagcttccccaacaagaccagcaggcccctgtgcggcctggctcctgttcaccctaccagtctcggctcaggctcacggctggaatatgccgagctctttcttgtcctggggcctttgcacttggcttccctctgtccaaaatcatcttcctgtagctttgtgcttgcctagctcatcatcattcttcagctcgtggcttcaaccttacctccttggggagagatccttgactaccctatgaaaatcaggtgctgctctcctcattattttctgcaatgcctttatttccatgattgcactagcaaacgttacgtatcatttttatatttgctgtgtatttgcttacttgttaggaaagtactaatgaccctatcagtcttgttctgtattttgtcctcagtgcccaatacagtgcctaataaatttgtgttgcgcaagtgaatatgtgaataaatactgttatttgcctagcatggagttaagctctataggacatgccaaaaatctctattacctgatgcttcaaaatgacttttactcataaaacaatttcatggtagtttaaacaatgggctatcaggaagggatattcttgccctctcttcctccaacactttgtaatactgagtatggcctaccttacttccccataccaagacctacaaactcacatgtaaaccacccgttggaaagacaggatatatatttccagttatcatcatgacagattcctttctgcttgcagttcatgcccctggtgttctttcctcctccaagaatgcacacattccagagttgatgaaaccagacttgagtaacacagtgttggtttggtggtatacttagatatgtgagttttctaatctggtcaaaagcatgaatatccccattatcctgttggagatctgtatatttttataatgaacaaatgtagaagaatcatttcataggggcctataagcccaggatgggaagggcccttagaggcccgcctacccagggcaagtatctcctggacagtgtgtgccctgggtgggtatccgtactcaatgtgaacttttttagtgctgatctcagcacactctttttgagcacaatgttccactcttgggcaactgtgattgtaaagttaattaatctcatgaactaaaagctgcctctttccacttacatcagggtcttagttctgccccttggaacaataaagagcaaataggtttcttgtcccacctaccagtcttcaagtacttgaatatttgaggcagtgtggtgtagcagagagcactcaggtttctgaattatacaactgggagttcaagtccttctccaccactttgtagctacttgaacttgaggaggttaacctgtctttctcagctgcagtcttgtcttctataaggattggactggtttttacctgatacttcgttgaaatgattaaataagatacagtgtttaaagtaattagcacaataaaccctcagtaaatgttgttgttgttatttggcctgcagttggccatctctgaaactcacctatatctataaaataaggaaaatgattcctaccaaggagtgattcaaggctgacatcagttaatcctaagatatagttggttgttcagccagccagccaggaacctatatatactttctcatcctaaccagatagccttatcttacccccagaatattatgaagatattaacaaatcctggttgaaatcgaacaatatggtgttaataatatttgccccatatacttgtataatctccatggaattaaatgagttcagattggcaggatttgttcttggtgctgcagctgcaagaacagcattcactagagacagcagcggtgtgcatggcaactgtgctatctctagtgtgtacagcaacgcacctgtgctatctctggcgtgtacagcaacgcacctgtgctatctctggcgtgtacagcaacgcacctgtgctatctctggtgtgtacagcaacgcacctgtgctatctctggtgtgtacagcaacgcacctgtgctatctctggtgtgtacagcaacgcacctgtgctatctctggtgtgtacagcaacgcacctgtgctgtctctagggtacaccatgttttaaaattcttaataagcattggtcaaagatagacattgacttatttgcttgaagacttccattacagagttttatttttattttcttgagaccatatttgccgccactctggtcttctgctgccattccctttctctcagttcttcagagtggagtaagaatagtttcatgaccatattttccaagttctttcactgtcctggaatatagttcagctggaattaaagatgggaacttttctaagattcctattctgctctctcctgatgaagaataacttctttggggagaaaggaaaaaccctaagaattgagtagctttctgtgatctcttgatgtttctcacacgcttgaagcagcgactctgtctcttccatgctttctcgttgctcagagagcactgaagcgtttctcatcacctcggttactcagcgttgtcctcttacactcttcgtctccatcgcagtgttctgctgcctactccccatctcttctgtaacagcacagctcatgtgcatttagcggttactgcgagccagttgctatgcacagcactttgcatattatctcatttagcccttaggcccaccctatgaggtaggtcatctagtcctattgggaaatgcttatcagctgtttgtgagcagtgtgctcagatgttgttctagaacgtgaaccttgtacagactagaaatgcataaagcaaatgggaacctaagcgactgtcaagcattttcagactcatagtttccaatagtttaatgactaccgtgccctcattatcaagattatagctgcactgaaaatggaaatggggagatgggcaagcggttctcagatgtgttaacatgaaacctagattaaagaaataacactgctcttcctggaggccaaacaaatacaaattggtttcatgggctaaactgtagttggagaaaaggggcattactcttttgaaaatcttagcataggcagcttcccttctttctctgccggaacccatgtttgtttacactcacaagctcaacgccctcttcctgccatccctgcgttgtccctctccaaccctccaactgctgatgacatcaacagtatattcctgcagttcaggcccctgtaatgcaatggggctgtgaaagtcacaggatcctgcagacaggtgctggggctgcttctggccttccctcagctgggcttcctccttgccaagttgtcctcagctggcccctttttacccattctctatagcactcccagaccctcactactgctccatcctcctaagcctctgctgtctcttgatttcagtagatagggaaaaagagtccatcagacataaagcccatctcaacttcccaccctgctgacttccagatgcaactctatctgcacccattctgtctcttcctgttagaggaaatggggacctccttgccaaagccgagtccccaccacccgcttctaccacctgtgctcttgaccctaccctctgcctcctcgtggacctcgccccccttgctgccccatctgttggggtctgcctttccgtgtccactgactccttccctgtggcataaacgtgcccacactttcccgttataagaaacaaactctttttccagctcagctcttgcctctaaccattgtttcctgtttaatctgtgaaaccccttgagtcatctgcacacttaatgaccctgtttgttttctcttaactcccacaataggagttatcactccccaaagcacgctctctctgatgtcatcggtgagcccctgatttcaaatccattgacctcctttgagtctcttccccattgatgccattgttgagttccacaccacctgtcccttccttcctcctcctgggaacactctcctttcgtttccgtgccctcctttacttctccgctttgcccctgagattcttgggccccgttggattgggtgatttcctctgtcgcatatcttcagattccacctgcgtggcgttgacttccaagtcgacacttctcactttcacttgtcttctgggtctagtttcatatttcccgcttcctaggggtaactgtacctggattctctgcagacatcttatattagcatgtccaaaagcgaacgtccctttcctaaacacctttctacattccccatctcaccggaaggcttcgccatgcactcagccactgaagccagatgcatggccgttgtcctggaatcctctactctccacagacttactcccaggttatcatcttgttacactctcttgaattgttccttttctcttcagtctctctcttcctctctcactgttgctaaggcacggccttattcagattcatgtcatctctttctggattgttgaaacatctacctaacaccttccgccttcagtccctcccacctgcaagtgtattttccacgtaaatatttgaaaaacatagagattatacttaaaatctccccatgtctccatgttgcccatgcaggatcaaattcattctttgatctgaccccttccctacctctctacctcatatctaaacctttatctccacccctttcccccgatgaaccgtttaattcagctttatgtttttgggtctgtgggctcattctgaagtagcccttcagcttagtggggaaaagagcctctaaggaaaagcagcctctgaacagcaagtaactgcagacctagtagggcagcagagggccggggagctgccccgtctccgcagcgccgccctgccatgcatgagtgaaccagaagcacccaacagcgtggcctccccaaggacctctttctcttctctgctactggccttcctgcttgtctctccttgtctaatgcttccatagcctccaagcctgaactcatgcatcctcttctccgggacattttccctaaatcccggccaggcagagggctctgcctctgtgctcccatagcctccaagcctgcactcatgcatcctcttctccaggacattttccctaaatcctggccaggcagagggctctgcctctatgctcccatagccccagggcttacctctctgttatcacgtgcggtatttagaaatgatacatttgtttggccgtttcaaccactggaatgtaagctgaggccacatctcagctgtgtcttctcagatccagtacctggccctggagtgcactggggagatgttgtcatatattgagctaaagagcacctgaagggcatgagatttattccccgtagtgccacagacttggtcacttttgtgtctattgtaaataaactatttgtgcaaaagcagagaacatgggagacagaactgtagattgagcagacaagaaaaaagaaaagcaaaaccatcaatacttgcagcaagtcttaaccatgtcggcacgaagagtgacagcatgatcgcagagattcggagcaatggctgaggcggcaaaggccacgctgatggtccttggcccagactgtgcattggaatcacctggggagcttagaaaagataccggtatctgcctgcccccaagagatgctgatatcatttgcctcgatggaacccggtctgtattcttaacagctcctgaggtgattctaagtatatacccaccttaccttactaggcccttacagcaaagaggagagacaaagctggaggaacaacaggtctgcagtttgagggaaagtcggagccctcagtatcccttaaagcatattcctgggatgtgtgtgtatgtgggcatgtctgtgggtatctgtgtgtttgcacactcttggtagcataggggaggaagtaagctctctgcagccctctggagtgaattaaagcctctgatacatattttaaaaagcacatccagagctatccagcttccactggtgatgaagacctgggactttctcatattaagtcctctgaatgaaggtctgggtaccccttgttcttgcacagagcaagagggatttgtaagtttgtttacctccggaaaagaaatccttgcgtattttagttggtaagcatttacaaaccttaaaatcttactttcagagtagtctcaaaagttaaatggaaagtaaaacagaaatggtaaaggcaaacagctagggctgtgtaattttggcccacaatgagtatgacccaaaatgaaaacaaaaactaatcaaaaggtaatcatttcctaaatcttctgtgactggcatcgtagcattcccttgggcaagaggaagaatattaggggtatgagaagcattatatcatcttgtatactcaaaaagccattttgaacatccaaatttgaggaacttcatcagatatcaatataaagatgatacctatactgctggggacagatttgaggtttgatgttgcccacatgccaggttctaatggaagatgtgcacgactcaggcggctcagtgagcagttctctggtagtaggagtattctgagtatatagttgaatatctatttccagctctccccacaatttccagcatgttctgagtgaaatcacttgcccctccctgtacctcctttccttcctgtgcagtagggacctgtctgatcgtcatctgctaatgtttatgaagctccgtcagacctttgtctggaagactctgttaacagtaatgcatgcttggtttatgagacggttacaagagaatggaggtggaggcagggtgccaaacatggccagtacttttatctttgacattacaaagaggtcctctggctgagagccagcctggagtttactggaatcaaaaatgcagacatgtgctttctgttggcgtgccaggaagcggctcgccgtgccgtcagccagcacttcacttccatggctgcagagctgcttgcaggagcgtctaagtcctggtgattttgtgtagtctgtctcatggatacgaggtgaggcacaaaagagctgtaccatggaatctggtcacccctctctcctcccaaactttacaaagtagtgttctcctcaccagacctttaggccaagtgactgccctctggggtgacccaccctccagcttcaagggacagatctctgtatggattgattcacagactacagacttttctttttttgttttagaataattggaggaacactggctttttttccagtgagatacaaaatacaattctagaatttttttttaaaggctgagagattaaagtaatttctttccctcgaacagcgacatgtttcttttgaacttttggcttgtgtgacacatggtctaaggatttcagtgctgccttatgaagtgtttgtagaacgggataatttctgcagcccaactctgaagacttaggggacgctatggaaccctccattaactgatgttaagagagaggttctaatgtcaaaataaatcatttctttagatgacccgtaagattgcctcctaaaaagctatgtctagacttgtgtctcagggacttgttatgtgaagctgtcattgtggaccccagctaaactattcctttaattcagaaccacagattagataatctgatgtgctcgctttagcagataagcaaataccatgtttacccaagcttggaatattgcctgttataatcattatacatacaaatgttagagggaatgtgtgaattaaataaccattgtcaaattcttggtttggcagaaggtagtaccatgttgagtgttgtcttcagtcctgtagactctctgtgctatggctggggttgtttatacttgagaaaactcagtttaaaatagaatgaaggagggacaaatcagaacaaaggcatttacaatttgttgcacaatcacaaaccccagcaaccttcctatcagaatttcaggtctgttttcatggacaacatatactttacacataggcgactaatggagtggaaggattagtttccatgtcagtggtaaccctaatgtagttctcacctgggcaagcggagccaggaggcactgttagactctaggcctcacagctggccagtggcagagctggtaccagggcccggcctccttagttccacttccgtagtgctgcctgtcacacagtcttacatgccaacagcacagaacccaaatcaagctatcattcatcccatgtctgaatgtctctggagtggccacatctaggttatcctataaccttcgccttcgggacactgccctttaaacctcacttgaatctgttctgcggcagcttaaagcatttttatctctgttggcagaggagaatgagagcatctgtcctcaaagaagaaaatacaaaagatggagatgtggccgattaaaggagatgagggctgcagctttggtcttcattaagacaaaactcaccctgaactttggaggtgtactttatcttaatggctattgtcaggagaacaattttcctgtaaaatctttgcatttttcccagaatctcaaacctcccacctggtagcgtttacacaacagtattggcaggacttgggtaggagttgtgagtatgggcttacagcagcctaagccatccatttggtagtctctctacagatgtgaaaagaatttgtctgaatgtgcatttgcaagtggagctcatagccctctgtgtcatctaatccccattatatgttattacatcaggaacatacctttccagtatggggggagggtgcaagcaagtgtctccttcctaaatgtattcatgtgtgtttaactgccttgtatatcagcccatcatgctagttttctacaaaatgcttttctacagaaggctcatttttagcaagcaccactgacaagaggtaggctctcaaactgccctcaacgtgtagatgctgtttttattctctccaggttgacttgattttatataagcaaataagcttatttctctgagaagcagttttattcactgggatgggaacaaccccacacagagggaggggaggtgttgaggctgtagccggaaaaggcctttggtggttctagaagttctgacttcataccttcaaggctgtgctccgtttcccagaagctatgaagggaatatccccttccttctggcaattctgtgtagctggagattgaaccttgaaatcgcagttggtttgaatgtgtggtttgtggaaatttgtagttgcaggagagccctgtttctgcctgagatctaaagctaaatgggcatttggcaaatgctggcagcgacggtgggaatgtaaagtgaaatggaacagagctgccagtggcttcagctgtttgatgacttcttctcctcaccacgagcatttttgtttggattgggctcacagcccctggttgcccaagtgctcctcagttggatccaagggagtgacggggctgcccgacgggagaaggctctctcatctgagaagaggacatccatcctggggtcggccagctcagggaggccggtgaaggagaaggcggcaggaactctgggctctctcatctgagaagaggacatccatcctggggtcggccagctcaggagatgggtgaagcagcaggaggcgggaactttgggctcttgcgaggatgcaagcagctgcttggactcacaattcagagccctgctacatcctgcttgtggacatctgttaaaggcactgagatcccacaatttcatgaaatagatgaaaaaataaccttttaaagccaattttacttcacctgtgggctgatgacagcatctggaagacatgcttttcatctgcatcacagttacgctcattgccgccaggcagtagagcaagcatcatgaaagccagtgggaagtgcacagggattgtgcctgtggatgtcagaggctgtttggtgtggtttgtggtggatcagagaagtttgcttggatgactacgttgaggaagagccttcccggcaaagggaatgggatgtgcagagatgtggggtcacagcatagttggttgttgattacattgtaatgtgctccctcctccaccatttttttctttcccaccaaacaaagctgactctagtcagcctcctgttggtccccgccctgtagggtggggattgaaaactcaggccactgtgacatttaggacgtaagtaactctagagggtgcagaggaaaagatgagaaggtgcatctccttagagaatcgttaccactgaagaaattgggcctctggaaggttgaaggacttgccaagactacacagctcggcagcagggatatgcagcagggattcagttccacatcttatggctccaagcccggcattctttttcactaatttctgttaatcgttgtgtacatttgctgattaattgctaattagaacatactacaatttgatcgtgcttcaacctgagaacattccttccttttccttattccccagcctataatgtccactgactggtctgtagttgatataacagtgaatgctctatttttagccactatttttccgctttatgaaagagccacttttcccctcaagttacatctgaactgctttcagttgtttttgtcaaaggaggtggaaattggttccagcacagatgtctccttttaatcataaaggttttgaatgatgttgtatattaatctagtcccagtatattgccccaaccagactacctcagtcaaagacactgcaaattacctcagaatttttaatttcaagactttccaatctctctcttgagtgcagacactgtatttgaacctcattctactttaaaaactaaaactaaaaacctttcttccgtttaagacatgaattattgaattactggaaaagtttgtaagtgttcattaattttttatttttcatcctatactccatctctcttcaatctaattagagtttgcatgagtactggataacaggaagtactgggaagcagattacctttctcctgttcctcttctttttaatgagaaccatctgaaattggcccagcatacgagtttcaacatcaaacgcttgcaagctaagtgaacacatctgttcaagtgttcgagctgcaaggtgggtctggatggattcgtgtgtttaacctgacagagcccgtggtcactttctcaagtttatactcagctagcctggctggactccaaactttccctatggaagaaacgtagctttgtaattcacagtgactactggtatctggcaggtaaacttcccactccgaaacccaaaggaagcgtttggccaattgaatgtaaccgtgttgagtgatacccttttatgtggtggtgagatgatctcatatcatctggtacctatttttacagttaaggaaatgatcctggggtattgattcagcagctatggatgaaggaatgtaggtggcctcactgattcatgcagggatagatggagcgagggacctctgggccaagagcgccattagaatctcaggatggtgtttgaggtagaagccaggagaggtaagcgagcccactccccaaataacccttgacgcgattgtcagaaagcgtgggtccggagccggcgtggggtttcctgtgctgggggagggtgtcacacttaggctctaaatgatgaccaatgccagctgtagtatttgacaaatacccacagctgcggtgggaacgtatctgatcttagtgtagtaatattagagtcaaggtagacgtgtgctgtgaaaggaacaacctgttgtcttggttgggattctctttgttgtggtggagttaaggtattttattcttgtaatactgtcgcccatgggttgtggaagatcacttctcattcactctatcaccaaatatttaccgagtgatttaccttgcaggcactgggaatacagctatgatgaggtcacggtccctcagggcgttctgaggatacctggggaggcaatccaggaaaccattcgtgtcagttcagggctaggggctgtgcagaggggcctggagggccaggctaacccagaaggcagaaccagagaaggtttcctgatagagtacagcaggggctgtgtcccaaaaggacaaacgggaagaaagccaaagacttaaatggagtggtgagccgaggaaacagcagaaaacacgctgagtcctgacagaagccacaggatggcgattttagttggaagagtgggtgcagtgaagtcagagatgggcgtgggtaggattttggggtggagctgtgaggggaaagaatggggtgagtgaactgggagggcggtattcaaggggcttgtgcggtcagagagagaatggacaaatgagactcgttcttacctgagaacaacggcacagttctgtctttcataaactagctctacgattgtactgtttaaaataaagacaggcttttgaaggacttctccggggctgtgcaaaagagcagtcaccagagatggagctaaattggttctgcactgctgaaatcactagagtggttacatagcagccatccagactagctgctccttctgcaggtgaggaaggtgagggccaggaaaaggaagacttgcccggggtcatgcagtgggtcagggcagagatgccaccagcgctggaaccagcaggttcttcattctctcgatcatttcccaggaaagtcagctttcttaggaatccttctgcttctaggctgaattctttttagcatttgtagaaaatccagcaatagtatatttgatgtttaaatgaatgtaaaatgaatgtttccatcccctaaaaaaaaattccaggactcacccattcaagctccttttatgtggtaaaagtaaaattcaaagagattttttttttcctgaataactttgtcctgaattatatcaagtgtctttgtgtttggatatgaaataatggaaataaggatataaatttactaattttatacctcagggactgtgataaaaaacagtaatttactcttctatttgcaaattaggaaagtagaagattaaaattatgcttccctaagtagtttttctgtttctgtcctgtttatacacctgtgcaactgaatgttttcctccagcctggtgtggagagaggggagacgtgacagacccagtgtagacataattgtgagtagcagccacagtgggatgggtagggtcaggggaagttggaacctgagaggcagttaccgtagtggaacactccagggaggtgatagctattagtgagtgtagctttgtctagctccaatataaaatgctctcagaggtatcatttctaaatgtttaggagcagtttcaaagcttgcttgctcttctgttaagcaaataaaggcttaggatcaacctaaaagaacagctaatcaggttatgttcactggtggcaaatttagttgtgactgtaattcccatatgaaattgttctgccctgggctgcggtctcaccctgcttgatagaagaatacgagatctgctgtgggttctatgttggaggattttactctcctcttagaattgctagtactagatagagcttaggaaacaagggtgaagatattttgaattgattaactcagatatgagtttcaccttttaagcaagtccaggagagaaatcaaattgaagcatgaaggtactagaaagagcatgggctttggagccagacagacctgggtttgaatcctacctcggcaattaggggtagaaggacatttggaccaattatgtaagcttcaggattatcttgcacctcatctgtaaataacaagtattggtgcctttcaaagatgttgtgaggaataactgaaataaacacaagagacatcaaatcattaccaagttagttcacttcttccagatccatgctatagacattcagcagagcatttgttaaatataagactgtgctagatatttgggagaggcaggatcaaagaagaataagacctatattcagctctaaagagcttacagttaagtggggaagatatgacatgcacacactgcagtccacaagctctggccatgctggcctcatgttcctggaacattcaggcacgcttctgcgtccgcacttgccctccgctcttcctggaactgctgtctcctactccttcacctcctttaaatgagctttactcaaatatcactttggtgagaccttccccgatcatcctgtttaaaatgaactccctggtgccagtattccccatccctcttccttgtttttctcccaacaaaatgtgtgtgtgagtgtgtgtgtgtgtgtgtgtgcgcgcgcacgcacacgcacgcgcatgcacatatcttctcttgccgtgtgttccacctgcctcttcagtatgaacaccatgattatctgatttatttactgctctatccctactgcctagaacagtgcctggttaggtactcagtaagtgttaatggaataaatgagtgatctaactaagtaattccaggtacagagagggccaggcacaaagagccccagtggccagaggagcagaaggtatgttagggactacattttctgtggctgctgtaacaattgatcataaatatagcatctcaaaacaactcagatttattattttagagttctgtaggccagaagcctgacccaagtctcagaaggccaaaatcaaggtgtgggcaaggctgccttcctttctggaaactccaggggactggttccttgcctttgccagcttctggttaagttcttctcacagcacatcaccctgacctcctcttttgcctccctcttctacttctaaggacccttgtaattatattggacccacctggaaagtccgggatactctcagctattttaaggtcagctgattagcaaccttaatcccatctacaacttaattcccctttgcaatgtggcctaacatattcacaggtttggagagcaggatgtggacatctttggggatccattattctgcttaccatagagactaacattttgcttagatctagggtttaagctgccagttgtgaaatgtaaaactggaacattcaatcaggaatgaccatgattgttaaggtctaatgggtgagcttgatctgggaggcagtgggaagttgctgaaggctttggtgcaggagagggaggtgatctttaggagatgaatacgggcttaaagcaggcatttgaagggagactgttgtttaccttcttttcttttctttttttgaggcagagtctcgctctgttgtccaggctggagtgcagtggcgtggtcttggctcactgcaacctctgcctcccacgttcaagccattctcctgcctcagcctcccaagtatctgggattacaggcgtgtgccactagacccagctagtttttatatttttagtagagacgaggttttgtcatgttggccaggctggtctcaaactcctgacctcaggtgatccacctgtctcggcctcccaaagtggtgggattacaggcatgagccgccgcatccagcctgttgtttaccttcttaagggcattttatctcctccctcctccatgtacagaaagttagggatgtatttagaattaaaaaaaaaaagtgcacctatggtgtctttttaaaatccactctactatatcacacagacacacagcacatacacatagaggcccacaaagcccaattatgcagacacaagtgctcctatctcctcatacacacacccactgccccagcctcagaaggagagtctcaggatctgttttctgtggttcgtggtgctctgcccctccctttgtttctgccctggcacacttgagtgatatttcttcttcccaaaaacacagactgactctggcagtggttctcatggggtcgttctataaacctccttcaacgggcacatgacagtctccagggggatgtctagagtatgaaaatgtccctcgttcctcacccttatgtcatccttcacactggccctgctttcatgtaacttcctagggtggttcttgtctctgacacccgttgaaagtctcatggatagtgaacacctggttttgaatagtgtcttctaagagtgcttaccctttgactagccacctgaaagcagcactgtccaacaggactttctgcaatgacatagtgaactgttctgtatctgggttgttgagtgtggtagccacagccgcatgcggctgttagcttcttggaatgtggctgctgcagctgaggaactgagttttttattgtttgaattaatttaaattgaaatagccacacctggctggtggctacctgttagtgcagctttaaataagcaggacttgctgagcatgctgaaaagaccatagcagtatctgtggcaaacagagtaatatttgacaagaagatagccttttggaatcaaacagacctggggtgaaattttggttccaggctagtgattgtcaggtaagtcacttaatctgagtctcagttttgtcatgtataaactgggtatgatcagtgatatattagggagaaagatgttagacaccctctgacctggggggaagaagaatatttcacctctgaattgttgcacataataaacatcagacctacttttcgttggtttttattattattttttagtattctatagacagtgtgccctctcattgcctgacccagggtagactttttccactccctgcctgtgttaccccatgggatttgaccttacatacatagaagagctatgtgaagatacttacatacatagaagagctatgtgaagataagacgatatcagtaaatatcagtaaatatcaatatcagtaaatatcagtaaagccttcagcattgtgcacacatgtggttttcagtcattcattcaacaagtgctgagtaagcaactactatgtgccaggcactgtgctagatgccagacgtacactggccaaccggaagcagaggacctgcttactgaataggagggcagacatttcatacatggtagctcataattttcttttgaattttttcagtgttgggggattttgtttttagtttaggtggaagtcagaattgggtcacatgggtgtagttgtactttatacttaataaggttttagctgtaggtctcctaacaaataactatttatcctattcttctgtttttttaaaatatcagcattattgaggtgtaattcacctgtgatgaaattcacccagttaaagtgtacagttcagtggttttcagtctctttacagagttgtgcaactagcatggtgtcaattttagagcatttttatcaccccagaagaaactcctacccattagcagtgactctccagttccctccaatcctcttagccctaggcaaccacaaatcgactctgtctctgtggatttgcctcttctgggcatgtcatatccatggaatcatacatgtggtctttgtgattggcttctcgcttagcgtaacgtattcaagcctcatccatgttgtagcaggtatcagtactttattgtggaaaggttcatccatgttgtagcatgtagtactttattgtggagtcatattccattgtctggatattttattgatagacgtgtgagttgtttccattttttggctattatgaacaatgctgctgtgaatatttgtgaacaagtttttgttgaacatacatgttcatttatcttgggtagatacctaggagtaggactgttaatatggtaactctaattgggaacatgaaaactctacgtttaaccctttgaggaacttccagagtgttttccaaagctaccattttgcattctcatgtgcagtgtatgagggtttccgtttctctgcatcttcactaacctttgctgttatcctgtctttttgattatagccatggtagtgggtatcaagtaacatctcactgtggttttgctttatatatttccctgatgataaatgatgccaagcatcttttcaggggcttgcaggccatttgtatatctgggagaaaggtctattcacgtcctttgcctattactaattagattatttgtcttccttttctggcctgagcaggatgctgatatgctaactggtgatgagcaagtatggaaggaagttcaagaatccctgaaaaaaattgaagaactgaaggcacactggagtatcctttcgcctgtggattgaggtggactgttgggattgtttccttgttttcttgaagccctgtcgtaatgaggtcagaggcggggtttgacctctccatgagccagtggttttcattctgttccatggtcacaggccgcacctccgaccctggccagcagtttgagtaatgacaaggaagttcgtggcaaaatcagcgtgaataataactcactaccgttaggtaataatcaaaactcatggcctagcagtagtaggaaagtaagaattagtctctttatatgtaaaaggtaacaaattcctcaattttcttctcccataaccactaacatctctaggaaagagtagcttagaatccttatcattcagtgccattgaccgtcagacccagaagcttcatattaaaccagccacgactacaatggcagtggggattgctgcacgacacattttctcagcatgaatagtaatgaccacaggtggaccaaagttcagagtaaggagagaccatgtaggatgaaggtcatctgggaaggctccactaatgttttactgtgcaagatagcctgagtcaggggcaggatttggataggccaaggctgagaaggaggccgctcctggtagaggagttcattggagtgaagctgtgatgaagggaaacagcaggcaagaaggaagagatcaaggtggatgaaaagactgcaaaaggtcattcagaggctctggggtaaatttatatcccaggcactaagaacatagcagatgaggtttccaatttgctgacgatgctatttaaagagttgtaaagagccagagaaggaggtagagggaggtttccagttttaaaggtgaaggacataattttgaatcaatagcccactgagtttattagcagtcttgggtaaagaatctaggattggttactaaggaatggaaaagaaagctgtgatcatcacagtgctgcctggtttctccaagagcgaatgaatccacagagtcacagctttctttggtaaagtttgtatcgagactttagaaagggatttgacgaaaagtaatcaagaaacttacattagatgttagcaaagctaactgaatagctacactgaaaaaatgatgttacatgattcagtgtcattctggagtgttgtttttccatctcgggcctctttaatgcataattccatacctcgaatgaagatacagaggacaggtttatcaaatctccaaagtgacgtagatggggaggataatagaggtgggatgatagaatcagtatctcgaaagaaaaaaaagagttcaaaagatctctaaatgtttaaatggtatccaagttttaaagacatgaaatataacaagaacatatataaaatttctattcggatcaaaaagttcaaatatgtaaatatgcataagaacatgtgaaaaaaatttagggctttagtaaatagcaaaatttaacaacatttaagagtataatataatcttagtactgtgatcttgggctgcattaatattgattataaaatgatagagatgatagtaccagtctgattatttctggaattttctattcagtttgaggtgggaagtattaaaaaggatatagaaaaacaaactagttttgaggggtggaactgaaattaaggagggatttgaaacgctgtctatgatgagatggaagatactaggaaaacggaaaacagtcaactctggaagcaggaggtccctgctcatgggctcaaagagcctttatgtgcagaggagtagacctgttctgtgtggtccctggcagcggtattggggcccatggataacccagccagagttcagtttcaactggacaaggttttactgaaaacggactgtgtgctgggtaccttgctggtcatcattcacctgatggttcagacagaagttagaagacacagccctgcactcactactctcctatattgtggggtagtaaaatgtccattaatacatattttggtaaagatacagacttatggcggcatcaaagacacaatagtcaactttgggaagttgaaagatttcacagaggaggtgaccagtgagctgcgtctgggaggattagtgggagttcaccagaccaaccaagagaagaggcatccaacacaaggaatgacctgtgcagacgcgcagaacatgcattgctactgagaagctgctggctgtgcaatatgagaggaggggaaggtggcaaggccttaactgccatgcaccggttagactttataggtgagaggaggccatgggatgattttttaagcagtagagtaatatgattaagtgaataaaagctctgtggtctgacagtcattgaatctcagtaagttgagtaattcccaagtgaatttactttgcttccctttctcttcccctgatcctcttatggtcatttaaaagtattcaggaaaaaaagatatccgttctgtccactaggaatctgttctctttgggtgcactctccagccctgctaggtctagagctcagctccgtactggaacagagtgaattgtagtaaacaccacacagatgccagggactaaatctttgagcaaatacatgtcagtagtagcttggggggaaaagcctcttagttaaaattattccattttttggctcactggggtgttttgcaggaaaggttttgccttgtttggcaagagacagttgccagcattgtgaagggaaattggcacgtagtcccttccagcttgctgggggataaaataaatgcattcctatgagtagctgcagaacatcacatctggcttctacttctaaggcctgtcacctcgaacctctttagaataagtgggaacatacataaatgaacaggcaaataatagtggaggtcaaacagcacaatgttaaaataaggtacaagtcttgccacagaaatgtctagcaatgtgtaagagacagtcattcctcctgacagttcgtcaaatatctaatcctggaatgaaaagccacggaggttagcccagcaatctgttacaaaatcagtgcgttgcctaagatactgcttcccccaacctctaggggatacattcagcaaactttgaacatacatgtcagatgaatgcaagagcaaatcatgcactcgcttttcttcaggaaatgaaccttttctgggatcagggtcaattcctccaagacgggactcatcctaacattgtagtgggtgtgatggaacaggctctcagctgtgcattggggtgctttaaattctcatcaaggaactcatcttttggagtaagatactgtgtctccgggaggcctttgctggaaagaaaatacatttgctgtgaaagttcataaaggtatttgtctccactctcaggagtggcttgattggtttattagaagtatttgctaatgtttcagaaagccgtgttctgagaagggtatggacattcgaagaggaaggttttgctggacagagagggagaggggaccataaacagtgagctgtctgctcagggctgggcgtgctctgttaggacctcagtgaagagggttttgaattgggggcaggggatggcacagagagcatggattgtaaagggaccaggtcatgtgggagtgggaggggtgtgggggcacgaagggggcactgagttcagtcaaactcagtccactgaaccactttctttaagcccagtcaggctcagaggtcatgtcacagagggaaggtggaaggcactaatgcttgtgtagcatgtgctttgtgcatgccacgaaatgttccccactgtgtctctgacacctggaactctccctggctcatgagaggacacatcatgaactgtgtcattttacatacaatatattactcattcttacgttgacgtgagtcatttctatttctggcctatcattaagcactttgacttcctcagaacctcaactctgataaatgacaggactcgattagatctgaatctagctttactacagtcaaaggctaggctgccatttctgatcttcaaaccttttcaccctactggaatgacaacatatgaagcagatgaatttggagctccactgggtgaaggtgagacaggagtgagagaaggaccagtcccagtcctgcaccctccttggtctccagctcgcctaacacaccgcacagtgaagaaactgcgaggtcccagggtcctgcactctggccttcgctgtgtttcccagagaattcactggggagggattaaaattacgctccataaaccatgtcctcagtcctctgactgcctctgtaagacagggaatatcagttttaaaaagcgaagtcactccaaggctacatgagatgaagttactgactcatggttaatcagaaaggcagttactgagaagtggacattgagtcttctccccatcctttttaaagcatcgtttcccttgccagcaattgatgtgcataagccatgttcctaatactgtctcttattttgggggtttaaaataacatattttaatgtatttggttaagtacaggctggggtcactgttgctttataatcggaaaaaatgagacccagtggaaatctatgtcttcaaattgctccacctagtgtgtgcctgtgggttgtgtgagtttttgggttcatgtatgcccaaaactcaggtaacacagaagcaaacatgagctcttccttttgaaaaaggaatctctctaaagcatctttaatttcaaacagtttttaaacagaagctaacagagtaaataatttaaaatcgaattaacttaatctttagtccaatttaataaaggactgcatttatttatgactagatttaaagagaacacatctaggagtatgaagcaagaacaggtctttggaagttttaaaactccaaagcacaggcctggttacgagatagtttgttgatgtaaacagaattcacttcactgagatgcctcttctgtgcttttgcttctcaagtgtgttttcaggcagctcatctgtgaaaaataacgggtgcttccctcgctcctgtgcttgggagctctttagccttttagagaatctaattttgtttgtttttttcttgatgaagacaatgaatccttaactaaggttaataacagagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggcaagtcccagggagagggctgacataagggctaggacgtcttcacgttgggcaaaggatccatgttgtgaagtcattctgattactactttgcatggagcatttccagctgcttctcaaccattgtttaaaaccaagtcttattttattcactcctcttgttcattcacttatgcattcattcatcatttgtaaagttccttccatgtgtcagacaccgtgggtgtacagaaactaattagatgctgtctctatctggagcagatgattacaatacgatgtggcgcttgcagtgacaaagacgggctcagggtggtgggggagctgtagaggaacgcaggctcagacctagcttgagaggctgtgtcatgagcctctgctggtccaggtgaggatggccatatggggcccttggtctggctgacagtaagaatggtcctttatctctctcaggatttatgctttcagttgaatcatttgccttcataatcaccttgtgagccagggaggacagcagggagacggccctgcctcagcttctccttgagtcaggtgaaggaactataggtaattgcttcttgactgatctcagctcctggagaccagtaggtgttttgccctgagatgtttttataactcagaaaagcattgaagggggtagtgttgaactgctgagagttaggcgctggtggatgctgcaccctgatttgcagtcggctgagaacataattctagaaggtgagacggagagcagcccaaggggaagggcacggagacatgtggaccataatctgaggtgggaatggctcagtctctagcacagaacaaggttgctggcgggaaggtacctcgaaagcacctgtgaccaggagcgatggcagagggaggaggtccctggagaacaggggctccaacctgggcagatctttaatttcccagctttgcagactgtgcaaataccatgtcagcccaaaggggcaacgtaggacaacaggcagggaatggctgtaagcgaagaggagcaggtggaaacgtgagagtccagggtacttcctgttcccgctagagggagaggaatttcccagggtcaacataagaacagaagtgagtccagggtctaggatatttgtttggacaaaggtagtaaaccagaaatgaggtgtttggtcaggaagccaggcgtgagccaggagcttggtgcagtccacaaggaccccgaagacggcagaggctccaccagccaggcggatggcagaggtccctggccagccagtgccaccagcctgaccctgagcatgttttcgggacttctgtagatggtttcctccactgcctgtgggtgaacagctttggaatccagactgtgagtcagctttaatcaaatgtatgagggattggcttgagggctgagactgtagactttcccatgagcagtgaaatgcctgctcagagtgatcgatcttgtgggttctcggaaaatacgaatcgcattcaaagagataaggcttcctctctgagccttagtgttgcaaaaagaggcaggtcagatggttggcgttacctctctgaactccagggcttgctctgaggaagccaaacagcctctgggtgagtggataaactccatccaaaagatgcagactgaaaaatacccttctttctccaggcccccaacagcagctgctggttcctcactcttggctagcgctgcactgattcttctgcctcatcctccctttcgacactcaggctgccctgctcgggccactcttaagcacagaaactttacatgggtccaccacatccataaagaagaccacacacctacacgggtgtctgttctgcacgtattttgcaaccttctcttccccacatctaccagggcctctttgaggcactaacttacaccttaagtagctggcagtttgactgactttaaacaaagaggcctttcttgtaagtgaggccaagtcctccaccagaatacagtccattatgtttgggaaacgtttggttatatttacatggtgtttggcaggtcacaatctctttaagtgtgtgctgtgttcttatgctgggtgacaaatttccaagcctcccttggtttctcttccctggcgtgtgttgagttgctttttggtggtatttcaagaaatccaatctgcattgatccacttcacatgagtgaggtacgaatcatttgcttttaaagctgtagttgaggaaaaggctataaataaaccagaaccaacaaagttgagagaaatgggcaggttagatgttgtcatactttgcctttttcccctttagctcaggcagaggtaaaaataaggaatgtatgcaaataggtcaggtaccctgcaaccctgttagcaattttggaacaaaggcaggaatggagaagttggcagtggttttcacctctcacatgtgcatgagggaattcacactgagtgctctcagccccccgcatcggctccctgcagacgcaggaggtgggccttttgctcacctttagccaaggacacagacagttagctaggcatgagttaccaagggatgattgcattgccatctgctgtaacagttttacaatgttaatatattgtttgcaacaactagatggaggtcaagtctttcttgatgattttgtcactcctgaccttggctaaattttaattgctgaccttagaggagaaagtgctgctattccattttaatccaaattatggccttcagctcccttcttgctactctcatttatttttactcaatagattttactcagtttttatgacgcaactcaacattacatccttcatgtttcataaaacaagttagaaatcacatacaacaaaatgtataatgtttagtattagcccatagtatgtcttctgatagtatcggcatatatatgtgactaatatggaaactcatctgtcccttagcattgtaaacaggaagtagaatgaagataattttaaaatacttcataaattttatttaaaagtttaacttagtctaatgttaattcgccaattagtagttcagaacttgggatgcattttcctattaaagatggttacagattatggtgatgtctccagactaacccatgaaagtctactcagcctttgatagcaccactgtatgggctataaattccccccccagcccctaaaaacggagagaaaaatacaaaattgagcacattgttttaaaatttttgtgcgtcgaatattaattaaatttgacttttctttcggaactagagagtgataaggagatatagagggtgtttccggctttgaagaggactttcaggacattcgcccgttctgttcatttctgttgcgagattaacatatgcttgtagggaaggacaatttaagaggacagaaaggtaaaaatcagcctcatcttcaaactgttgtcccactccttaaagataaacatggctaaaagtttccttctggaaatgttccgtgtgagagtggccggtctgaatatattccagagccagatagacctccgtcttagcatggtgtcagaggattgaaagtaaacagtaatcctaaccttcgccagaaaacatgaacaatggttccatcataatacacagaatgtttttttaaagccctgcttcccccattccttttattctgctttcccagttactctcaactctcttcccttcagaactgttcacgtgggctcttccactttctcctgcacttctgcgtttttcctgcttgtcttgctgggggaaagactcatttccaataggtcttttaaatatgcctgctgaggtggtgtatggaggagtggggattagagaaaaggaagggaagccaagccaaaggtcctccttagtgtgcgggaaaaagagagagagagagagaaaaggataactccctagcccatgttctgtaacttttttcactttacaagagagtgtagacatctgtctagattagctccagattagctaccttattctttttaacagatacatagtatttcatctcatggatatgccataatttttagatcaatctctgtcgtttccatttatgtgtactgtgtcaaacagtgccatgattaattgaatccatagggtaaatccacatgagaaattcctaagtggtaacttggtacatcaaaagttaggtccccctgctcttaaagtgaaagttatatttattttaaatttggataaccatttccaaattgtacctcccccaccacacacactaaaatgtcactctttcctcaagaaaatatgagaagagatgacgttgacttccgttgtttctgatctaaagccatttcaaaacgtattagggccttcatctcttctttcatcaaagcccacattatagggtaagatttgttgatattaattttgttgtccataaatagtatttttgtgctggtgggaatgacacttttgtgacgtacctgggaaaaaggcagaagaacaagaatgatgaagagacttaagttgtgatcagagaaagaggcaagggaggtgggctatgaaatctccatcaaggagaagaaagctgataagagtgagatttcagctcagatagttttctgtgctttgttgtcagaaaaaatgggggcaggtggagagagtggaagtataatgcagctggtagtttgtgtacctgccatggttacaaatcaggggtttgtaactgagagattgtcagttaattacatagcagccccattcgtttttaattttgcgggggattttttttttctcctttttttgagaaggtttggaagataggttgataaactatgagatttcctcataacagtaccttctactgttttcaagcaggcttttctgaagaactccagttgttctttcatgggtttttgtcagtgtgacattctggtacaggagtctgcagagcttgccgggtacatgttatagtgggaagacctgagcgcacgtttggtgcagccacgcgcccagcgcttgctttgggcctgccttcctgaccccgcatcccaggtgcgtattacagtgggaggacctgagcgcgcgttcgatgccgtcacatacccagcgcttgctttgggtctgcctctcccaatcccgcatctctccttgttgctcagatgttgttagcttgctctctgaggacgcttgtgtcattgtctctgacaacgaagctcattcctagagggcaggctgggtccttggctgttgtatctagtttagaacttttcctaatccatgctcatggagtaggacctagagaacaactcagagccagttctcaccccagaagaagaaataactatctgaacttcatccaacattctttccacgtatgttgtttgccatttattgtctctgatgagatttagagaattatttcacctgataaatgaataaatgttttcttctctgcttattaaagtgaacagtaatcttgtagccacttaatcatgttttccatgctgtagttttcaattaaagtatctttagtggaagaccctcgatacaagactctgagctctgtatgtgcgtgtgttcgtatgtgtgaaatactgaattatctggcatgcctaatcagggcctctttctgtttgctgtccattttgtaaggtttatttcttactgggacactggggccgtgatcacctgcacagtgatgggcgaagggtccgtcaagacccaagcatttttaaaaacttttaaatataagccttttaatttaattctgaaagactttcttaatgcagaatctagacataaaatccaatgaaaaaggaggtgaaagaggggaaaatagagaaagagggaagatgaagaagaaggaaagaagatatgacaatgactagtagatatttattacaccactgacttgcgcttaggcctcattacttatgttttacttttatggataatccaaggctaatatgagggtttaggtaggaggtaatggagaacattatgaccgatttctctggctcttcttttcttggaacaagagaaatgagaacatctctgcttcagccatctactcctctaaagtaccttgacttcctttagccctaatcaccttgcttgagatgccacctgtacgtttgggtaaagaccttcattgcccagctttgtggagtggttccagcactgaacctactggttggtgtgagaatgacccagccttgtagtcttacttctggaagaaaaatctaggacactctgtgcatggaactggcataagctctggcccttcaacacctctgaaaaagaggaggcagggtgccttgggcctactccttctcctgaatgtagcagctcttctgaccattgctgtcacctcaggcatttgaacaagtgttgcacattctgacagagctttggatgacagcagacaggcttaggtgatctggcagcttcacataccatgccttcatccagcttgcctatttcccatctgtcttaaggatgaaacaaaatgattgggtgctgctgatgtatgtgtagcccctactgggaaggggaggtgacccattcattgcttccaacatgctgctgcacatggcagaacatgcataaagcctgtgctttccgtcacctcctggccatacatctctatagtgtttcactcctggctagtagaggccactactcaaccatctttcagaggaccccatcttctgtttcactctggacagcattgccagaacctgctgctgaactttattctggtaactctccctgtagcaagagtgctagatatagtccacagccactttcagacaagagaattgagaagctgcttgttcctcccctgtccccgttatgagctccactgtgcagctgtcgtcctgccccaagtctgtgtgtgtctttccacatcaatgctagcaggcatggggctttaggaaatcagatctctgtaggaacctccatcttatttgtatgcaagaagtcgaatatggcctttagatatgccttggccggtaggagacagagcaagagatatcatttggactaaagaagcctgcccatcttctctacctgattctcagcttactgcatggcctcctggatgtatagatcatagttgatttgaatgggtacatctcacattcctgggtcaggcacttttactcatccttttcaacaaaaatatttatggagacctacctacttaaatgcactgtggtaaacgaaacaggcaatacaaagtcctcattctggtggagcttacagatagccttcaacagccagctgaggggcacctgtgagcatctccagaaaaccaggcctttgacaacctgaggaggaattgctggaccaaatccggcctggccagtgatggacaaggtttttagagtgctagagtaggaggccctgcagtggatcaagtacttatctctcttggaggtccccgattgattttcaggatttcattcatcattctactattttaaagcctcatatagagaatctagtgcctctgatttcccaaagccctccctatggctaaacccctgtttagctccacactgtcatcctctgagctggaagggtacccagaagccagggccagcatgctcaggccttggagtgactggcgtaaagctggaggctgtgctcatgaccagcttgatgggtgctagttggccaccagaggatgccttctcccagaagccagcagtccaggggacactgatgggggaatatcatcatttgacatggctttgtttatgcagctattttagggtagcctcattttgtttttattttgttttttgagacacagggtcttgctctgttgtccaggctggagtgtagtggtgcaaacacttctcactgcagtgtttacttcctgggctcaagtgttcctcccacctcagcctctcgagtagatgaggggggaccacaggcacacaccctgacaccaagctaattaaagaaatttttttttgtagaggcagggtcttgtaatgttgcccaggctagtcttgaactcctgggcccaagtgatcctcgcaccttggcctcccaaagttctgggattacaggtgtgagccactgaacccagcctgggatagctttagaatcaaacttaaactctcacctacctttactataaaataatgtgtaaaatagaggttctgccctgagaaataatctgcctaaaacactttcgggttctttatacacagttacagctgaccaagtgattaagtatcaacaaaaattgtgcagtggcatttctgagagccccaggaccgtgtggggtggagccaagaaagcctgtaatatgaagttagtggctttacatctggccagggcgacctgtgacagcatgattccacttgcatttctcatttctgcccctcctttgcctcccatccttacctgggacaaggatatcaattcctttttccccccaaaccccaagttatacataattcctacccatttttatactcttccctggctatgccaggaccctggaaacccataccttttctctctgtcatcaagacagtgaataggccggacacagtggctcacgcttgcaatcccagcactttgggaggccaaggcaggcatattgcttgagtcctggagttcaagaccagcctgggcaacatggtgaaaccccatctctactaaaaatgtgaagattagctgggagaggtggcatgtgcctgtagtcccagccaccagggaggatgaggtgagaggatcgcttgagtctgggaggtcaaggctgcagtgagctgtgatcacgtcgttgcactctaacctgggtgactgagcgagaccctgtctcaaaataaaataaataatataaaataaaataaataaaataaagatggtaaatagcagagctcctaatttcaaatcagaagtgataatcctgcactattaccaccttagagaggcccaagttctggtaagaagtacactgatcaacactgggttctagagaactctcctaagtggcagtgccacctgactccccttttggtccatacacataactcatctctgctggaagttggaagatctgccccccaaaccccctcaaggtaactggaggtcttcaaacctttatcttaaagcacggtgtaaaatatcctcccgatgccaaattcctccatttgactttcaccaaatcctgctctttctgataatccaatcccctcttttaacactcaagctcccagtcaagaaccatgtgctaaggggagctgctggatttcctgtaacagcatgagtcattctaggtagcagtagtctactgggaaaagttcagaccaggagggagccactagaatctactttgtacctttggataacttcctagtgaaagtttttgtccaacctggagggaccccagtcctgtgcctccttggttgcagtatccaaggaaaacagaagttcccagctatagctttcacccagcccatagatgctcgtggtcctaaaaggcttcctgaactctaatgttttagatactaattccaggatctgtcttcagaatccatttgtttttctgtctggcctatcctccttggagatatttcattctggctcatatactttctctctgctcactgtctaccttctacattctcctctgctgctcctccctacctgcagcaaggatacctgtttccctttactccaaaatcccacagctgtggaccaaccccacttattccccgtctaccttgcttggctcttgagccaccaacccaggccaggacataagaaataccttttgtgggcctagcacagtggctcacacctgtaatcccagcactttgggaggctaaggtgggaagataacttgagcccaggagttcaagacagacctgggtgacacagcaagacttcatctctactaaacataaaaaaagtagatgggcgtggtggtggttggtgcctgtagtcccagctatttgagaggctgaggcaggaggatccctcgagcccaggagttcgaggctgcagggaaccaccacatgctccaacttgggttaagagtcagtctctgtctcttaacaacaacaaaaaatccagtcaaggtggctcatgcctgtaggccttagcactttgggaggccaaggtgggcagatcacttgagcccaggattgggaccagcctgggcaacatgatgaaaccctatctctaccaagaaatacacacacacacacacagaaaaaaataactcggcatggtggctcaagcctatagttccagctactcagaggctgaggtggaaggaaggatcacttgagcccatggaggtcgaggctacagtgaaccatgttcataccactgtattccagcttgggcaacagcatgagaccctgtctccaaaaaaaaaaaaagactttatctctgttgcatttgcctgactttcagtataaacaacttccttgtggaataagatggaagccacactccactcctgggactaggtcacctgaacaggaaaacatttaattgtttgtggttcaccagtatgtatggggctaggtcacctgaacaggaaaacatttgtttgtgttgaccagtgtgtatgagcaatatatatgatttgagaaattgtgtttaggcttcctatgttgtgaaagcatttccagaataagacattttccattgtagttcaatttttttttaacttgaacaagccatcactgagcactttgactttcctgatagaaaaattttcagtttcttattacaacaaattgtactctaagcagcaggataccaaattcctagggaatcttttgggatgcattgaatttctcctgttgaatcagtctcttgtttggcttccgtgcagctaccaagctgctctcttttctttttctcacctcgtggaagagaaagtaggaaaaaaagaaatcccatttcccctgtagggagccaaaagaaatcaggtgggcctgaaaaatgggtaatgaaggataaaactttgaatgactcaaacacattaaaacccattttaattttatgtaaaggacacacttcataattttgaaaatatgatcagcacgcttacatgctacttgtgtattttgagtgaagttcatatagagttttcagaaactcccgaaggatagatggatgggacttcagttacaatgcaaacataaaactaacttgtcagaccttataatatttgatcgcttgtagagaaggataatggcatttataatgagcagtaagaggtccttgaaagaaataaaaagtggggtataaatgacccccaaaattacagttatttagagcaaggaaaatatcttctgggctggttagtataaagctcttgagctcgtgagatagaatggaaaaatgtgtactattcttattgttagatgtgttaagggaaatggcccagccaggttctggggaactgaagtagcaagggtggccagccatagcctttgaacagggagagagcaggggcttgggagtagtgagaggagtggagacagtgccctgctctgcaaagagggaaacagatgatggaaattgctcttcctgcataaaggacaccaatcataataacactgcccttcagtatgaaagaggaacaaatctgctctcacctgtaattggaaatagcaccgtaatgtcctcccaacgtgagataaactggattcaacaatcataaaagcatctgccagctattggttagcatcatctttctaggggagtaggtgaaaggactttaaggactctacctttcaactttctttaactgaaaagtaattgctgttatttattaagaggctactgtggaccaagcaacttgcttgtccttctaatcctcacagccagagtgagaaggatgttaacctctcttgtcctctgtggcagaagctgaggctgagacttagtaacttgcacactccatgacggagccaagattcaaactcaggccatggattcatttattttattttggctataattttttaaagcatttgagtcagcctgaacccagattggctttgttagaaaagtataaactattactacactacagagggctctagtggtctttccactataccattctgttttcctaccatatgactctgtgatgctaattttaatacaagtaacagaaatccacctgagcaccttcacgcagagtagaatctgttgcctacacactgcacagccagccacagatctactgcgatggaattcagggatgcagtctgggccgtcggactgacgtctggctcctttgctttcttgctcttgcgttctttttctctccctccttccttcccttcctggatgctgtcctcattcttcctcacagtcttgtccacagcgtggtgagacagatggcttccagcagcttcttcccccccaccccattcatgttctgctatctgtataacaaaagaaaaagttctattccctccagctccagatttaaaaactgtgtatttgggatggatggctttggcctttgtgggtctcacacccaaccctgcctggaccgagggagatgaggtgctggcagccctgccaaaaatgcaggtttgaaatgggacagacattcttgaaaacctaggagggtgggtgaactctggacaaaccagaagaatagatgtccactgtactattccactcagaaatagtctaataaacatttcagatagaaaacgactcaaagatggtaaagagaatccaataaaaagactgatgaaaggacaattacatgagagagaaggaagcagcagctctccgccattatgttatgcactggggattgagctttgcaagagcaggttcttagaatttccaagggaacagcaggacccacttggaccagagcacaagccagccatttaggaggaagtctgagagctggaaaaggaaaagatggatctctagaaagcagctgaggtcctacctggagcaaagaaattatgtcaggacctgatgtacctgatggcagtgtgtgacatactctatggaggttctccagttcccctgtgtgctatctccttctggctacaggcattaagtaatatagccagaatgctacaaaatgtagcatttattttggaaatgctacagaaacagtgcaccttgatatcagcaaggcatttgatagtgtctcctggcacatttcctatggatggaaaaataggagttagtgaggttaatttataccttttaaatagctatttctgaaccatagtctttcacagattgatagacccctttggggaaatacgcagtggggtatatgcctcaaagctcagtgtttttttggtcttaatggttctcattaatcaaagacttaatgagaagaatacgtagaagttatgtatatcaaatatggaagggattcaaagcagagaagaatcttttggagagctgaaccaaagttcaaattaattccttaatcagaagcatttggcatcaaagtgagtaggggtacacggaaaagtcttcatttggaagtaaaattcaataataggctggagaaatttttctagtgtttagtagattatttttggtttttccaataacattaatttctgcattctttcttaatataacttcaaatgggtcctagccatgtcgtgtgtatgtgattgaccacagaggcagtctgtctgtgattggctaaagctagaaaagtcatgtttccctggtcatgtgacccatgttagccaggtggcttcatgttggagccgtgatggtcgtccgttcttggcctttcattcgaactattaagaaagaagacttctcctttactactgctcataactaagggagcatagaaccctaagactgcaggccgttagcgttcttgggactaaaagagatcagaagaaaaaaaaaaagaaaccaaggaagtagaggtgagaaatggaaagaggaaaaccggatcctgatcacattgtttaaacactgcctcagaccgcatttactcctgtactgttgagttgcataagcaattaggctgataaactttatttttacttcgtcagcctatttgaattggatttcttcgttcatacaacataaaaatcataacatatatctggggggtccagagagaacagtgcagtgcagtaaagctaatccaaccttaggctgcattattttaagtatagtatcaacatcaaaggatggggtacatgtatccatcaccccgtctagacagtttctagctgaggatgaccatcatgagaagaattctgtagccatatgatgagaaatggctgatgagaactggaggtatttcatcacaaggttaaaagactgtgaaggagagggatacctgctgtaaatttccaaacattttaaaaggctgtcttgtaggaaggaagaagagttttcctcctggccagaggaggaggaactaggacttgttacttggaattgaggaaagacacatttcatgccagcaaattaggaagaacagtttgtaacacctcaggtacccaataatggagcatccaacactccatcgttggaagtgtttacataacaactagttgacaacctgttggaattgtacccaaataattcctttattgaataggaggttgcccacatgactgtaatgtcccttctagctttcagattctgagtttcaaaatcctccaaaacttctttagtctcagccacaaataaagtacaaaacaaactaactcagctccaattctcactgcctctcttgtcatgagttatcatgtggtccataaggttaggaccacacataccctttccttcctccgactggttccaagacaacatcctgaggagttagtatagctttggttgcttataattttttgtgtaacttggtggtttaaggtaatacaactgatgttactttgtttcacatatatgtatatgcacatacacacacacacacacacacacacacacacacacacacatatatatatacacattcatgtatatgaaacatttctgattagccacatggtggatattttaatgaaatatttgctaacttctaaaaagcaggagattttattttatttttttaacttagatttctagttttgcctggggaatcagaagactggtacagtggatccacatccccaaagcagctgtagctatgctgggtagcagctgccttcttaaacctggcgtattctctgtcagtttgccaaagtctccactagttccccaccaggctggctttactcgtccacatcctgtctaccccagtgggctcgtaagtgtgtgatccctggcctgtgttgctttcttccctaccagccctcactgctggcagttcccacagcagccatcatgagtgggagagtattaagacatggaagcatgctgtgtaaggctttctcagacccaaagaacatgagagagaaaaaacacaaacacttcattcccacccatgaattttctattaaaatgtttttattttaaaaaaatacatataagctgggtgtggtggctcacacctgtaatctcagtgctttgggaggccaaagtgggaggatccctcgaggcaagaagtttgagatcaacctggggtaacataggaagaccttgtcttacaaaaaattagaaaattagctgggcatggtagggtgcacctttagtcccagctcatcgggaggctgaggtggaatgatcacttttgaccccaggagttcgaggtaacagttagctttgattgtaccactgcactccagcctgggcaacagaacaagaccccatctctaaaaaaaagtaaaataaaaattaatataaaacgtggaacttttcaccagtggagatgagtgaatagaatatatagtctgccgatttatagaagtatggcatctggatataagttaagtttcttttctcattaattcccctgttagcagttgctaattattattatcaaagtcggcttgctgttccccagggcctgtagtacaagcatatgacttccttcctgttgagtagtggtttccagagtgtgttctgtcaggataattgttccattgacttgaaatgaaaagagaatcctggtcaaatgaatttgggaaaagctaggttaagtaaaatggcttcaggtcagttggccgaaaatcaattatggaaagccaattcatcaaaagccagttcactgtacaccaagtccacgaagagcctagttttcagatatgcacatttacccatgacgatttagtagccctgtctactaagtgtttgatcctgttttgctgacaatgaaagatgcttttctgaatatagtcatgcattgtttaataatggggatacgttcggagaaatgcgtcattagatgattttgttgtcacgcaatcgtcatgaaatgtatttacacaaacctagattgtgaaatcctactacacaactagactatatggtgctccttggctacaaacctgtacaggacattattgtactgaatgctgtagccagttgtaacacagtggcaggtatttgtgtatgtaaacatagaaaaaatagggcaaaaatatgtcataaaatttaaaattatataggtgcatagggcagctccagtataatcttgtggaacaactattatcacatatgcagtccattgactgaaatgttatgtggcacatgactgtattaactaatattaagatgtttcctgtctgaggtatcagtagaaaagaaaattctaaaatgctggaaggctgacaacagaattcggcatcatttgaacaattcctatatgaaatacaatttttctacctgaagttttggcatttcatatgtgacaggattgtttcaactacattttatttttttatatgctttaaaaatgttattttattttgtaaagaatttttaatgttctttcaccaatttgtaaatagtttaaccttaattttgtgtttccgtccgtttagaatttgaattagatctaagttaatttaaaattctgatgtccttgagatgcatttgaatttacatttaacttaaatgtttaattgttagaaatacacaataaaggccagtaggtcatggaggaaatgagggaaagtaaaccttagaatgcttaaaattttaagcaaagttaaaaatgatatccagaaatgtccaaaagaaaccagaagtagtctaaaaatctcatttgtaaaatcttctctgtttatattaatgtgtgctctactcactttttggctatttaattttcttttgcaacttgcacattcctatcaaaactttgaaaacaatcccattgtgagtattaaatctttattttaaaaaagttggtaaatttagtaacatcggcaaattaacagttcatcaaattggtctttcagcaaattgacctgtatttaaatgaagtcaaaatggtttatattctacagaacttctcagagcttttaataacttaatgtatgttttgaatctgtaaaagggacatcaagaatgacagtatctcccaaagttaagtaactggacaactcacggtctgtgaaatgctttcatgcagtatagtttggaagtgcgcagctacccaaatgccaagccttggctctctgcactgcttctaggatctgtatttaaaagtcccgttaattagttgaaaaaaaaagtttggccttatatctcatttttaaaataaaaagcagtgggtttcttctccccctgggatccctcccttttcctttcagacctgctccttagctgcaactttgttttttttttttaaccatgtctgttttcaatacttctcagagttatatttattacctctatgtagtatttttagatttaagtttcttacaactgaagaagtggtccattcctaggtatgaaaaataaagatctagcttttattatgttcttttctctattctacatctctttttccatgaaggtaatagtactttaattcttttattggcaacctgtgacacctcaaacactatattgaaatttctatttcttgttccatcaacttcaggcagtatctcttgatttcccactattagattgagatttagtactcttgttcttggtggagaattagaatataaaattctccattcaaaataattttcaatgaaaatttcaaaagcctattacacggtctcgtaagatctgttatttctgatgcttcttggcttctggatcctttgtcaatcacccgttttatcttttctgtaaggttttaggctctgctctgctctttgatgttctgaaagttcacactgatgtattcggcatgggtatctttttcattcctacaagacccttttattttaaacattcttgtcttcctttagctctgggaaaagttttccctattttttcctttttaattttatttcctctgtttttctgttctttcactctgaaagtgctggttatcacatgttaaacttctctttttctagtgtctgggccttttgctttatgctctagggattatccctgacttcattgtgcagacatttaatcaaaattttatctcttaggaaacttattgttttaataattcacaagaactctttcttgtttttggatagttcctttttcatggctccctattcttattttgtggatgcagcatcttcttgagtctctcaaaggataattggtcatttaaaaaattgttttttttttctgaatgaactgagtgttcttcatttttccccctgcttattaattctgctttctcttgctccaagcttttcttgaattttagatgcttcttggttgtccgttcatatttttaacaactttattgagctatcattcatataccacataactgacccactgaaagtacacaaatcactgggttttactgtagtcacatagttgcgtatccatcatcacaatcaatttcggaacattttaattaccctcccccagaaaactatgctccttggctgtcaccccctcattctcttactgtcgcccccgcctccccaggaaaccgctatccattcctgtttgaaaataaaggttagaaaggctggcctgggctgggcacagtggctcatgcctgtaatcccagcactttgggaggccgaggtgggcggatcacgaggtcaggagatcgagaccatcctggctaacacggtgaaaccccgtctctactaaaaatacaaaaacttagctgggcgctgtggcaggcacctgtagtcccagctacgtgggaggctgaggcaggagaatggcgtgaacccgggaggcggagcttgcagtgagctgagatagcaccactgcagtccggcctgggcgaaagagcgagaatgtctcaaaataataaaaattaaaataaaataaaaaggctggcctggtgctgtgagggtttcaaaatgagagtgagtgagaaggcagtgattggcaaggagagggcagagacagaggtcaagcagagctcaccgcccagaaagccaggtgtggcatcaggacctcagagagccctgagaggggctagtgctgcagacgagcaatcaagccattccactgtgatctgcctcacttccaagttcaggattcagaggacattctgaatagatgtcctcccatagatgataatgcaacgcctctagattttaggtttcatacgggtgggattgtatgtctcctgcacagctttatttcctgcacctcacatagcatacattaagtattacagatttatagagtaattcaacatcatgtatttatataattatagtttgagatgtacatttatatacgtacctcttatttgagataggcaggtgtgcaaagttagattcaccatgacactaacgagacttaaactgtagggccttccacttgcaggagcccctttgaaaactctgttcccatttctgcatttgtcaacttggcattcttaaagaaggtatacaaaatgttaggcatcagaacacctaaacctagacctacatgtatctagatatagcagaaattatgagtccccatttagagctctgaaagctgtggctcagagagttgagcacctcacccaaagccacacatctaggaggtgggagaacatttcttacctgaatgatttctcccaccattagccctcctcatcccccgcagggtgaaggtgtggcttccaactgatgcctattcccaggacaccagccactggaaacggtgcaggacctgggttacacccagagcagccctgatgctgactcttcatgggaggggtctgtgccccctaagcccacaggcttcccctctgtccaatatgaaccaagcgaggagagcccatgcaccccacccacacacctgtcattgcaattttagttgtgaaataacttcaaaaatattttctttgaacaaaagaaatactgcatcttttccacttctgtttctggatgacacttttaatctcatgttgtttcatggccttaaaataaaatgtaggacctaaggggaatggaaaaaaaagtcagagatcatattttcaactgccaactaattcgatgatactccctggtgggaaaatcaatgtctgccctgcagaggtgaatcacacattccattgtgttatgccgttgacttcctttcttctttgaaaattaactttaccctccatgcttttcaacctttcagtgaagtatatttcatgccttgcctttccccagacacaaatgtatgtgttctgagtagaaacctgagctggcggtgcctagaggagatagtctgagtgtttcagaggattgaactgaattccccgggggtggactagaagtctccgggtgtctcgggctgagtttccaaagacctcccggcacctaaactaatgtggaaattggctcctggaaattctttttcctgaagttattgatccagtgagatttgggaaggctaaagtctcctgggtactaacacagtgtgataaaaaatgcgaaggttgcagaggcttcttttctgtgcttcttccctcgtgtacgtgccctcatctcccacgactgcaggacagagaatcacccagacctggtgctgcctgctgcttgttcaggccatagaatgcctcttccctggaggtcaatagccactgctctagcccctttgcccagcctctcaggcttgccaccgaggactttcccagaatccaagaagcaaacagggaggatgccctgcactacgggggatttctaggacccgtctcccagctgtggctgccatctcttcttcatcttcttcctctccttcttcttcttcttcttttttttttttttgagacagaggctcactctgtcaagtagctgggattacaggtgcccaccatgcctggctcatttttgtatttttagtagagatggggtttcaccatgtaggccaggctggtctcgaactcctgacctcaggtgatctgtccactcagcctcccaaagtgctgccactgcgcccaactactggcatctcttctgattggtcagtgacgatgccgtgtcttaggtaattgactatcaaaatattaaataattaagttgtggataatttgaaagatcatccccactcctgaaaaatcctgttgaaatggacaataggctgtttcatctgtttgatgccctggttccttggcaaaccagaagccaagttatccacttaaaggttgaattcccggggctctgctcagggcgtgcttgtcgttttgctttgccttgtcaaggtttcatcaacactggtgacacaaaatgagacattgaagccatcactgaaaccgagtcgggacattgctgtgagtgtaggaccagtcccctgctgccagtgagtgctctctgagttctacttccttataagagcaggtacaagccctgaagaatggatgccacaagcaaggccagctttcatctgtcagcagcttcacatgtttaggacggtccactgactagaaatacgcatcctagagaggtgcccagcagcggatggaacacacaaaccccaaccgactcggagcatttgtgccttaggtggcctttggctgagcctggaattaaccttcataaacacagactcctctctcaagaacttgccttgcacgaagacggctccctatggccagccctgaatgtgctattgtgagtgcatggtcagttcaggaccgcacggaggatgggaaggccagtggctatgcgaggggagcacagggatgcgggttttcagactcgtttgaaatcagcttcagtttctcctcagctcaactgaaaccaggctgtcttggactgtatcatagcactggcttcattttctctcatcctcttcaagctcctgcttctgtttatatccagctgaaactctcatccttctctcctggccacagaagtagttaaaataaccaaattgccaatgattcgtttttgccaaaggatatttttcgatcttggagacgtctatgagggtcagatgggtggctaatgtttggtaggagttgggagttgaggtgggggttcttggttctggcaggaatgagcctttgttgtctctcgaccctctctgagagcagagagagcattaactagcaaagcaagttttcgctgtcctcttaattcctgcccacaggcactgttaacgctaacaagtcacgtcgacggagaacagaaggaagaccagccatgataatgtccagagaggatcaaacaccttggcctcctgctaaaccctggattgttcagaaggacttgcatcagggcgctgatacctgtttttcctaatgatcccatacagtccagagagtgtgtgggatcattagaaaggtcccctgcccctgcagattgttcttgaggccttcctaaaactggggtgttagagtaccaagcttgtgcagaatcgagaccgggccatctggtatcaaccatgagacagtccctagtgtaaagggagcttggagtgaaagggaattccatgtttgttactaattttctctgtgccaggctaaaaatatttcagcagattgtctcatttgagctctataatatccttgtcaagtatgtatttttatccccattttacccatgagaaaactgaagctcagagaaattaagaaacctgcctcaggggccgggcacggtggctcacgcctgtaatcccagcactttgggaggctgaggtgggcagatcacgaggtcaagagatcgagaccatcttggccaacatggtgaaactccgtctctactaaaaatacaaaaattagctgggtgtggtggcgcaagtctgtggtcccagctactcaggaggctgaggcaggagaatcacttgaacctgggaggcagaggttgcagtgagccaagattgcgctgttgcactctagcctggtgacagagcaagactccctctcaaaaaaaaaaaaaaaaggaaacctgccccaggaactaggatttgagcccaagcatatccaactccaagtctcatgcattttctaccgtgccactcttcttttggtaaaaggtgacaaatttttaaaaatgaaaggaatagttgcccttatgtatctgtaagttcactttctcatataatggaaaaggcccatgttcctataacgtgggaatgtcttccccaagagactcactatatgaattgttgatttgatggatggccctatgcgcttatgtatgcatgttacccaccaaatgctgctgtcatttagtgggacaaaaatgtaaccccataccctaaaagaccttgtcaatagccaaggcagagcctgggcctaaatgacactaggatctccctttctggcctcccatgtacgggctgaaatggtgattactccctgtgttgccgtgatcctccgaacaggaagattgctccactggggctgctcagaactgtgaaatgaggttggctaggatgtctattataatttgcttcctaaattttcagcttacccacctgccactacagtgttcctcagaggacgttaagatgtagtatcagagaacagaagttcattctattagagtcaggtatgagtcctggcagttaaaggatgcaaaggttagtagggggctggggtgagcccatcctcattcacagtggtccaatgagcaggcagctctgatacgattttggaactcagtgttcgcatgcttacctgcctgtctggaccatttttactcccggatatcgtgacaaaggtcagccacttccataggactgtcagtatatccgtgcatagctcacagacgtgcaagcagagccttcccaggggtgtatgagaggtcaaagaaatgcatttaaatgcatcagaattgtgactgaggatgtcagaggctctgaagagcattcctttatgaggaagcttgccacagtcaggcagctgggactcaaagcagattcagctggctcagccctgttccttcccctctattcataggttcaggtgaagaaagggccttaagtgaaaagaggactctgtgatcaaattagtttgggaaactgtaggttaaataaggttactgcaggatgtcccagaacctttacagtacacttgattctaaaataaaaagcccatgtttttatacttcaatgtttctaaaattagagtaaactttggaatcagtgtcagaagcggggatgggcatagagcaagttaaatgaggtgcatggggtgcaagattcatgcgggtgagaccctgagagtgagtgtgtctggcttctcacgccaatgagctcccggccctggccaggacgctgaggttgtccctgcctgcacaagatgcagggacctagccagtctttgtacatgcttgcccatttgatggcacctcaggtgagttcttaaaatagggagtccaccaaagttgaatttaacttagatcccttcatttgctacaccttgcagtggaaaaacttggcaaacactaccttaactaagggatcaggttagcttcacaagtgaggccatgtggctgccacgtcccctgtgataggatgtaatgagaagggtactttacttctgtggcattttttacaaaaatacctccatttagtcttgagaaaagcaagagagaaacacagatcagagtacattgtacagtacatttggccaggacgcttcaagactgtcaagaaaagattgagaaactgccacagagcagaggagactgaggcaacatgacaactgaatgcattgttgtcagaacagaacataaaagagacgtgggtagatgcacgggtgaaatctaagtaaagcctggggtttagttaatagtcacataccaacatttgcttcttagttttgacaaatgttccttggtaatgtaagatgttagcaacagaggactgggtaaagggtgtataggaacactctactatctttgcaacttttctgtaaatctaaaattattccaaaatgtgtattttaaaaacattgttatgaatcagcattataaaagcaggttttttttttttttttgtcacatattccgggcagtaattaaaggcaacagagattgccaaatgtctaggaatggatcgtggaagcttcactgtgcggagaaggtggtttgacagttcttggaatgctgattcccccattatgaagaactatcactccatctccaagaatctgtcaagagcttccagctgacacttagcaaagtcaatacctttcagtcacgttattcaattaaggaaaatatgaaacaataagcttataaaaaaaggcacatgaaacttgaatatttctttacaggattcaacattatgttgtttattctaaggatacaaaggagaccaagatcataagtttatgaaaagcaacttgtccctctaagattccatataacttctaatggtcaaaagtgactcagtgaacccttagactcagatggcaaagagtgattagatgcaaactgtaactgagatactaaagaagaaatcctgagtgctcatctagataaatgtaggctcttactgtgtgttaaaaacaaaactatattacttataatcaggtgtcgtcttctcctcaactctcaaaaaaaaaaaaacaaaaaaaacattaaatcgatgaggagcttaaaactgatgatgtcttagaatcttagaaataagacaggggtggaatgcattgtcccaaacttaactgcccatggaaccctggagttccatggaacacactttgggaaagattgctccatcctgtttgctgcctgttcatttgatgtcggataaattcccagcctgaaggctgtcagggttgcagccattaaatttcagaaggattgtgctaggcagacatcttttattgagaagatctgaacccagagacactcattatataaacgagccccgaagggtgagacccagcctcttgaccaggcattattgagccaggctttaggttagatgagacagacagatcctttctggactgaatgtggtaaaagatgccccagacctgcccattcattagaaagtaagcccaaaaagcgtggaggtagacaaagttggcaaaggcctcccctccctcctccaagaaaggcagtgagctttaggaaactgatatctgttactcagagaaaaaacaaactgtactctttgaccgttgatttaggcaatgtccggcaaagtttccaattcaaaacgcccaaattaggaaccaagattatccctcacacacgtgcatgcacacttaaatcatttggccatctccagaatcagtgccattttcagggccagtttgaggggtggccacaaaacctgacttggccgtgttttctgttcccttgtcagtgatgagttgaagtgtcgtttcagcggctgccctcacaaaggatctattaatacaagccactgctccagacttgacctccagtcactggaaaacattgaaaacaacttcaaccaaatgaaaaaatactctggcgaacttggtccaaacatcgacaacctttgtgtgagtgatgctagaaagtggtctgtgtggcaggtgcgtttctcactgatggaaacttcaagttgttagtggttcttctgggacaagactgtaagggcagttgcccctgctgtggcagaatagcacatgagaaagttacccaggtacctggtttaccccgaaatattcatgtctgagggtgtgagaggacccatggcacttatcaaaggtcttggccaaatgctagctccttcccattggtgaagatgaggaaaaattgcttgctatgcatatgtcatggctagcattccatcattgttaacagagcagctacattttagccagctcatcgtttgaggccttttgtgtacctctgttgtgaaggacagtaatttattagtctcagtaagatacagaactgtcatcatggaaaagaataactgagggtgaggccctgctaaaatattggggaatctgtcattcacacaaacgtggaaccggatttctgaagtccaaatgctgtttacttgggattagctctagtttggtaaagaggtacgtgaagtttggatgaggttgttgatactgctgtttgtggtgagagaaaccaggccaacacttgtgatctgtagcgaggaggggggcaggaccagctggcaagaggccacccaccaagaatctatgtcttgctctaaatgccaattctaaaactcaacatgggcactgtggaggttaggaggtgacatgaggagaggaagaagaaagaaatacctgtctcttctggtttagagataggtgttgcctatctcaagtgagattttagtgaatcttcatacagctggtgccactctagcaaactgtaaatcttattagtgggtgggtgttgccaggaaaatctgttatcgctaagctttctacttcctacagtagtctgagcaatatctgttgattactatctgtcaccaatttttggcccagaaacttccccagaggggtattctctatagagttacagaagaaaaacagcaacatggtgcccaggccagttgcctacccacacactgataaggtttggttgtgtccccacccaaatctcaccttgaattataataatccccacatgtcaagggcagggccaggtggagataattgaatcatggaggcagtttcccccatactgttctcctggaagtgaataagtttcacaagatctaatggttttataagtgggagttcacctcaacaagctcccttgcctgccgccatgtaggacgtgcctttgcttctcctttgccttccgccatgattgtgaggcctccccagccatgtggaactgagtccattaaacttctttcctttaaaaattacccagtctcaggtatgtctttattagcagcatgagaacaaactgctgagatcatcttccactagttctcagtatatcttcatactatgttatgtacaatcttttttgacatgtaattcatataacatataattactcatttaaagtgtactactcagtggcttttagcatatttacagagttctgcaatcatcaccacaatcaattttagaacatttttatcacccccaaagaaaccccatactcattagtcataccccatctccccagccccccagtccctagataaccattaatctgctatttatctagatttgcctattctagacagtttatataaatggaattataaaatatttgcttttttgtggctgacttatttcacttagcatagtttcaaggttcatgcatgttgtggcatgtatcagtattttctttttttgccaagtaatattttatgaatgttgcatatttatctatcaagtgatggacatttgggctctttctactttttagctattaagaataatgctgtgaacatgtgtgcacaagtttttatatagaaatatattttaatttttttcaagtgtatatctagagtggaattaccagatcatatggtaagtatgcaattaatattttgaggaactgccaaactgctttccaaagtgggtgcataattttacattcccaccagtaatatatgagagtaatacggagagtacctctccatatctttgctaccacttgttattacatgtcttcttgattttagccattttagtggatgggcggtagtatctcactgtggtttcaatttgaatttgcctgttgtctcatccgtgaaagggccctagtgtggaacctcaggagaatggaaactccccctgctgtgtttaatcttatatccctagggcctagaatagtgcccagtgtacaataggctcccaataaatacttgttgattgattaaatattcaatacttccattatttaatccctagaattaagttagcttcttataggttagttataaggtgttctgaaaccatataagtgaacttttcatactatctcacattaaaatctgttgacctatcttaaaaaaaaaaaagtgattgtcttccttctggagggcagtacagaaaaaaaaaaaaaaaagccaggctaagaaggtgaagaggacaactcttgggtaagtgtgagttagtaagtagaatcagaaaaactggccgggcgtggtggctcatgcctctaaccccagcactttgggaggccgagtcaggcagatcacctggggtcaggagttcgagaccagcctggccaacatggcgaaaccccatctctactaaaaatacaaagattagctgggcgtgggggctcatgcctgtaatcccagttacttgggaggctgaggcacaagaaatgcttgaacccgggaagcggaggttgcagtgagcccgagatcatgccactgcactccagcctgggcgacatgagaccctgtctcaaaaaaaaaaaaatcagaaaaactgacatccatgtcctaatatgtatcagaagcctcttctatctgcatcaggttttctccaaagatttacatcttactgggataaaaatgtgtacatgtacccaaacattacaccatgccctataaatttgtacaattattatttgtctattaaacatacaataaaacttttaaaatgtcaaaaaataagcacataatgacctatcatcaaaaaaaaataatgtgttcaagtgtttcattaactataaaatgcttcagaggtgtatgacttcctttctttttattggaaagggacatgtagatggctctaacaatacagcaaacctgcaaatgaggtgaatctatattttctagaaggtgtcatttcattttcaaggtactgaagaaccagatatcctttaataatgttaatttattgaagaattttgaggttataaaatgttaatgcacctctctagtctttcacactttactctggagagaattgcattttccctggcccgtcttaaggagcaagcaatattgaggtgggaggggacagagggagaaggacagagtgtctttatttaatatgtggataaagactaggaatttgcattgctttttattcctttctttctgttcagtattccttttcatctttttttccctatggaaataaaaaggtagtactttcatatctccttaaaatgactaaatgtagaatttaacctttctttcctcgtgtctgcccacttcaggctttagggcacaactctgtgctgcaaaatgataaagaatcctggttagatgggctcagcagcaggagaggacagattagaagacagaagactgggttctggactcggctcctcattaattagctctgtaaccacatgagtgacctcacatctctgggtctcagtttctcacctggaaaataagtgtgataaggcagggcccacccagctcttagattgcataaatttatggcatagccagtcaaaaagcattcatcaagtgccctgccaaattccaggacactcttaggtggtgggatgggaaggggaacacactttcctccttggaagatcatagagtaggacatgatgctgctatgagagtgtgtgtccaaccgaattcagccagcagagcaaaggagaagcgaaataccgggagtgcgtgtgggaggattttactgtctggaagaagtgagccttgagctgcatcttgaggaaaccatgggatgtggattgggggagaggtcacgtgggccggaggcaagtggaatggagcagagagccctgggccaggcatcgtgagttcgaggcatcaccccagctctgtagctaatgggcagcgcagccacaggtgtcacctcatgtatctgggcctcagtgtcgctctctgttgtgttgatcatctctaaggctcactggaaggcagtaaagattagtgactgacaacaggctgtagagtcagagggagctggggaaggtcagaggtccagattgctgcacttggaagcagtgtggccttgaacgtgccgtttaatctccctgggcctcaactttctcatctacagatcacagtcataaccctgaagtttctgtgaaaacgtgtgagaggctccgttagcgcagtgtgagtgctcaacaggtagcagcggtggctgtcattgtattaaagctcttccgagagtgaagctgaattaaaggagtgatatggttaggttttgtgtccccacccaaatctcatcttgaattataatccccataatccccatgtgtcaaggaagagactgggtggtggtagttggatcatgggggcagtttgctccatgctcttctcatgatagtgagtgagttctcttgagatctgatggttttgtaagcgtttggtagttcctcctgcattcattctccttcctgccgccctgtgaggaagctgccttgcttccacttcgccttcacctttgccgtgatcttaagtttcctgaggcctccccagccatgcggaactgtgagtcaattaaacccctttcccttataaattacacagtctcaggcagttcttcatagcagtgtgaaaacgaactaatataaggagagagttttaaggaagcaacttgatgaaatgggtcatttaagaaacttggcgtgggaaataaaatgtagtgtttccagccttaataaacaaggaaattttggctggatgcagcggctcatggctgtaatcctagcactttgggaggctgaggcaggaggatcgcttgagcccaggagtttgagaccagcctgggcaacatagtgagaccccttctctatttaaaaaccaaaacaaaacaaaaacaaggaaatcctgtcacatgctacaacatggatgaagcttgcagacactacgctaagtgaagtcagccacaaaaagataaacactatttgattccagttatatgaagtatctaaagcaggcaaattcaacgtaaaaaggtggttgccagagactggagggaggagaaatggggaattgttcaatgggtatagagtttcagttttgcaagatgaaaaagttctggatgactgttatacaacagtgtgaatatacttaatagtactgaactgtacaccttaaaacctagtggcacaaatacatgatgcatattcttccatttttatttaacaaatatttaattaaatacaacatagaaagcagatgctaggtactagatgtaggagcagagatagatgattaaggcagaggaggtctttgccttcataggaaggtcgtttaggagaaaatgacgtggagttttcgtagagtgacttcaattctagacccagatacgtcattactcaggcagtgaccttgggcaagttacttaattcttctaaactttagatttctgtagatgtaaaataggaataattagtatctgtctcacagattgtcataggaattaaagaaaaatgtatttagaataatgacacatgttcagcatgctcagtgaagttctgtttcttgctgtgctcatcaattcctctctcacaggggcttccagactcatggaacaggtaggagaaagccctacccacaacaaagcccacaaaggcatttttaaaagctgaacagagagggggacaagatgcccagggagggccacgcatggcctcggcccgcctagtgagccccttccagcctgaagacacagaagccctccgcccacctagtgagcccctttccagcctgaagacagagaagcaggccagatagaggggccgcctgtcaatctcatcccaggtggaggggccgcttgccaatctcatcccagtaacttcccccgtagtagtttcctctagatatgagactcaggaacaactgaagagggacttaaaccacaagccgaaggtgtggagccatctagaggagcttgttgggagccgttgtgggtttccaaatctaagagaacgtagggagatggaaaaagcttcccaagagtgatggctgacacacgctggcaaagattacagggagaggtggtggaatttcttcctttaatgtctgtcttaaggcaaagctgcattctcacgtgtctgggtggctgttatggggtctactctgagagtaacacgtccattcctgctgagctcttggcgagtttacattttcctgttttgttttggtttttttcttttgagacagagtcttgttctgttgcccaggctggagtgcagtggcacgatctcggctgactgcaacctctgcctctcgggttcaagcaattttcctgcttcagcctcctgagtagctgggattgcaggtacacgccgccacacccgactaatttttttttttgtttttttttttttgagacggagtttcgttcttgttgcccaggctggagtgcaatggtgcgatctcggcccactgcaacctccatctcctgggttcaagcaattctcccgcctcagccgcccaagtagctgggactacaggcatgcaccaccacacctggctaatttttgtatttttagtagaaacagggtttctccatgttgatcaggctggtctccaactcccaacctcaggtgatccgcctgccttgacgtcccaaagtgctgggattacaggcgtgagccaacgtgcctggctgctaatttttatatttttagtagagttgggggtttcaccatgttggccaggctggtctcgaactcctgacctcaagtgatccacccgccttggcctcccaaagtgctgggattacaggcgtgagccactgcgcccggcctgagttttcattttcaaagattacttagtacttggcttggttgagaaaacaatgccttcctttcatgtgtcgtttcatccaatcatcgatccattcatgtatacagctaacctttagtgggtgcccagtatggaaaagatacttagctacaaagcatctcttccttcgtgtcatttgcctaaatggcaacctatattttggtcatcctccaactgtgtgcaaagataattttgagggaacacctctatgccaagcttgtgcagggtaccgctgtttccctactttggggaagattgctagatggcatggccctgatgctttcagacaccccaagtagctgtgactgaagggggcagaagccacaactctccagtcgtgagtaggggaggaagctggtatgtaacaaaaaatgtgaccctggacctttgggtccttaagagtccagagctgacatctgctgtcattctggccatgccctgccctgcgtgcggtgccttcgggagcacgtgggtctccctggtgcagtcagctctggaagtaaaacctgggaactttgcccaccccatagtacctgataccctgccagagtttttggtatagtgcagttttatcctggagcaagtttggtactaaatcagagaagtgcttccaattttctttcctcatttggcggtctcactgttttgcctgtcctctcttctgcccaatgagagagcagaaatctctacttaaaggcttccctgaacggttgcccaacaactgaattgaacgacttgtgggaaaaacagatgagagagagtcaacaaggtggaagttggaactgtgagagcttcttgaatgagtatctgtgaatattgtccatatggctgaatttggtaaatcctgctgagactgttgacatgaatgggagctttgcctgaacaatgcatttggcccaggaaatcgcagtagtgcgcggcgctgacttcagatgtttggggttaaaggaggatgtgcccttctttcatttcatcgccttcccaaggtgcacttctccagggacggatgcctggagccttagaaaagagagagagagagcgagagcgagcaagcacgagcgcgcgtgtgtgtgtgcacacgcacgtgtggcagagagcaagaaagcttgggggaagggcagagaagcagggacagagaaggagaaatggattttgcaatcgtcctgaacaatgtagaagagatgaatcaggtcctctaaatgccattcctgttactggtcacattccttttgtacttttttatccagctctattcctctgaagccaatggcctctatcttactatatttcacaccaaagaactgagcactccctcgtcagggcccttgtgcctgtgggaggcagaaaaagaatgtcataattagggaggcagagactgaaaatccctttgctagcacagtgtctgagcactttgcctcacccattcaggactgacaagaacacgagcaggggacatgtcttcttaccatgatcaaattctatttattaaggactcacttggatgcagccctgttctagtagagatttgaagagagtctttcctaggaagatttttttaaaagaggcttataacacatgtaaaaatgtcttttgatcacggagttaagaggaactatggagagccaagtacaaagtgggcccagtgaaagggccccactagagtcactggatgagaggttggtgggattgctgcagagaatggtaagtgaggcttcaccctcagcggaggaagttagcatcgtgcaaaggataccataagatggtgtcagcagtaaaacagccgagctcctcagactgaggcagcaactagaggcatgctggcggtggctttttttttttttcttttattattatactttaagttttagggtacatgtgcacattgtgcaggttagttacatatgtatacatgtgccatgctggtgtgctgcacccactaactcgtcatctagcattaggtatatctcccagtgctatccctcccccctccccctaccccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttgtatggctgcatagtattccatggtgtatatgtgccacattttcttaatccgatctatcattgttggacatttgggttggttccaagtctttgctattgtgaataatgccgcaataaacatacgtgtgcatgtgtctttatagcagcatgatttataatcctttgggtatatacccagtaatggcatgactgggtcaaatggtatttctagttcgagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatgttttcatgtgtcttttggctgcataaatgtcttcttttgagaagtgtctgttcatgtcctttgcccactttttgatggtgttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatcaatcttgaattgatttttctataaggtgtaagaaagggatccagtttcagctttctacatatggctagccagttttcgcagcaccatttattaaatagggaatcctttccccattgcttcttttgtcaggtttgtcaaagatcagatagttgtagatatgtggcgttatttctgaggactctgttctgttccattgatctatatctctgttttggtaccagtaccatgctgttttggttactgtagccttgtagtatagtttgaagtcaggtagcatgatgcctccagctttgttcttttggcttaggattgacttggagatgcaggctcttttttggttccatatgaactttaaagtagtttttttccaattctgtgaagaaaggcattggtagcttcatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagagatccttcacatcccttgtaagttggattcctaggtattttattctctttgaagcaattgtgaatgggagttcactcatgatttggctctctgtttgtctgttgttggtgtataagaatgcttgtgatttttgtacattgattttgtaccctgagactttgctgaagttgcttatcagcttaaggagattttgggctcagacgatggggttttctagatatacaatcatgtcgtctgcaaacagggacaatttgacttgtcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggccttttctgcatctattgagatagtcatttggtttttgtctttggctctgtttatatgctggattacatttattgatttgcgtatattgaaccagccttgcatcccagggatgaaacccacttgatcatggtggataagctttttgatgtgctgctggatttgttttgccagtattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatgcgtcccagagattctggtatgttgtgtctttgttcttgttggtttcaaagaacatctttatttctgccttcatttcgttatgtatccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaactatgtgatcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctgatgttgacagtggggtgttaaagtctcccattattaatgtgtgggagtctaagtctctttgcaggtcactcaggacttgctttatgaatctgggtgctcctgtattggatgcatatatatttaggatagttagctcttcttgttgaattcatccctttaccattatgtaatggccttctttgtctcttttgatctttgttggtttaaagtctgttttatcagactaggattgcaacccctgccttttttttgttttccatttgcttggtagatcttcctccatccttttattttgagcctatgtgtgtctctgctcgtgagatgggtttcctgaatacagcacactgatgggtcttgactctttatccaatttgccagtctgtgtcttttaattggagcatttagtccatttacgtttaaagttaatattgttatgtgtgaatttgatcctgtcattatgatgttagctggttattttgctcgttagttgatgcagtttcttcctagtctcaatggtctttacattttggcatgattttgcagtggctggtaccggttgttcctttcgatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattctttttaagaatgttgaatattgctccccactctcttctggcttgtagggtttctgctgagagatccgctgttagtctgatgggcttccctttgagggtaacccgatctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgctttccaacttgtttccattctccccatcactttcaggtacaccaatcagacgtagatttggtcttttcacatagtcccatatttcttggaggcgttgctcatttctttttattcttttttctctaaacttcccttctcacttcatttcattcatttcatcttccatcactgataccctttcttccagttgatcacatcggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcaggtcatcaaagtcattctccgtccagctttgttccgttgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtgctttctgtttgttagttttccttctaacaggcaggaccctcagctgcagggctgttggaataccctgccatgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtgtttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctggcaatcagcgagactccgtcgggtaggaccctccgagccagatgcgggatataatctcgtggtgcgccgttttttaggccggtccgaaaagcgcaatattcgggtgggagtgacccgattttccaggtgcgtccgtcacccctttctttgactaggaaagggaactccctgacccctggcgcttcccgagtgaggcattgccttaccctgcttcggctcgcgcacggtgcgcgcacccactgacctgtgcccactgtctggcactccctagtgagatgaacccggtacctcagatggaaatgcagaaatcaccgtcttctatgtcactcacgctgggagctgtagactggagctgttcctattcggccatcttggctcctcttttttttttttttttttttttacatagatgaaggggacctctcataatagatggcaccttgagttgggttgtagctggcttttgcagttgcttagatgagtattgcattgttccagtcgtcctattctgaaatgtgtctgagaatcctgttttagagccaagctccattctagcaaacagtagtgcaagccccactccttggcctgattgatacagtaatggcactgtccaccccctagccaccccgggagtactctctgtggggagtttgctgctgccgtctaaactgaaatggacttgattttctcttctgagtagatgctcagctgtaatccattgggagaaaattcttgatttcttgggatatttaggaaggctagcgacaggtaggagcttctttatttattatgcttttctctagaagcttcattgaatacattatcttctgccccacaccccagggctttgaccaaaatatccttgagatactgtggcccatattcggtcacagaggtgcactgttcttttgaaagaatggcatgccgcaacttacctactcacctacagaaggtgagtgctgcaaggcagtcccagtaggcacttggagtggagctttgatgaatccgaaggatcatgggctttggaatcacaagacccaggtccaaggcctgatctctgcttcttaccagcaggctgtgaaggctgtgaaacacttcaaaggcccgtaatttctcagtttgtaaaaacagcgattttcatttctgtctcttaggggttgattcagtgagacagtggctgtggaaaaactttatagactgtaaagtgttaaagacatatcctttgtctctgttcttatctaagaatgatgttttaatgcttttgagcaggacacagagaggtgctacagggacagggttgcttctaccaccagccatctggctatgttgataactgggatctgtgtacttcttgacctgtgatgctcaagtcttaatatgcatcagagtcacttgggggctaggccccatgtctctaaaatccccttggttgatctgggatccatgtgtcattagctccccagctattctgatggaggttacccataagctccactttgagaaaaactagagcgtacagcttggactagatgaccatggagattgggatggaaggaaaagcatggtagggtcatgtctgtgtgcacccctgaatgagaggcaaggactccttcgtgttgagttaaccaacagctcttctgggctctgccactatcacgttccatttgttaacagttgcttcctgtgtgtgtttgtgtttttttctggttgggatgtttggcctcttttagttgtgagaaacaatgctggggccatgagtgtaaaagcatcttctgttttattgttggtagcaatagttgcctggcttgactgaaagtcattttccttggaggttgtacctaaagatttagcggatggatcaagaccattgtcctgctctggctttctgatatcacctcacctcatggtgtctgtgggcttagtttacccttcatttattttgagcaccaatggacagctgtctttgttttgtgtgttttgtgaggaagatgtcttgggagccttcagtgaagatagagtgtgtgtgtgtgcatgcgtgtgtgcgtgcgtgtgtgtgtgcttgcgtgtgtgtgcgtgcatgtgtgtgcgtgtgtgcgtgcgtgtgtgtgtgtgcatggtgggataagggataaggtcatttgagaggatctggaagccaagggaaacaggtctgctgggaattccaaaattctgtctagtagaagatcttaaagtttattcctcatcggagctcttagcagagccggcacaagcttaagtgaccttgaagcctttagaaagagcagcttctccgcaatgccagtcacatggcacagaagatcaagatgttgtttaaataaaatcttgcagcagcatccatttcacaggtccctggggccgcgtgtagtcagtactagaagggcaagactttaaaacaagtatgtggtgtaacagtagcattctttttattttatttatttatttttattgtttattttttcgtttttattttttttttgcccccagttgaagaagaccaggaaagaatcttcttttaaaaaactgagctctatctgtcctgattcctggtgctgcttcaggtatctaccttaattttcttatattcctatgaagacagtggtttggataattggaggtagctatacactgaaattattaaattgtttaccttcaaaacaggagtagaccagaaatgcaggtccttgtcctcagaactgcagttcacatcatattcagtaattaatttaatagtcacgttttcctcccaggctagacaggaagggcactaactttgacttaggatcccttttgtagctcccacattatgtgaggatatcaatttgccttctgtttatttttctttattataaaaataaatttattataaaaactttattataaaattttgctgtcatttaaaaatatacggaaaaggtgaaacaatgaagaaatctacaatcacctaaaagcaactacaatgaatattttagctgatctcatgccagtgattcatctgtatatatatatatatatatatatatatatatatatatatatatagggctccatgaattaacctaaatgacagagcaggttaggtgcttaatattctgaggccatctaaactcaacatcttgcctttctcttgagggcagctcctccactagtcccttttcttcatggtttcagagactttcccagcctgccagtcttcatttggaggctttctatggagctttgtgaaatcacagtaaaccctttgacatgcagcgctgttgcccacctagtcttcagccttgctgtaaaggtgaagtagattagttagacagggttttgcccttctgactccttgttgattatctctttttagataattactattcatgtacctttctcaatgcccttaggtgagagaatagcttcctttcttcctgatttgattctgtagcatagacaaccttcctttcagggggctggattcatttaactcttatcttcaggccagctgctgtgcttgcacctgggggaaggaggtttgcttgtgtgctgcatgttgacccttatacattttatctaagagaacattttcaaatgaaagaagctgtctaggcctggtgcggtggctcatgcctgtaatcccagcactttgagagacccaggcaggtggatcccaaagtcaggagttcgagaccaggctggccaacatagtgaaacgccgtctctcctaaaaatacaaaaattagccgggcgtggtggcgggcgcctgtagtcccagctacttgggaggctgaggcaggagaatcacttgaacctgggaggcggaggttacaatgagctgagatcgcgccactgcactccagcctgggcaacagagcgagactccgtctcaaaaaaaaaaaaaaaaaaaaaaaaaaagaagctgtctcatgaccatggctccatgccttcctctcctcctcacctcctcaccccaactacccctctattctttgctcaaatcaaactccggcttgcccactagatgagatttactcacccacagtagtctgtatttttccaaagaagaaaaagaggtattcatgactatatcctgataaatgatgaagccttccctcccagcccactctgagtgagtgagtgacccctttcttctcagttcctgctactgagtgagtttctctgtctctctcgctcgctctttctctttttttttttttttggaactgttgtttagaagtaagaatttgtcattcttaccaaagcactgggcatgggcctgttctctcttgggctactctgaccaggggttggtttcctagacctgcatccaggtgtgttttcacggaaaatacccctccctctcttagggtttcctcgggcagccctggtgacgttggtcacaatggaggatgctgagaggacagtggtggttgggcacaccctctcgtagagcacaggaccaatgtcttcctgacggtgttcactcattcctttgtgcggccatcagatagcagtggtggtgcctggtagtaggggaaggtttacaaaccctggggcagctcctgcatgaggagggccagcacattcagggaactgaaataattcaggccctcctgagcacaagcttgtcctctatgcaaaggtgaagcagttcatacactcagaggattttagaattaaaaggaacagttttaactgttggactttagtccttcaatccatccttatggttttctgggagagaaaaaggtccaccgaggtaaagtgagttgcccacacacgtgactggctgatgtggcctgcagactcgtatcccggagatcatgccaatctcaagccaccgaacataattatcacctacttccagaatgacattccatatccctgaaaatggaaaatcaattttgaaacaatctaagcaaagaaagaggaccatcttctgtgctagtgtgttgtatgcagtaggaagaacgggcttcggagtggacacagacccatgttcaaatgtaaattcttccatttactaggtgggtgatttcaggcagcatgcttaacctttcagagcctcagtttatatcatcagtaaaatgaagataacctttcaagaattcatcaaaaagattaatggaacagtatccatagagcacctgtacagcacatcacctgatttttaactttcaagaaatagtggttattggccatttgtgattagagatgtgttcactcctcactgatctgtgtttaggaagatagctttttccaaatatgaaatttttatgtgtctggtagagagagggtggaaatggaactgtggttgtaaaggcaaaatgacaagaacggccacattagatcattaactgttccaaaaacctctcatcagatgtttttccaaattcagaagatcctaagcccagtcctttaaaaaaataatgttaaaagtatagtgctaagaaacccaagactttcaacatttcaaatctgtctgggagtacacatacagaaagcataacagatagttaatggaatctgtctttttgatgataattatagcattcttaagtaggctggaaacacatctgtatacctgaactgcttcaaaattatttgcttcaagggggcattcagtatcttgctaaactttcaagttagagataactactgtttaaattgatggcaggtgtttgatctataaataagagctgtactttgcacttcagcgctctgtttacctgctgcacggtgttcatttgcatcaccctgggaaactggaaaggccacaggaataggcatcagtgatacaccagacgtgacagctgaaacacagccttcacacttacaaattccaggagggactagctctcctttcagaggcaagaagccatgttgaattggaagatgcatcagtgagcctggagagaggtgagaaaatcatatcagaagtgtaatgagcactagggattttgtccagagtatgtgataacctcactagctactgaaaaatcttgcctagttatttatgttttcagtcagcctcagtgtggagactgcactccctccgtctgctcggccacgtggctttggcagcctcatctcttttcagcatcgtgcccatatttcaatttgctgttggggaattctttgaaaagtgcgtctttctctgcagttctcagctcagttctcattcaaattacagaattctgatgctggtcctggggcttacccaggctagacacataagctctaagaggctttcccttttccacgctcctcacacctgaaactgctgctcaggtccatagcgcaggtcagagggatgatcagttcttgaatcactccccaaaccctgcccccaccagccttcaactccgtggctgcagtggagacagaggctttgggtgaataacagagtaggtgctgtcgactggcttcctgactactcacagaccacagtcttgccagtaccaatgccatctgtacaaggatgcttagagttctgggaagggagtaaggaggattagcgggggattctgaaacaggtgccctgcctcagggcgccagagtcatgggggtcatccccaggggagggatcaccagtacaaattgctgtacagtgagcctgtctcatacttgagctgcagaatgagttgtaggctcttagttctgagttctgtgacagcctctcccagcctgttgggtgagaggcctcacctagcaagagaggtgatgtttgttccaaagagctgctctaactcgaaggctctgctgccttgtggtagactcccagagtactgcggaaagagacaaggccgcctcctgcccaggcagcaggaagaactgttaaacttggtgaaattggtttctggtggtgaaatggatggtacccaatgagtactacttacctcgtttgtcccctctgaaaccaaaatcttggctccagtggtaaattgggtacctgcatttcagctacctggagggtctctttatcttgggactttgtgaaaatgacaatgagagagaacctgtcatctatgatgaagactcagtacagctaattccaaatctttacaataataagttgtcaaggataatacagagaaacttctgccaccagtctgcagttctgtctcactagggaattgtccctgagcagtgtggccctgggaagctcctctgtgctggcctggccaggatcctcttttcattgtcccctttttgtcctggtcaggcacaattgtgcccgcactaggatgttttctgcgtcttgcctcctaaccacgccaagctttcagcctttacttgggaatctaaacaatgccttcctgacgttgcactccttgttctctctcacctgagtgtttttgtctgtatgaccagctgccacacaaaggaacaacagcagggttctcagggaggggcacttctttggttcacaaagttagaactctactccttcctccttttgaactcactgggcttgggaagaaagcgcctctcctgctttctctgtgggtcccaactgaggtgggtgctattggtccctgagggagacacagacaaatccccgaaagcctggcatagcactgtctgtcagtgcaggtttcatacagagggttggagaaaggaaatgggtgcacagttggagaagagaaaagtggcagatggttctgcaggttttttcttctcttatttgcctgacagatgaaattgtaattgatttaccaaatgatcactaataacaaggcccatacttgttatgtgtttgatagtagtgagcagcaggaaccagaggcagtacagagccctgagttatttggagacctcatgaaaagccttttgagcccagtctgacttcttaaaatcacaaccggccaggagcagtggctcacgcctgtaatcccagcactttgggaggccgaggcgggcggaggtcaggagtccaagaccagcctggccaacatggtgaaaccccatctcttctaaaaatacaaacattagccaggtgtggtggtgcatgcctgtaatctcagctgttcgggaggctgaggcacgagaatcgcttgaacccaggaggtagtggttccaatgagctgagatcgtgccattgcactccagcctgggcaacaaaatgagactctgtctcacaaataaaaactaaaaaaaaaagaaatcacaacctaatttatttccaaaaaaaagcactgtcctgggatgggacagcatccccaagaagaggctgaggcacactgcagcctcaatggagacaactacacctgcacaacaggcaaacctcaagagcctcagcaagttgagaaggccagtgtgtgcttgagaaaggggaaagtggccagcctcacccggtccaggcggctccctcctgcaccagctctcaagaggccagctccttcctgagtcaggtggttctcagataaagtgaaagtggaggctacgcttatttccttttgaattctcagacctgctgatttccatttttgttggagccttgtgtgattgtgttaccctcttccctttttcctttcaaaaggatgttttggggcatcatggcagcatgtggaagagtatgtgtatatgggtgcccaggtttgtgtatgtgtgttacgtaggtgggggtatgcatgcccatattggtgccaggctctgagagacaaagaaacaagtatgccatctttagatctgattttaaaaaagaaacaccccagccaagggcgtttatctgcttaatgtaccagaactcaactgcaggaaacccatttctatattagcatatcatgaaaatgtgcagtgcagctgcctgggaacagccagtttattattgctgggggccgtcctgggttatgatctggaagaatttgaatcgccctttacatttttttctgtcctcattttgattttggcagtggcagaagaggagaatactctcaagagattaaattatttccctttaaaattctcttggaatcataacgactattaaaaattaaaggcacccatatctcatgctattcagcttaactggtaattaaagtgcaattaaatttttcacggtgtagattgcttctgtttttttgttttttgttttttttttttttccctgggaaattacaaactctgggctcttgagagttacaggattaatctatagacttttaataattcagctttgatcaggtgccgtcacttgatgcgtctctgaaagggaaggggggactgtaaagtgttgttttgttattaatggtgagttttaattttatttggtttcttagaaaccaggaagtaactaccagtccatgaatgcaaggccgttttcgagtgcggttttgagttggctgcgattgctctcactaatgtgtgccggtaattctctctctgctgccaggcctgcttccctcaagtagcattgtgtaatttggggtacagtcctgagttgtcaccagtgaacaaggtgtcaacattggaccggaagttcggaggctgacttcggtggaccctttctggccttggccaaatgtttctttttctctcttcttcttcctctccaaccttttttttttctttgttggtaaaaacgcgtttgcattgcagagctgtaatcataagcaatttcttgacttttgtaagaccttttgctgacctgaggctgatggccccagagagacctggtcagcagcatggtctctgtgtaaggagagtggccctggtcagtttggccaggagtggaggtgagggctgcccactgtagcccgcctgcagcaggacttgccattttccagcaagcctcccagttgcaccatgcagcctgtgggtgctgcgtgggaggaggagtgagcagcagcagcctgaccacaccccactcttgactggtcccagaagacaccttcagccctgtcctcaatcctgactcatttctctgttcatttctaactgttaggaagatatgtcttaccatttttctccctctttttttttttttttttttttttttttttgagacggagtctcgctctgtcgcccaggccggattgcggactgcagtggcgcgatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctccatctcctgacctcatgatccacccgcctcggcctcccaaagtgctgggattacaggcgtgagccaccgcgcccggccttctccctcttttaacccactttgaaagttcatctttagaaataacacgtatcccaagttggcaaggtgtcagtttagggccaagttcctgcaatatagcatagcaaggaagggttcaggtatcggaggcaggtaggtttctgcggcaactccattgctttgagatattttattgtagacatggaatttaacttccctgagcctcagttttcccatttctaaaatggatttatttacagtacctacctcacagcgttgtgataaggattaagtaagacaaatcctagcaatatggatggcaaaaaataagcattcaacaaatataagctgttactgtttttattattgatcatgaaatagaacatcagcatttctcttttttacttctggtatattttaattctgcatccccactttggagtaattttataatatttcctaacagactggaattctttctcttctttctctttcttttatcctctttatgagtagcaaaaaaagttgaacaactggaaagaccccgtcttcttcataactgtcttcccagcagctaacatattctctgacacatagtaggcactcaacttgtaatagatggccacagggttgaaaggaatgtccagaattgatcagatgatggggtaggaaagaagagaatcattctggtttctttatccttctatctcaagtcatatgctgcatatactgaagcagtagaaggaacttgggaatataaattatattaaagctgcagattcttcaaataatgtgcccaagcctggattctgaaggcttatttgtcaggtaagacagcagatactgaatctcatattagctcacaggataatggcacaatgcatcatcagtctgaatggggacagtacacaattttcttttgattgcctggagccacagacggggtgagcactgaatattgatttttcaaaggatgactaatagatggtaaaaaagcaaaatagtttttggtttcaacctatccctttcctgtgccacaaattttggcagtaaattaaaataaacttttatttccccaaaacaggtaaaagagcagaatttatgcaggaagacttaagacacaaatgaacagatggctgtgactttacaaattgcacatcagcaaatgtttaaccagctcagaaaatagacaaaactgattagaaacattgagtactgttctgctactcttatggttaggataatctgacaatattctagtaactttcatctaataacaatttgataattttaatccagtcttaggtcttggcttgtgcaatttttcacagtatacctgacatccagcttcttgcttctgatgaggacataataaacttgcccctctcttatattatcaacatttgattatgaaatagcctgattcttcccttctctgcattagtaacgtactggttaaatctacacatgtggtaaactttttttttttttttcattctcacttaccaggaaattctattttcttttacccaggctcttacaatttatctgtgcagggttttaactgcttgggccttgaacgcatgtacttgtgaatcagactagaagccaaagcttttttgaagttttgatatgaaatgggtcttgcttgttgtgattcagttcaacattttgagatgggttggtccagcatcataagcttttgtgtatgtggtgggtatctttgtgctgccacaacaaaataccacagactgggtaatttataaacaacagaaagttactcagcacagttggagaggctgagacaccaagatccaggcactggcaggttcagcgcctggtgagggctgctcgctccaacttcaagatggttccttgttgctgtggcctccagaggggatgaactctgtgtcctcacgtggcagaatgcaaaagggcaaaaaaggggcctaagttagttccctctagctcttttataaggtactaattcatttataagagcagagccctcatggcttaatcagttcccaaaggccccactcttactaccactacagtgggaattaagtttttttgtttttgtttttgttttgagacggagtctcgctttgtcacccaggctggagtgcagtggtgcaatctcagctcaatgcaagctccgcctcccaggtccatgccattctcctgcctcagcctcccgagtagctgggactacaggcgcccgtatttttagtagagatggggtttcaccacattagccaggatggtctggatctcctgacttcgtgatccgcctgccttggcctcccaaagtgccactgcgcccggccgggaattaagttttaacacattaatttgggagaacatccagaccacggcagtgagtgctattgtgtgtgtatgcatgagtatgtgctttaataagaaagatactgactcagctgggcgcggtgcctcacgcctgtaatcccaacactttgggaggccgagatgggcagatcacaaggacaggagttcaagaccagcctggccaatatgttgaaaccctgtctctactaaaaatacaaaaattacccgagtgtggtggtgggcgcctgtggtcccagctgcttggaagtctgaggcaggagaatccttgaacccgggaggcggaggttgcagtgagccgagattgtgccactccactccagcctgggcgacagagagagactctgtctcaaaaaaaaaaaaaaaaaatactgacttacgtaactggaaagtccagggatatctggcctcaagcctggttggatccagggctcaaaggatccaataggacattgtttctctgcatctctctgttccctcttctgttggcttcaaaatcaggcacatcaaattttagaaattttcttaagctgataggtttgtgtgtttgtcattttccttccagcttttgttaactctagaaataatgattttcctttccttaagaattcccacctaattctagtagttccagaaggcatttctataatgtcgttttgttacataataactttttagcctccacgtggctggggtttgcatttgagttgtcgtccatcttcttcccaccatcattgcactcagagaaaaacctgtagaataccactttccccagccactggggggctttgtgtgtatttaaccatatgaaactgttgacagtcaccattgttgacctgtgaaattggccagttcatacgtgaaattggccagttcatatggttcaacctaaaacaccaggtttgtagtggtaattgtttctcagcaacagcagttgtgtctagaaagctttgcataaattaatgtttttattttgctgttggtttgctcctagcacctctcctgtgccccagtgtgacgaataaacagctggaggcaaatgacagagtgcttgcacatacggcaagccattcataactgaatcccaggtgcaagatgaccatctttcatgtcacagtcagaggtttcggcacgccattccggaatttcaccattaaattaggtcctgtgaatcagataatgaagaaagagaagaagtatttttagaagctgtagagcttctctgccagccctgtgagtcttgaacattcatgctttttaactcatttctggcagttttgagaggcaagtggtgtccacagattcataaaggccaatgttgcctgtgtgccaaggcagttggcagctgatagaatttcagaactagagaagactttaaaggtgatctgatggcagcccctcaacaagtctcaatgacttaagagatttgcccaagataagagcttaagacgaggcccaaggtttccagtctggttctgtcttccgattattccattatcttgaagagcaatgctggcctggcagattcattcctcactctcttcatagcttgacttttgttgttttaaaagaaatcacagaattttaggccaccaacaggcaccatgagggaacattggaaactggagccaccttattatccagaaagctctggagcccaaagccaggccctaggctatagcctgaagccactaaccaggggtagctgaagcatggttgattccatctctagtactgcaatactcctgctttggggaggtatgcaatgcaaaatgtatctttttaaaaaaccaatcatttttcaagagattaagttgaataaaatgaaattagttgtgaccttgatatcaagtagctattttcataatttgtagtaaaggaaaaagagagttgtcttatgacttggggagagggggaggtcagcgtttggctctctggccctaggactagtgtagttgaggtgaagacttcaatggcttcacagcagttgtctcctgctgagcttgtggccactgagaacttctagaactccatgccaggaacactaccaagtcaaatctccccattctgtgggtattcagtaattttgttgcttaaatgcaggtttactatgagagcaactcaaattattttaaataagtaattataaaatagaactcagtggaatacattggtgacaatgttgtttacgcattcctaacgtcagtccaccaggaatctctgccctaaggttgtaaaacatgcaaccttcctttaatcagtaggactgattgattatatataacaagtcttaagagtctacaaatggcgttattatattttggaagaacacgatttggtgacattactcaaaggtttttttttttggtgttttggtgtttttttaaacaacttacttgttttattcatgtgtcgttgtttttgtagatccttccacagagttttgttttgttttgtttttttaaagctacatgctgggtttcccttttttattgatacaattattagctttagcccatttttccaacttgagtttttgtgattttttttttttttttaacaaatcctgattctgctattctttgtgtaaaagaagataactaactttactggttcactttatataccttggctcattaattctttacaataaccctacaaaatcgaaatcattgtcacactttatagatgaagaaatggagagtctgctggattaactaccatggccaagattataagagctcttatcccttcctctgagcttcgtagcagctgcaggtttgataaacatgtcttaaatatcttcatctaaatcatggacttagacttgaatgcctgaagtctgagatatttatgacaagaagtaagtttagttaccgtggctagaaatgatggcctgattccatgccctccaggccagagggatgcactcatcagcgtcttgtgggaacagtttgcaaccacttaacaatccaccttgtcaaatccgatactctgtttattgacactattattgtttttgaaaacacttttgcatataaaagcatcaaacacatttttaaaagtttagctattttaaacatttgtaattggctctagtataatacgtagcacacccagacaaaaataaacttctttaggattgaattctcttaagtggggctgtttatttggcttgtccaccagaaacttgactttaaaagtcaaataagacgtagtcagttctggcccccctgcataatagtatctagagggctgtttcaacccaggattttatgtaatgaacaaagaatttgcagagaattactacaccccacattctgtaatgaaaactgtataaaattcattctacacaattatgtccaactaaccatgagtatgccctgctattagtttctgtttctttgtcatcaggaaggtggtattactctttagccacactggccaagaaaagagtcattgtcagccagcccgaatccttccccaagttcctggggccctgtgacagatgtctctcattctcccatggatggtgttgggatgtccactacttgctttaggaaaaaaaacttagtcttttcttatgcatttgtacaaaacagtctttaagaacaaagttttcatcatttgttatccacagatgtcatttttcccaaccagcttgatctagagaagttaatggcttatttacgtagggacatctgcatgacagggctgtgttctgttttctgcttgagctctcttggtctgtatccttaataccatttgttcattaatgtcacaaatatttaaatatgtattgagtacctcctatgtgccaagcactattagatatagcattatttaaaaaaaaaacccagcatatataaccctatcactagacagtttacactctagcatgagagacaatgacatcattaccaaaatatagtgtatagttatgaactgcatgaagagctaggaaggaaagatacactgttagaagagcttccgatggaaggacctgcttttaggtagaaacaggaggtgatgggaagggagcccagttgtgagagtaaagtgaactaccggaggggctggccagcctcagagaagagctctccctgacccggtagcaggagggaaaataccacactcaagaacctgcacaacagctagggtggtgacaggcatggggagatgaaggaagcgggacaggacaagtggcccagaatgaggctgatgaagtgggcacataccttaggcccacggctgcacagcggtttttgcagggtgtttgttattaagtgcagatgccaccttggagtggcttcaaagtgatgccaactgtttgcacattggtgtgaattccagtgctgcagcatgaggtgggcagatggacaggtggacaggtgtgcctaggtcgggagatcctgcaggaagcttctctgccttactggttcattggtgtgaattccagcgctgcagcatgaggtgggcagatggacaggtggacaggtgtgccgaggtcgggagatcctgcaggaagcttctctgcctcactgattcattagcagataccacagagaagttaatccagggcagacagatgcctcctctaccagcgtcagcagccaaaatacaaagagaacaatgtgctgtacccagtttactcacatgactaacattcgttacactttataataaaacataaaaatgtttgtttgcataaactcacacattgcctagcttgcttcagagtaactaaatttacttcttgtcatgatatctcagacttcacgcattcgagtccatttagtgttcatttaattggaaaggagaagagagggactataacagcacttgctggtgattgtggtggattggctgttttcagaccctttagagaacccagtttttggggtcctacacagttgagagcagggctgagtgtaggaatcagaattgagagaactgagtgcatcagacatggtgggacatggcagaccttcctgctgagctgctgcaacccctcccctcggcccctctctctctgtgatgttgctcttgttgctgtgctccttgcacagctgtgtaggaggaccagggaaggctggatgcccagccctctcccttcaacctctctgtacctaataggaataaggagctgtcacctatagctctgattcctctctgggagcatttatcatctctcagaggagtaggcaggttctctgctatggagagggctagagcttgttctgtgaagagtatcgagggtgcagacaggagtgaaaagagaagagtgcctgttggatggatatttgctgtgtgaaaaagtaacaaggacatcatcaggctgcagtgagtccagttggaagcagggcctgccgggaacactaaggcatggtctgaggggcctgagcaaggctgggctgaggggttgatggtgttctagggggaaaagaatgagagaaagtgggaggaagaagaaaataggtagtgaaggccagaagggtgatctgaagagattcaaacaacataagagaggaattaagctttgagtggtcatctaataagggagcaacaggaggcacaggaaaagccagcagtggtagcggaggggtagctgccccgctcctgttcagcctcgtccagtacaagcccagcctgagaaaacacatctgggcatcacaaagaatggagcccaaggctcttgaaatttccctctttcttcctggttctggggtgggcagattaagaagctgggtggctcttaagcatggggaaggctcaaggtgtgtgtgtgtgtgtgtgtggtgtgttgtgtatgtgtgtgtatgtgtgtgcatatttttatgtgtgtgtatgtgtgtgggggtgtgtatgtgtgtgtatgtgtgtgtgtgtgtgcgcgtgtgtgtgttgacaggtcaagatccttccctcagaaggcttctcagtctgcccttccccatgggccggggccgctctggctcccactggaaattgcttcctcttttgagggtagggaaggggctcagggactgcagaccagctcgacacaggcactactgggtgatggcgcaggccaggctaaggagctgggtaggagtgagctcgcctgcagcagctcagtgcagaatcctctgtgctttcctggaatatgaaatagccagtaatagccaagagttgcatattttaaaaaaaaaaataagaatgtttctactttctagacagtgattcatttacattgggacacactggacgttgatgccgaatgagcaaatgaacaaggctttatctggtttctgtacctcaacccaaaattctcacgtactgagcatcctcaaacccatattgtgaaaagctttgtagcttttgaaaataaaattccctagaacacataagaagcagaccacaagcaatgagcctcgctggtgtcttgatccaccttttttttttttttttttttggaacccggaagcaattgagaggacatgtcttggcatagctttgaaaaccggccagtagggggcgtctgcagtggacctgaaatctccttagagttggccgtttctttttcttttcttttcttttctttatatctatctatctatctatatataattatactttaagttctagggtacatgtgcacaacgtgcaggtttgttacatatgtatacatgtgccatgttggtgtgctgcacccattaacttgtcatttacattaggtatatctcctaatgctatcctaccccctccccccaccccaccacaggccccagtgtgtgatgttccccttcctgtgtccaagcgttctcattgttcagttcccacctatcagtgagaacatgtggtgtttggttttttgtccttgtgatagtttgttgagaatgatggtttccagcttcatccatgtccctacaaaggacatgaaatatccttttttgtggctgcatagtattccatggtgtatatatgccacattttcttaatccagtctatcattgttggacatttgggttggttccaagtctttgctattgtgagtactgctgcaataaacatacgtgtgcatgtgtctttatagcagcatgattgatattcctttgggtatggacctgaagtaaagccctgttcaaaggaaaacattcaccaaatcccctcatattctgtatctcacaatttggtacttgaatagaaagtgccttgtagtaactattcttgaaaactttgtatttacactaccaaagaagcaatttcctctatagcctgattcttgagtacactaaccggtacagatatgtctcctcctgtccttccaaattcattatttcataggtgttttgcaccttaagtcatggcctttcgtttttgacagactaattggaattgtgatgctttctgcagagccagtgggagaaagagaaaaaaatgctgagccttcccagcttcaacaggtggttgcagtatgtttggagctaatagaatggagcagtgatctagctgtcctaaaagagctaactgcagatgcggagactatggctgtggagtggagtcttgatgacactctgctctcctccacactcacatgagaatatgcaagagttttgtgcgtatcaaatttcattgatctggcctcactgattttgaatttatggtactgtagagagagagctgatactcacatttccagtgtctgtagatggaaaaaaattgtttcctgtgaaaatcataaatatgtaggaaattataggggaaatgctagcccattcatgctgcctttacagcatgctatccccgctaaaaagatagttgatcatagacagttctttactgttcattaaagtaggtcctggcagggtctctatttggcagtgtcctgtaaaccattactctgtgctgttgtacagggttacaagaaatcagtctccattttattaaaaaaaaaatctagaattccaaatctccattaatttggatgtttcatcatcccaattcgtcccaataaggttttattatattttatttttgataaaatattgaaacaagagactatttgattattggacataataccttaagttccaggtaatttcatcatctgagtcctgaaaagaaactcagacttcccaacccaagaagtctgctgtctttcacattgggccatacctgtacatatccttgacctttatatttgtaggcagcaccactgtcaatgttagtggtgtaggtacatcttaccaaaaagaagtgtggcctgtaagctgtggtttgggcgatcttgtgactgtttgcaactttgctctgaagacaactaactggatccaattaataaacaattgggagatagggttactaagatagagtgatcagaaaagtgccttctgagactgtatttaagctgaaattaaaaggctgagaatagtatttagggagagagactgtatttaagctgaaattaaaaggccgagaatagtatttagggagagaggggacaagagcgttcagtgcttggctctttctcttcatgcatgtgtctggtcttgaggtgggagaaatcttgattgaccagagaactgaagagatagcaaaggaggtgactggagcgcatgggcccgtggcatgaggtgaggttgtagagaaagtcagggaactccttggtgagctggcatggttagatcatgctttaggccacaagagacaaaatataacaatgggaaattaaaaagatatagctaggctcaaagcgagtgaatctgaaaaagaagagaaatgcaaagaagtgatggagctgaagccactggctacctggctctcggataaaggaggcaaaatggctgggaatttggctcctggaatgtaacagggactagatatgtactctgtgaaatgggaagtggagtcaggctcactactgaaaaccggggatgttgataaatgagagaggacatcctcactatgatgggaggctgataaaagtaactgctgacctatgcctggaatgatggtcgacatgaagcttgtgagtctatggaggtataagatcccagacacaggatcctgaccagggcctgagccaagccacctgctggttcagtgactggatttgcaatgtccctatcactggggataggatccttgagctagcatttaagatcctgttcaagatgagggcgtaggcacttgtgggggtaggatgcaaatggagacagggacagagacagatgggagagaacctgccactgaaatgaacatgcacacctaaatgccaaaacacataaagaaatagagcatcaaaaagagaaccactgagattcacaatcagaaattcactccatatggaaataaaattatagaataaaagttttcaatttattccaaatccttaaagagaaaaaaatggataatatccactgggattgggggacaaacatatgtgaaacaagaacaggagaataggaacagaaccaatcagaaatctcagaaatgaaaactatagtcattgaaataaaaaaacccacaaagatacattgaattaagagatagtggtgaggaatttacccagaatgcagctcagaggaaaaagacattttttaaaattatgcaaaagcagctgaggcaggagggatattttgagactatccaataagtttctaataagaagttctttaagaaagagtagaacgaatgaccagcaaattttcaatttgacagagtttttaaaaggcatgaaccctcaaattcaaagcatacccccaagtactgagtggtatcaatacaaagaaatgtaaatacacacacactagtgaatcttcagaacatcgctggcagagaatcttacaacctgatttcaatttgattgagagaacatctcaacagccagtgacgtcaggtcacgtggaatgtcttcaatgtgcgaaagcaaagaattgtcaagaattctgtctatagttaaactgtctctcaaaagtgaaaatgaaataaagatattttaagaggtacaaggaatcttgttaaaataattttttaaaaagaatgtgtattacaagaaaagtaaacccagagagaagttgtagaatgcgtagaacagtgttgagtatagaaattgctgaaatgtcagaaaatagaatttactaatgaatgtgaacacaactgctttccctgtgttgagactgaaagatgaaactaaaatactaggtaaaaatgataaggagagtataaatccacatatatcaccatacatgtaaatgattaagatgaaatttaaatattaagagacaggttttttgtttggttttttttaagcccagttgcatgctgcttaagaagaaaactgcaccaaggggttaaaaataatgagatgaaatagagatatatcaagaccacattaatcagaggaaagctgggttaactgtcattatcaaacaatatagactttagggcagatgaagcatttgtggagataaaactctttataaaagagaggaaagcatgaaccaggtcatgtggggctgtgggccatggtcagggatttgcacgttagcctaagctaatatggttggtccctgcagaaaatagctatatggatgggagggcaaggtttgagaggtgtggcgggtacagcatagaggtgagggcagttgggggggcactgggcagagcaggggagggcagggattgagagaccaagaggggcctgttttgaagaaagtgatggtaaacagtagtgtgtgctactgatgggtaaaatgagatgtggacctctgggtggcattcattacagagtgacaggtggagatttgagagacgaagcaagccggagccttggcagtagggaggaagtggctacaacggttttcattcctgccccgccatgctctggaaagcatggtcaaattagtgttgttacactctgtctgccagcgggaaaacatgcaagtatgcaagtgaaactttaaatggaagatatttctttttttgttgtttttttttttgggacggagtctcgcccaagctggagtgcagtggcacgatctcggctcacttcaagctccgtctcctgggttcaagcgattctcctgcctcagcctcccgagtagctgggactacaggcacccgccaccatgcccggctcattttttgtatttttagtagagacggggtttcaccgtgttagccaggatggtcttgatctcctgatttcgtgatcacccgcctcggcctcccaaagtgctgggattacaggcatgagccactgtgcctggcctatatggaagatatttctaactagaaatgcagtaaggggcaggaggcaagtcttctgaaactcaaggctttatcagagattcttactttcagcacagtgttttataacttaggagagcatattttgtcatcattatggtactggatggcagcagccactgagatgaccgagctgagccagcataaaatcccgaggagacttcgttgtctttgaacttcgacgtcgtccctcatgccctctcccttcgtccacccaaaccctgcagatcatgtctgcacccttaactgtgattagagctactgtttgtaaagaagctatatgttagcgatagacaactttatctgttcattgtaacaaatattaatgaagtcctagcttacagatatgttgatggactatgttccccattatcatgacacccccaaagtggataaacaaatggaatgtcagaattccatgctaactgagaagttgtggaataaaaaaattttttttctgtctttttctcaaagtgatcagaatcttgcccatagtctgtcatcattaataagtctgtttttggagtctattgtggcataaagaattaggcatggtaatttacaaaatctgattaccaagagaatccctatctgctagcagttgagagcatcttaaaaagatccaagttagatacagagcagttttgcagtgtactagctatgtggcttaggccaattattatatttaagttctgtgagatgcaattttgtcatctgtaaaatgagagtaataatgtttaccttactgtgaggattaattgaggtaacactcatctagagcggtacccagcatctagaagagtgcttggctgattgtgggttctcaataaatattccttgaagagaatgaataaatgaatgagtgaatgaatgaatgagttggctcagttgtaaaccctctaggtacaaagtcagcactctttcatatatatttgagagtaagcccagaaagaggacataaatcaaatttcatcgaacagccttttgggaatacgtataccgcttacacacacacacacacacacacacacacacacaagtttaaaattagaatgtttaaaacagtctaatcagatggtctgtcattggcatgacagtgagaactaccagaaagcatgagaggagagctgataatggggaagggagtggcccagagaaaagaaaggcagcgataattctagagacagaaatcagagaaggcaagaggaggaggttttcagtggcttccaaacacatgtgacctctgcgtatcagacacaatctagctgaaggctaaaaagaccagaatttttgttgaataaattgaatttctacagaacaaataccgactgatgtactcatgagcatgcacaggccccctgtctgcccccctctctctttctcccgtcctctccccccattcctttcctaagaggtagataaacttgttacttacagaaaatgataatctgtctggctgacccgtgctccacagctctgttcaagaaaaacacagacagtgagcacgtaaaccttgattactagcagagacacagtgtcaccatgccctgagtttgagactcctgccatttccatatgctgttttgcaatttatcctcatggtgttagcaggataaactgatccgttgcattaataagtgttgcaagtagtactttagtgcccaagaggaatttggaaagcatctcatacttgccagatctcttttcctaggtaacataataggctctctttcccccaactgattttattccccataagatgcccagagtagtttagtataggtatcccatgtggatgaagaagaaagtggccagcttgatgaaatcactgagaccttggataccaggggaggaattgcttgtctggtagggatgtagctttttcatggtgtagcttattgaagacatgcagcctgggtggtgagcttcaccatggcctcctcctttctccccagttcctgcacatcatttcttaggacagagaccaaattcacatccacagtcacaaaaaagggtcatttgtatcacctacctttattttccctgggctttgaggtaaatgtaatattttgcaactgaaaagtacagtttgctcaggaaagcagagtaagcagaaaaaaaatcattttatctggaaatgaatgagcctgatgattagatggaacagagtcatccagtcttggattcaaatctggctctacaactcagtctcaaatttgacccataaagctgttcagtcatctttcccaaaattagcagtgtccatgcaaatggttcagttagccaaagaatcacagagtacactcatcccccattgtggcttatctgtggcagaaattcctgcttcagaaatgaggctctccctctgaccaaaagaggctttctctaattatgtgcttgtgactctgtcttttctaaaagcatccacattttttaggtgctgactgtgtgcctggtttggagccaagtatagaaagtacaattgccctcaaggtgcagatgctgccctcgaaaagctttgccgaccctgactctgggggttctcccctcacttggacctagtgccccagtgggtagataagagtgggctctgcccgtgttgccccattcatcactggggttgattccactaatctagcaagtagggtcattcattcattcattcctcactgcagctctccttctatagttgggacactcttgactttccatcagttcgttgaattctcagtgttgctgttttgtgcccctgggggttttccacctactgttttttcatcagcctaatttttactcatctaccagcccccaatgaaagtgtctcttctaagtttttcctgactctctagagcagctctgactactgtaggtcccttttgaagcctgcccagtactcaccagacttgttaatactttccagtatctggcccttccacagtgatgtaagatccatgaggacaggaaccgtggtctcccttatttcccagcttatccctgtagtgtctggcccataatgggtgctcagtaaatgtggaatctgtaatgtgaatgcatgaatgaatgaatgaacaaataaatgaacaaactggtcaatgaattctagtttcacttttccaaaggtggatgcaacaccagagatggaatttttctttaatcaatagtatgtaaggagctataattgccagctagaaagtacaaagcctgagcagggaaatccattaacccatagaccatctttgtcccaacaatgttttgggagcagtgaaagaagtcagctattcgtgttgaggagaattggaaaatggtggaaataggtaaaatatagagcttataaaattctctgtggacttcatttggcaccaatatttagtttcaaggaaatttccagaatacagaccacacaattgtacttaaatataaataaaaacaatactttcaggccaacatcaagaatttgggggtcatcccctgtttatattaccccaatcattcattgaattctataatcaaatattgactgtggctttcttcttagtctgtattttatttttttattggaatatttccttgcttacagcttgccgtattgcagactattaaaaatcctgagtctgtgcagaaatatactgggttctagtgccattcctgtccctgctagcttggttagaaagggccctgttcctctgtgcaacaactttccatttatacgtgaggagctacggagacctttgcctcattagggagctgcctatgaaagtctctctgaaaggacttacatcataataggaattcaggtccccgaaatggcacattatcatggtctgaacctagtgccacgtacaccttgtcatacctacatttcattaaggggagtcatccgcaagcatccgggactccaaaagctcctggtgccgtgttccaagaggagttcttgacttcaccttcaaaggatactccgtgatagagaaactttcggaatgctttcctgagagccaccttctcggtcccctagtccaaacctcctcctggaaggaagaaagaattggcccagtttctgaagcctgtgtagtaataattagcagtggcacactggcaccacttggcacataattagagtcataagtaactgagtaagtggaccgtcccctaactcactttggggtcttattctggactctggcatggtctgtgattgttttccaccagagactggaacgaagaatgtgggagtggggatggtgggcatgggagggagttataatgaaaggagcatggaactaggaagcagacctcaggaatccagccactaggctagccaacacttattaagcaccttttgtgtacccaacttgatagagctgaggggcttagagcttgctgcatggcctgagtgggcctagggcaacttttctaggctatttcatcatctttaaggtgacagggttgaagcaggtgatctctgcttccttctggctctaaacagtctgtgattcatttcaataattggaagtaaagcatcccccactcctttaacctagtaggcatgagccaggaataacatctggcctcccgagtcatgtgaacgcttagtagaagtagaggaatgcagaccacaaagcttgtagtctattccagcagctcagaaagtagaagcaatgcttcataggtgccctggacaccattctcctcgccctgttccctgtgctaatctggtcaccattcttcttgccctgttccctgtgctaatctggactccattctccttgccctgttccctgtgttaatctggtcaccattctccttgccctgttccctgtgctagtctggtcaccattccccttgccctgttccctgtgttaatctggactccattctccttgccctgttccctgtgctaatctagactccattctccttgcgctgttccctgtgttaatctgctcaccattctccttgccctgttccctgtgctaatctggtcaggtcccatccatgcatcttgcatttgcttcccaggactaagtgatttaaaggacacttcagcagcaaggttgagcatgtgaccagtacaatgcccagttcgaaagtcgactccctataccgtgcttgaacctctaccacacacatgaagctcaactctccgtggtttgcttttgaggaatctgggagtcgcttgtgcccaaaaatccttttccttcccacggatgaaaatgcagcacgtagttgtgttgtttcaaattttacctattaaaaattgttttgagttgataagaatttctccctcaaaatctaaactcatctatgaaattattaatcattaacacctgtaatttcatctaataaggttgcctttttttttttttaacaccctgatgggatcagacttttctaaaggaggcttggaagttttgactgggtaaagagggaacttctggagaaagctgctctggagaaggcagcatttgtgaggccacactaagaaggccgttggtgagtccttcagcccaagtgaaagagaaaacttgtcagaactaagagggatggaaagggagtaaagacaaacgatgcttacttcacagtgtggatgtgaactggtccagcgctaggtctgatgattggttatggaagagactgcccccgcgggaacttacgagcctgaagtaatgggagctacatgtaaagagctgcctcatagaccttcagagagagggagacagagaggcttcttttccccagcagcataaatgagcccattttagcaaaaatagctgtaatttgcacaagcgttaagaatctgcttccaactgtaaaaaaatactgaaatatccagggcatagcaaggctgtggttcggccctgtgacatgatgtgtgatcttgaaaagtaatgaaagtggaagaaggcgttgtaaagataccgctctaatgaacacaattctgtttgccagcattttttcctgctagcaaattatattactccatcaacttggtagaacatcaataacatcttcagaggatagctgtgagagctgagttactctatgacaggatttttgaagacaatgtaatttcatatttctcaattttctttgattttgtgctgagaaaatggaagaccataataaatattttccacaaatggtgtcttaaatggaatcacagctggtagcaacagtattctaccgtttatttagatgctggattccagattttctatgtgaaacaaccatgctggcagattcattggtttcacatttttctaacactttttttttttttttaagggatgaattaggcttcacgtgtgaactcctggtgggcgctgtgggacgggtgatgctgggctgccagcttgtttgtactcagtggtctcagagtgtgttagggttcttgcattgattggaaatatttcagttaagaagttaacaacgtacatgactgttaggtgaggttcagtgaggcaatgagatggctggagagagctgggttcaggaagcacaggctgagttccgatctcagccctttcacgccgtgaagacttggccaaatcacctcgcctcttggaactttgggttctacattgcgttagcaacatgataaactgtacagttttaatcaatgaagtagtggatgtgaatttggcttgtggtgtataaagatgccatacttactgtacttacatttattaggtagtataatctttgttgttttgatatcatacccaggtttccgtaggcttctttttcttcttaatattctgttgccaccatcccccccccgtccacaccccaactcaactcagtgcttatccttacaaagctttgttctcaactagttatcatggtaagtttttaggtaatagttgtagtatctagtatctccaagagtgattgctttttaaaaaaaaaaaaaaaaagcaaaacttctacaagttaaaataaatgtaaccgtggtatagctgcatcctaaaaggctcttagaaaattctggctgggcaccatggctcacacctgtaatctcagtactttggaagaccaagatgggaggattgcttgaggccaggaatttgagaccagcctgggcaatatagggagactccatctctacaaaaaataaaaaaaataaaattagccaggcatggtggcatacacctgtagtcctagctacttgggaggatgaggcaggaggatctcttgagccaaggagtttgaggttacagggagctatagtcacagcactacactgcagccggtggcagagcaagaccttgtctgcctgtctctcgctctctcttgctctctctcttgctcgctttctcactctctcacgcactctctctctctctctcgctcgctctctctctgggggagaggtgccctgtctcttgaaagaaaacaccaaggggatggggaggggttgggcaaagggatccttatggtgaggaatcacccacccaaaaggtgggagtaggcaagtgagtgtaaattaatgcttctttggccttttgagcacctagcgggcagcatgtgaaaggcacagtattgcatctgcaagtataatagaaccttccatgtgagtgataaaaacttagtctgttgattgaaaggacttagagagcctctgaggttataacataatacctggataaagtggaaattactttagtggaggattttttttaaatgctcctgtatttttttactgtaaccattgtgacaattggtattttcaaaagatgtccactacaatatctcctcctccacattctccgtaatgtaacattaccatttccccatcaaaaaattgagtctggcctggcgtaatggctcatgcctgtaattccagcactttgggaggccgaggcgggtggatcacttgaggtcaggagtttgagcctcaagtgatccacccgatccaaccttgaggtcagcctggccaacatagtgaaaccccatctttactaaaacccaaaacaattagctgggcacgatggtacatgcctgtaatcccagctactcaggagactgaggccagaggatcccttgaacccgggaggcggaggttgcagtgagccaaaattgtgccactacactccagcctgggcaacaagagtaagactccatctcaaaaaaaaaaaaaaaaaaaaaaattcagtctaaattccctccccttgaatctggttttccctaaatgaagctcttgtaactgctagaatgcagcagaagtgaatcaatgcgacttccaaggctagggtggatgaacccctgcagcttctgccttggtccttggcaacacttggctttccagaaaggtcattcttgtgacattccctcttagaaccaagctgccatgttttgagaacctaaaaggagaggccacttaagtactcttgttgatagtccctgcttgagttcattttttggtcacttgagctcaggtgccagaggtgaaaatgaagaagccatcttggaaatagatctttgagctgcagctgttttgagacacccttggccatttaagtcatcctagctgaggcccagatataatagaacagaggggagatatccctgctgtatccttcgtgaatttctgacccacagaatatgtgaccataagaaaatggttattattttataccactacattttggggtggtttcttacacagcagtagatgactagaacaaccatttgccatacatagatgcttagatacctctcctgcaacacttccaaactagcttttccaaagtacagtggaaaactggaaacagggcagcagtgtggtaagtgaacatcgcagaattagcatgagaactagtgcttgctacttctggtcttcagtagtgtacttctctagaaacatttgaaatcagatcacatcaatcctctagttttgctccttttccaaaattgtgctagctgctctagttcctttgcctttgcatgctaattttacaatactcttgtctatagctacaaaaactcttcctggggttttgatagaaattgtttggcctatatatcaatttggagagaattgacaacttcactgtgttgagtcttccaatgcatgaacacagtgtggctctttatttatttagatctttcatctgtgtttcgtatgttttagcatacagatactgtacatggtatttttaggtgtgtatctaagtattcaattttacattcatacctaagtaattttgtgttactgtgttttttattttggttttcatgtatgtcttgctagtctgtagatatataattaatttacgtgggttgagtttgtcctgctgctttacttaattcacttattagatctagaaatgtttttgaaaattccttgggattttctacataggcaatcatgttacctgtaaataggggcagcttattttttcctttctattctatatcctgttattttttttttgccttattacactggctagtacttccactattatgttcaatatgagtatggatgacagccatccttgctttttctcccattttagtgtgaaagcattcagcattaatgtttgctggtggaaatggtacacaagttgcccttggcttagtgctctttggattccctcatcagatctgtaactggacaacagatggatatgctcagtctacagctggttctcacaatccagtgtatttttatctattgggaactggttgactgaaatggcatcttctcttagcttgcttttctggtacatgaaacaaagtaccttgaaaactgaatactgtagaatgtacttctgtgaaggctcctcatatctcagccttctcttatcacgttatgtatgatacctgcttatgcccgtattcaatgtgacaccattcctgccacttctctccactctctaccctgcattttcccagaagttaaagtctgtatatggaataaacatattggctgaggagagagggaccaaaatgactgcgtatgtctgctgtagaagccagccccacatggtgcacagacagttgtgcagattcttgcttggtgcagacttgatttctgatccatgattctgacagtgtgaagggtccttgtcactcttttcagccaggcagtcttaccctcatagcgtttcactatgcattgccctcagcaaaattgtggctcagaagaactcctagactctggcattaggtagtctctttctagactcaggcattggccctagttttaaagtgttttaagttgaatttaatttttttatatttaaatctttttatatcttaataggtatttaaaaattaattgggaatgttgtattagaggtaaattgttagatgccgttttgactgtgagtatctagtttaatcattcaattactgattttgtcacaggcagtcatagcccctgctttaagttgccaaaatagcaaacaagccattaattatatttgcagaatttaaaaagcattgccagcagcttctcaggaccatcaagtcaaacccacatggttttgccacttccatgccgtcaggtgtttgaattcctgcctcactttgacaatggcaaaataaacagattcccaaaggggagaaatctttcttttcatgaacgtttactcttccctcatctttttccctttcttcctccctttgaaaaatactgcttgagcagtacttatggctatgtgtttgtgctttaccaaaaactgtcaaaatcttacaagttgataagtatgaatggaataagattattcatggctgcaggggctcctctggagacaagattaaaggaactacagtaatttgacctctaagtagggatttgattctctaattaagcataggaaatgcatatacccttccacaatgtagaaggagtgatacatatttggtttagagggagggtaaagaactagcctttttgcctggccttcagagactgtgagaggagagggtgcctgagcaaagaaagctctgaatgcgtaggtatcagacatagtttcttttttaaaaaaaattttgattagttaatattttttttttgagacatagtctcactctgtcatccaggccagagtgcagtggcacaatcttgtctcgctataacttctgcctcccaggttcaagtgattctcctgcttcagcttcccaagtagctgggattacagatgcatgccaccacgctcagctaaatttggacttttagtggagacggggtttcaccgtattagccaggattgtctccacctcctgaccccagtgctcggcctcccaaagtgctgggattacaggtgtgagccagcgcacctggcccagacatattttctttaatggtcgctatggaatttggaggagaccattataagacacatgtgctgaactgttttaaattgtatatttttaatgtaatagcaactaccttgcaaattggtgtgctaataagagaggatggaaatggggttacttgcagagagttaggtatataaatagtgccctcaatgtgtgatcattctttgactcttggaagaaggtggcatttttctcaattttcccagtactatactttatagttagcaaattacactggatttgatttagtggttaagaattccgtaatcattttgcctggaatcaaataatagctctgccattttctagcaagttacttaatctgtctatgcttcagtttcctgattgctaaaatggcaacaataatagtatctgtctcataaggttgtttaatttttaacagctttattgaagcataatttacatatcataaaattcaaccattataagttgtacagttctgagttttagaagtttttatggttgtgcaaaaattctcacaatccatttttagaatatttctagtatctccaaagttttcctgaggcctgtttgcagtcagttcatacccatacccagctccaggtaaccacatttctgcttactgtctccatagttcagctttttctacaaatttcctatcaatggaatcatatatgtagccttactttactgctttctttcactcagcatgttactaaggttcattcatgttgtaacatgtattagtactttgttactttttattgctgagtagtttacattgtatggatatagtacatcatatttatctactcccagttgattatttgggttatttccacttttttggctatgatgagtaatgctgctgtaaacattcacatataagaccttgtatggacatatatttttatttctcataagtagattgattcctaataatggaattcaggggcataatgtttaatctttaaaaaaattgagatagcgcttgcataccataaaatccactttaaaagtgtacatttcagtgggttttttagcatatttacaaggttgtacaaccatcaccataatttaattccagaacattgcctcatgcaaaaaaaaagcctcatgcttgttagcagtcatctccaaccccctttggccacatcccatggaaactactaatctagtttgtgtctctgtggatttgcctattcgggatttgtcatataccatttcacataaatggaatcatataatttgtggccttgtgtgtctggcttcttttacttagcataatgtttttaaagttcatccatgttgtagcatgtataaacacttcattccttttcatggctgaataatattccaccatacggagatatcaactttgtttatttataaaatgataggcatttggattgtttccatttctgggccattatgaatagcactgctataaacattcgtatacatgtttttgcatggacttgtgttttcatttttcatgggaacacacctagaggtagaattgctaggtcatatgataactctgtcgtttaatgttttgaggaactgacagatcattttccaaagtggctgtactattttacactcccaccagcagggtatgagggttctcatttctccacatgctcaccaacacttgttattatctgtctttttggttatccccatcctagtgggtgtgaggtggtactacactggcttcgagtcacgtttccctgatggctaatcatgttgagcatcgtttcaggtgtttatgagccatttgtgtatcttctttggaaaaatatctagtcagatcttttgaccatctcactcgagtcttctgtttaactttttaggtaattgccaaaatgttttccaaagtgctttaccattttatattcctattaacaatatatgagggttccagttcttccacatcttcacaaacacaaaagaatagtattgatagtttgtttgattttagccaaaaactgtcaaaatcttacaagttgataagttgataagtataaaacaagattcatagctgcagaggcacctctaggaacaagactaaaggaacttgtaatttgagtaatttgagtaatttgagctctaagtagggatttgattatctaattaagcataggaaatgcatatatacttccacaatctgggagaagtcatatatatttggtttagagggaggatggagaactagcctgttgacctgtggtaaagggtacgtggtggtgctcattggaaaacattttcctggtacctaattatgttgatcattttttcctgtacatatttggcattcatatattgtctctgtagaaatgtctattcaagtctcttgaccattttttcttttccttttctttttggctttgttttattgagttcttgatatattttggatacaagccttcaatctgatgtatattttgcaaataatttcactctgtaagctgtctttccattttctttttctttttcttttttttttttttttccccttgggacagtgtctcactctgtcacccaagctggagtgcagtggcccaatcttggctcattgcaccctcctccttctgggttcaagtgattcttgtgcttcatcctctcaattagctgggactacaagcgcatgccaccacacccagctaatatttgtatttttagtagagacaggatttcaccatgttggccaggctggtctcgaactcctggcctcaagtgatcgacccgcctcggcctcccaaagtgctgggattacaggtgtgagccaccacgccaggcctccattttttaaatgtatcttttacagagtagatgtttttaattttgatgaaatttttccatttttttcttttatgaatcatatttttggtgtcatatttaagaactcttgcctaactcagggtcatgaagattttcccctacgtcttctaaaatttttacgagtttgtatttaggtcaatgatctatttgagttcatggcctcatcattgaccttgatatataagttatgaagttcaggttgaagttcgtttttcttcctagactagactatacattttccaaagaagatatacaaatggctgataaacacatgaaaagatgttcaacattattaaccattagggaaatgcaaatcaaaaccacagtgagatagcacttcacacccactgggatggatataatagaaaaggtagataacaggtgttgttgaagatggttaaaaatgccatccttactccattgaattgttcttatgcctttgggaaaaaaaaaataattggctacatttgtgtgaatcaatttcttgaatttctattgtgctccattcattttgtgtctatctctttgccagtgccacactgtcttgattactgtggctttctagtaaatctgaaaattggattgtgtgagccctccaattttattattttttagaattgcttagactcttgtaattcctttgtgtttccatataaattttggaaacagtttgtctatatctacaaatatcaagcttggatttttattacagtttcactaagtcaatttaaagagactcatcatctttactatattcaccttcatttttaaatggtagtttctccggatataggtatctcggttaatagtttgtttcttttgacactttgtatcattttcctgccctctgtctttatttctttggggggtgggggcagggtgtagagacagtatatctggtggttttggtttgggaactgaacattttaaataatgtgttataactgcattctgttttgttctgagagtagttggtgagcattttgtggtgtattgttttgtaacttgcttggacttcagctgcagagtgtggagtacgcagtggagctcatcagtattgtctttgcttagtgtcttattctttttcttcttttttgtgatgtgggcagaccattaagctatgcagaagacacagggggacctctaggaaataccttgagcctataaggcttccactctgctggtcacttgtgtgtgagaagatacatttaaggtcctcaaatctcctctgatttttacttttgatgaggttcttttgggtctcccttgtgtacatgcaatttcccagttatccaggtgatacggagagttggtctcattccttctaaggctgacttgggggtgaatggtagatgggaatagcctcaggcaagaagaccatagaatcctgattttcttaccttaaaatatagttatttttaaaaaaataaacacttctcaattttttgtctaccttagatcaatttctgatgccctaaagtggttgcctttggcaattttgactagttttgtactcattttctatggacaagaactactaattactttacaccatcattaccagagtctgcttgaataagattttttttttagaataaattcaactcaaagtccttaggacagtgcctgacatgaggcaaaggcactaactgtatgaactgctgttactgtaattaccattattcttactagtgatgcagacaactaggcagccccacctcccagacctattcatggttgtccattacgatcatttttttaagggatcctcttcctggcctcttatttttagtaactcctttgtcgtagagcaagtgtcagcaactgttctgtgaagagccaggtagtaaatattttcagctttgcaagccatacatcctcctacttaattctgctcttgtagcttgaaagcagctgtggacaatatgtaaatgaatagacacggctgtgtcccaacgaaaccttatttacaaaagcatgttgctcatgggatttggcttgtgaggtggagtttaccagcctctgctatcgcctcactttctcatgattctgcatctaagcagtgctagctgctctgctacaacaggctatattttttctttgaaaatcttcaaagaagagaacatctctgcttcccagcaccacaatacggcaccttccaacacctgtgctatggaaacccatcctatgacttcttcaaggtctgtgggctctgagtacttggcatctgtagtgattgatttcaataaagtaccagtaacactactgaaatctatgtcaacaacatcacatgagtatagggttgttaaacaacattgtagatacagatacatacggcttggtaagctcattgatgccaaactatatttcatcttctattttaaagtaaattgtgcagctttttattcatatttaatttttatgactctcctcttttctttccaaacaaggaaaaggtatgggttttttttaacgacaatgctcctttcttactgatgtaacactcaatctttgagatcgttaaatccctagattacctattaacctgactgctctccgcaaactggctttgtactcagaaattaaaacagaacattaaatcagttacattaaacagaacattaaaaagtcttaattaagacttttaaaattattaaataaatcacatattgtgaaggatatataagtcacagatgaactgtttaaagaattgtaaagaaagtatgttactttcttacggtcttcgtggatgtagagaggctttaaaacgcttgaatactactgtttctcctactgatacatatgctataattgttgtgtattttaatttttaccatattttaacccacaaaaattattttgtcagtattcatagatttgcccatattaagcattctctttgtccattttttcttgtatcttagaccatccatctgggatgattttcctttcaactaaaatgttagaaattccttttgtgaagatctggtgacaaattttcaatttttctttgtctaaagatatttttatttcatctttatcctttttaagagatttattgagagacagtttatacagcttacaatttatccatttattttttttatttttttttttttttagtatttattgatcattcttgggtgtttctcggagagggggatttggcagggtcataggacaatagtggagggaaggtcggcagataaacaggtgaacaaaggtctctggttttcctaggcagaggaccctgcggccttccgcagtgtttgtgtccctgggtacttgagattagggagtggtgatgactcttaacgagcctgctgccttcaagcatctgtttaacaaagcacatcttgcaccgcccttaatccatttaaccctgagttgacacagcacatgtttcagagagcacagggttgggggtaaggtcacagatcaacaggatcccaaggcagaagaatttttcttagtacagaacaaactggagtctcccatgtctactttctacacagacacagcaacaatctgatttctctttcctttccccacacttccccccttccactcgacaaaaccgccatcgtcatcatggcccgttctcaatgacctgctgcgtacacctcccggacagggcggctggccgggtgggggtgtcccccacctcttggagggggcggctgccgggcggagatgctcctcacctcccagacggggcggcggggcagaggctgcaatctcggctctttgggaggccaaggcaggcggctgggaggtggaggttgtagccagccgagatcacgccactgcactccagcctgggcaccattgaccactgagtgaacgagactccgtctgcaatccctgcacctccgggaggccgaggctggcggatcactcgcggttaggagctggagaccagcccggccaacacagtgaaaccccgtctccaccaaaaaaatacgaaaacccgtcaggcgtggcggtgcacccctgcaatcgcaggcactcggcaggctgaggcaggagaatcaggcagggaggttgcagtgagccgagatggcagcagtacagtccagcttcggctcagcatcagagggagaccgtggaaagagagggagagggagaccgtggagagggagagggagaccgtgggaaagggagagggagacggtggaaagagagggagagggagactgtggggagagggagagggatttatccatttaaagtgtatacttcagtggttttcaatatattttaatatatgtgcaaccatgactacagtcaatttcagaagattttcatcatcatcagaagccctgcacccttcagctcttcaatcttattcttgaaagatgtcttttgggatgtagaattctagaggaggagtttgttttcctcagaacatggaagatgtcattccactggctttctttcagcttccactctgcaactgcttgtcagctctctgggactcttgcatgtaatctgtttccttctgttaccggcaatcatgtcttacttaccattccaaataagttgaacgaaaggaaggatttcctactagaccccatcctgctggggagacagtgggcttgctcttttgtcccccaagtcccacagagcagaggaggacagagactccagcagaccagcagttcagctattctgcttatttgtcaggagtccttcttcactcacattctggcctgacaatgccttcctatcttgccagcatcttactgctttttagaatatttcatcgagcgttctacattgttttcagtatgctcccattgaatcggtatagctaccatgcctgctgcatttctaggagtagaatataaaccaacttttataaacttgaactaaaacgttcaaataaatttaaaattttctgaaaattttaaactttctgctgttaagtttcttgaggaatgatctgaatgatatgaccatctttggagggcttgagtgtgtacattcagaactttatcccacacaaggatagactatacagaataaatgcagtttttgtagggaatatctcattaccattttttctcaaggatgtattaaactaaattatggttattttatacttcagttgtgctagccagcctttttgaaatccttcaagatgtcatcaaatgtttcacactctaaaaaaatagtgctgtcatatatgagacaggcaaaaggacagcattatcactgttaggagtcttcaagaggaaactgtttacatgaagtggaggactgtcctgcctgcctggaagatgctggccagtcctcacccctgcgccacactgagggccatccacacagcccctgaggtttccctgctgccagccaggctgctcgcgggcatgagagtgaggaaatttttaagtccagtgtgaagtgaaaataattgaacacacttaatataaaagttacaaatataggcaagagtttctcagtgtgttttctagaaggaaagaccaaaaccccagtttggttcattattggatgcttagtcctatctgcaacataagtctttcccttaatgaggacactcacccagaatcatctcaactactccaggctttcctgtgtgttgctgcccaagccccttgtattttaaaagaaacaggcaaatgtagcagtagttcaagtggttttctgtttttttgtttgtttgtttttggctgtggaaaatgaccattttgatgctatcatgcttttttttttttttttttttagtgattctccccacccccaacccagtgtgtaatctccatgtgggtgcaacagtgcattccactaattaccatacatttactagccctggaaacttaataatactagtttgtgttcgtatggagttgtatacatttccagatgctctccaatctcttatcacattagttgtgaaatagtcattcaactaactggaagagccatgtcttcagcccaaatcttgtatctccttcattctaatttatctactgctttcctaccctctgtgctcctgagtctgaataacatggacatttcagataattgaaagtctcttttattcttatctgattaaagattctaataatggatcatgtgcaaagtaactcttaattgtcaaactaataagagtaagaaaaccctacttctaaaaaaaatatgtatttatttgtagagatagtcttgtctgtcacttaggctgaagtacagtagcaccatcatagctcactacagcctcaaactcctgagctcaagtgatcctcccacctcagcctcccaagcagctgggaccacagctgtgcaacaccaagcatggctgactagttaaattgtttttttttccttttgtagagatggcatctcactatgttacccaggctgcacttgaactcctgccctggagcagtcttctctccttggcctcccaaagcactgggattaagggtgtgagccatggcgcctggcctaaaccccaccttttgagtgaaggacctatttggtggaaggttttaagagaagtagaaatgtatctcagtttatgaagtaaaagaaatgcaagaaaaatttcattgcattagataaaatctcactgtgatgttgtcaaatcctgtgtgacaccacgaattttctttctgttactcacatagagatgggggagtgcagatccatcttaatgatatgaggccaatagtacatatcagaaaccaaacaagagctgagggttcagtctgggctggaacccaagttctttttcttttggaaacaagaattcacggccctgatctccctgtcaccaacaaagcacagcagtagaggtgatggagaagcagtgattcatcacccacttgggaaacagcacctctccagagtagcagcctgggtgaattaaggtcatggtaagaagtagttctccgtgttctgaggtggtttcatgactgtggggcccatctttttttttcccctttggttttgtttcctgatgttaggaccttttttttccctcccagcaacaaaaatatatcatattactaataaagttatcctaccacaaaggcataaataacttccataaaacagctgctttaaattaaacagagcctaaggaacatcagaagactgactctatgtgcctcttcatgcctctttgtcccgtttactcctggcatatgacactgagtttctacatttgctttaagacctaaagcgaagccttttaatgttcactgtgggctgttgctccctctgctattattctagctatcaagtctatgtctgtctaatgtcttgaaacagcattggaaggctgttatatactgttcattgaatgtatcattttatttctacagaaggctcaaaatttagtaaaattccaaatcttttgaaacttgaggctatctcctgaagtccatcatttctaaaagtgaaaaagtaaaatccagtgccctgattatgaaaattttcaaatgtacacaaaaatagaataatatgaactttcatatgtctatcatccagcttcagtaattcttatcaagattttgccacgcctaccttatccctcatccttcttctttttccctttgctgaattattgtagtttctgtgcaattcttagcattttttaatctgtgacttgctgtctttagttttgaaaatgttccgccattacagccatatgtatgtatgtatgtatgtatatatacatgtatatatatgtatgtgtatatatgtatgtatatatgtgggtatatatatgtatgtatgtatatgtgtgtatgtgtgtgtgtgtgtatatatatagcttctgccccattctctcctttctctcatttgagattccagttgacacatatgagacctctgctcctgtttatttctgttacattgtctctgtatctttgatggatatgttcatttgacctaccttgcagttcactaattctttcctcagctctgactaatctaatgttagactgttaagttcttaattttagttttctatttttcagttctaaaatttccactggttattttttacataatttctgatttttctgctaaaattcttacatattatttaagttctcaaacatatttatgagctattttaaagtctgtgtatgagaaccttaccatttcagtacctgtaggtcttatgtcactgtctatattgttcttcttggttttcagagagttcttgtctttttgtatgccgggttataattttaccaaatgcagaacattatacagaaaatttgagataagttgaggctgaggatgatgttatctccttcagacatgtttacttttgcttctgggaatcaggatagaaagagttcgtaccttaatccaatcaggatttgaagtgattcattctttgtaatggctgctttatttctaatttactatacctagatagattgtagtcctttggtggtcagagtcgaaagccaggaatgtttactggagctccttgttatcattgttgatccctgaattccagtttctgtgtctccttttctatgagactgccaaaaatattgctcagctggtgagcctctctgtctctaagatcatcaaagggaaaagtaccaatgaatacaaggttcaccttccactctttccatgatcttgacttttcaagatcttgctgcctcagtggctccttgataccttcaaacagattcttaaaaatacttttttgtctatgttttcctgtttacagcatttcgtgttttcagcagcagataagctgcttggtctgaaataagctactccaccattgctggaagctgaaaatctgctgaagatacagttggccctctaaattcatggcttctgcgttgagtgatctctgctggattgaactggatgcagaacatgtggatatgcagggccagctgtgtttttgatctgcagttgttggaacctgcagatgctggacctggggatttataacccagcgataccatgggctgactgtaagagacttaaacatccacagatgttggtatttgtggggatcctggaactaacgtcttgtgcatacagaggactgactatatttaagtgaaatctcagatattaggtcatttaattcatacgtacctcagttttgtatctctgaaaaatgaggacattttttcttccatgcgcaatgccatttcatgctcagatttcctggattatcccagaaatatgtttttacagttgtcttggctgagtaaggatacacaaggtctgcacctcgtatttggctgttacatctcttacatctcttttaatctacagtattcttctcccgctaccatctttttctttcgatgtgattgacttgttgaagatcccgggtccgggcttttgtagaatttcccgtaccccagattcagctgactgctctacttgtccctctgtcccttgttttttgcatgaaatgggatttgactttgcagccttggttagattcagcttcagtgtgtggggttctgttttgtttcacaaggatcgttgaggggtggtcaaaaataattccttctgcgtcggatggcacttagtgtctagttgtcctccttcggtggtgctaagattgatcagtggatttagatggtgacaagttaatccacccactgtaaaattctttaccatccttttatctaatggtttcatcaagtgatattttctcccctcagtccaataattctccaggagttgcaaaatgatttttctaattctgtcatcattccacatttatcagctaaaattcatacaactggagctatttagttactctaagatacaatttaaataggcaggttaagttctcctttcaggttcagtaatatgttttgcatcagtttttaaaaaataattgtattaacttagtttgtgctgctacaccaaaataccatagacggtaattcaccaagaacagaatttttttttttctcacagttccggaggctgggaagttcaagtcatgaaatccaagatgaaggtgccagcaggttgtctggtgagggctgctttccatttccaacatgatgtcttgttgctacatcctctggagggaaggaacactgtgtccttacacagtggaaggcaaacaagctgaacacttcgtgaaacctgtgttataagggctttaatcccattcacaaggggaggagccttgatgacctaatcacctcttaaaggccggacctccaaacactaccacattggccattaagtttcagcatctgaattttggagggaacacattcaaaccaaagcagtagccctgaataacaaaggccttttcctaccctgtgaatgccaaagctgccatctgtaacggaataatgtgattggtaattgtgtcacgtaggaccaatagagatcagcaacctcagccagactgatagagatcctggcatcagatatttcttctccatgtccttttgacttcagatcccagttccctgactttcagcctccctgtaaaatatatcagtaagatcttggtgcttgtgggtctgagttaaagctggtgtgtacatttccttcttttctctgcttgtttaaacccatttcttcttatgcacttattcaccatagaaacaccaaaaacatttttttccaatctaggccaagcattctggaacatgtgattgctagcattatacctgtgaaaggaaaatttatatcacccaaacaagtaaactgccttgttgaatgattttgttgttatgtagtttgcttgtatgtttttgtggaagcgtttctatttctgaatcatggagtcaactcagactccactgcacccccttggatccccagattctgttaaatcagctgcataacctttcttgtaccaagtccttcttttctgttgatattgctgctatcctacctcaagtatttttgcctctagggtctgttttccaattttcttggttttctattgtgataaaatatcttcagccccctttggtagtgcctcactgctggcaaggtaagtccagagttcctagctttgcgcgtgtgtgtctgcacagcctggcctcactgctggcaagagaagtccagagttcctagctttgcacgtgtgtgtgcctctgcacagcctggccttgagtgcacctcccttcccactcccctcctctgctggccggaccagcatgctcactgccctttggcattcagcttcctatcccatcaccagagcaaccatccatcccttcccttgtcccaggatcccatcatcatctccagtggaaacacactcaggctctgccactcccctgatcactgtggtcccggctgctcccagagcacacattgtgtggtttcacacatattgacggggtttcaccatattgaccaggactgtgccctggtcaggtggctgtcacatgcctttctatatcatgatttcatttgcctcacctgcaaactacatgctaaccaagggcagggactcactttggacttctgcagattgcttatggggccggacccggaatccagtatcttgtaggtgcatcttcccctcaccttctcactcagactcctgctttagtcctcacggtccttggacacacctgattgctgcttcactttggactcttaatcccggtctttatttttgacaatcctatcaaaagatgaccgtctttttgtcctgtcaagactactacctccaggccctcttctctccccatccctgctctacaccatgaagtggatggaaggccacacctttgaagaatgtctcccagcaggagtgagcttgaccagctttccttggagttatactccagcaaggaatcatgatttttattctctatgtcagctgggaggcctccagaaaccaaccaggcccgcaatcagcagccccatagagctgtgaggctgccctggaaatatttatttggaagtgcccctggacaagcgcttcctcatgctctcctttgtaagctctacttcattttgaaatatctgagctaccggggcaggtacctgtcatggcgtaatgacacaccgctttctctgccatcgtagaactgaagattgtctttccttctgctaactgacatgacagacatctacttagtggagtgatgattagtgtaagatcactttttggcctttaagtttaatgatgctacattcgtagtaataatataacaccccaaatccaggcgtgcttttcaaggaaagtgtccagggcagttaccctctgatgatggcgtcctgcccttatgccttttgtctggggatcttaaagtcatttctacacaaatagataatgatgttcatttcgtaaggggtgagaggtaaagtgattgaccccttggcatactgaagagatgaagaaaaatccaggacccagtgtctcctttgttgttcccccttccgctcccttttcagcctttttttttttttttttttttttaagacagagtctcgctcttgttgcccaggctggagtgcagtgctgcaatctcggctcactgcagcctctgcctcctggattcaagcatttctgcctcagcctcccgagtagctgggactacaggcgcctgccaccacgtccagctaaattttgtatttttagtagaggcggggtttcaccatattcaccaagctggtctcaaactcctgaccttgtgatctgcccacctcgccctcccaaagtgctgggattacaggtgtgagccgccgcgcccagccccttttcagctttttaaaagaggcatgcccaactttctgtcggtttaaatactttcctcccaggtactgctttctacttcttaagagcatgaatgaaaaaaaaagtgtttctatatcacatttcatgggaggaagagttaagattcagcgagagggaatggtttgcagatatgtgtgcattttcagagaacatacctgtctctcctggtaaatccgcctcatcactgttatataatagagcttagatggggttctctgggttcatggatgaaaagcagttggaacagcgcctggcacatggcaggccctgcgtgagtgatggattctaggtcatcttagtgatgtctgtgggcaggcacctccgtccctggagaagcagcatttagagtgtgcccttgctcgttctctctgacggttgggatatgcttcccttctcctacccagccaagcctctccaaatccttgggagccagtgtaagtccaatttcccacctccaggaagccttccccagtccaaccaaccatcagtcacctctttgtcttcacaatacttgtatcattttctcagttcaattcaacaaacttgaactggacatctagggtatactaagttatgccttatttgggcgctaaatcatgctccgtcctgtaacattgttttaactcctgcaggaatgtttatcttgtgtctaatgggatgattcagcctcaaggaaaaaactttttttttttttgaaacagggtctcactctgtcacccagggtggagtgcagtggtgtgaaactgcagcctcagcctccagggctcaagtgatcctcccacctcagcgtcctaggtagctgggactacaggcatgctccactacacctggctcatttttgtattttttttttttttttaatagagaaagggttttgccttgttacccagggtggtctcaaactcctaagctcaagcaatccgcctgcctcggcctccaaagtgctgggattacaggtgtgagccatcgcacctgtcctgaaaagctcatttaaactgtggttttgtgtgtgtgtgtgtgtgtgtgtgtgtgtgtgtaggcatttccaccagagacaattctgcatatacagcgggggctcagtattctctaagagtaggggtagggggtattggggccagaagaggccaaactgctcatatttggttaaatccaatatggtaaattcttgttgaattgaagtaatacagctcttcacagggtctgaaacagcccatagccggagtcgtgtgcgtcctctttctttggtccacgacaacaccgtattctattctgttctatgtgaaagggtccagtatggattgagttcctcctgcatgtcagacatcatggagaacgcagatggggtgcctgaataaaaagcactataatccagtgagatgataaataaatacacacgtgctcataagaaaggtgtaccatgatggactccacagctgagattcaatcaaagggctttgcggttaaaaggggggtgtggtaggatctagttgggggatgatgaaaactttgtttattcaacaaatatatattgagaggcaatctgctgttccagggctgtgctagtgctgatgctgatgcttcatggaagagcttggaggaggagattagcacctgttctccccgccccacccctcccaaatatcaacgcagagctccaaacttttgtttctcttctctagtgtttatgagggagaccttctagtcctgtcattttttttccctaacacaaaacacattctgaggagctggagaccagtcctgtgtcaattcccctcagtactgcattctcctggattgcaaagctgatttcctttcagtagctcattaacattcacagctagtgtctgcttccactttcgtagtctcctgatgaaatgctgactgcaaaggtgagggctgctgacactgtttgccgtttggtttcttccaggatttttttcccaggaagccatcccgtcagaggggttcaagtgatgaaagttggcaaactgcagctacatcaaggcatgtttccccaagcaatgaagaatctgagactggtgagtgtgccaagatctcacatagttctgcctggcatcctttttttctgctgttgctgggcctctttgtgatttgttagcagctctatgtatgtgtgcacgcatacacacgcatgcccagtgtgtgctggtaaatgtttaacaaccactctggaaaaaacctgcttcatgacatttgcctatttctgtgatgcaggcatgcccaccatggctgattttaaatgtaaaatcaaccttcttataaaaataatattaacaattactcttgccactggtacaaaccagtctgagaacaccactgctcctgtgccctctccacgtttagcaagttgaccttgtttgtgcctcctccccattgcccacggaacacagtccgtgtccctcgcgtggcaagcccttgaccatctgtgtggcagttcacctttgcagccacttctccccgcccttcctctcttcctttccacccacccagtgatcactgctgttcaccaggacccactgtgaccctgaacttctcactcctccatcttcacacagctattttttcctctgccttaagtgctctccgcatcacaaccccctgggcttggcaggactctgctgatcctttaaggcccaattccagtgttactttgtggtcctacccctacagctctctgcccaccctgccaggagagcccttttcacattgcagtaggcatacccgatgaccacccttacccctgcccccaggagagtgtgagggcttcgtggttatcttggcaaccagctcagtgccatgcaagggatctggaacttaggaagtattcattattgagggaaggaggagggaggaagcgaaggaggtcagtgaatacggttctggcaataagtgtcaagaaactaattgggagaactggtttagggttggaatagcttgttaaaacacgatggttagtttcacccgctcagggagtctcctctgcccggaggagcccagggctctctgctgtctggcccaggccttcccacctcagcagaacttcctctcctctagtccgtgacccttccaaaggagagctcacatgctcacctggccaggcactggtgggttgtatggagacctggcgtgcgggtatcataggaagcgcttgacactttaacaggaccctctgggccgccatgcccttgtgtgcagaagagtgacggtggaaggatcgggcgtcagggttgctcagggcgtgtccaggggccggctgatcccaaaacactggcagccgcccacatggacctaagagaaatgacaaatgccgaagggattcttaaaagccagattccacagtgctcattttcgccgaatgctagccatagcgcctttacttgatctctaaataaagtcagcgtgtggccaacgggagtaacactaggattccctgagggcactcagctattctgttctttttatcatgtctggcatgtttacccaggcgggggaagaacaccgcaccgtctgttgcagcctcagggagaactttccttttctggtctgggggtacttgtcagccagtcgaatcagcaaggtacagcaaatccttatcaagggcctactgtgtgaaagtcctgacagaaaaacaacgtgcaggaaatttcctaatgtgcgatgcacccaacacagggtcacctgcaagtagatgttcgtaagtgatcagactagacctttgtgtttatatgggactagaaactatgaatactgctcgtacgtacgtgatccgtgatcatactcagtccccatgacaggtgacagctgtgtgaggtcaatgggacaggcattttcattcctatttggaaagtgaaggcgctcaggtttggagacatgcaagagctcacctaaagtcgcacagaggcagagccaggtgtatttgttcaatttaattcaacatggtgatcaaatacttctactactttgaataagactcaggctgggcgcggtggctcacatctataatcccagcactttgggaggctgaggcaggaggatcacctgaggtcaggggttcaagaccagtctggccaacatggtgaaatcccgtctctacaaaaatacaaaaattagctgagcatgataacgggtgcctgaaatcctagctgctcaggaggctgaggtgagagaatcgctttaacccaggcggcagaggttacagtgagccaagattgcaccattgcactccagcctgggcgacagagtgagactgtctcaaaaaaaaaaaaaaaaaaagactcaatatggtgtgtacaatttaatggaggagatagacatgtacaagtcattaaatccaggccagaaaccaaggctctgctcttttcctctagactggtccagttaaatagatgaggctctctagtaagatcagtgtgcagaaatcccttaagatctaaccgaacccatgatgccaactcagggaaaaatatgggagagaaatcagagaagatttagattgcttcttatgtgaagctttagtcattgctattgcatacagaacttctgaaggagacatctaataccctcaactataaggacaagcctgaacaaacccagacagacatctcgctatggattttcaggataatgtggcctgggctgatggtactgaccatcaccagcccttcagatgaccctcttactgccctttacatccctcatgcccaggtctgttctgctgccctcacacccttctgatgaggttgcatcgcctctttcagaagcttctcttcgtaatcatgttagcttttcctattcttggtaccaaggtgaagctcaggcatacaccctgatagatgccaaatgaaaggtattctgggagcagcatcagattatctgtcatgaggcctggggttaaatggtggccttacccaaacttgctgtgtgtctctacaaaagtcattgagtctcttgccaaggtctgatgatcaaccaaggagcaaacatgcactcctggcagagttgtagaaagagtgcaaggatttagagtcagtaggttcaggttccagtcccaccatttgcgttaatctctgaatataatttcatttgtaaaaggaagctgatagctatcccatagacttgttttgaggagtaagcgaggcaatgcgggagagtgtgcttgccaatctcaagcattctgaaactattaaagatgggtattgttacaggaactcttgttctgatcactctcccactagctggtctgttcagtacttgtgtttgtagtttggggtacacggtggttcctctggtgaacaattatgttctatgactgctccccagcagtgttttgctccccaaggtgagtgggaatccctcaagggaccttacattccttttgtgtcttctggtgccacctaacatagacacacatgcccccaatacggcaagttctgttaaatacatgcttgaatgaatggatttttttaatggatagaagtctttaaaagcctccccctgggcctgctggttagctgtttacagttaatggaccagatcttctcatgacctttgctgagcatttgctagcagagggatggcctgaatgtatccatccctaggaaagctcacgtgacctgtgagtctagaagcaggtcagtttcttcctgaagaaagtctttctttcctgagctttctcaggactcgggtaacctggagagggaaaagggaggctatactctttgccttttgaaactgatgtcatcttcagacgggcaccctcgggatgctctttcttgtcttagaaaccctggaaataatggaatgaaatcacttgaataaggtttttgaagactgagtttgaatagaaatcagaggagcttcagaaacagaaatttattacagattcagttaggctccagcctcctccaggaaaggaatccacttagcccagctctgatttggtttagtcttccatttccactgggctcagctgaaattcttgtgattgctgccacaggacagtcctggggtcccttcccagtgcttccctcctgccctctcctgtcactaatctacttttatttctttccatttatttcttagaaggcttttgtttgctactaatttgacttcttggacctcaaggacaacccatctgggctgtcttgttaatcagagttgttttttttcctgtgaaccctgcatgctgcaggctccctcaccctggccctagtgtagttgcttttcagcaaaaatctggttgcaaaagttagacttctttcccctcggcatccatttttttaaaaaaatctgtatttaaactttttgtattacaatttttcccttctcatttgattttattgcagtattttacccattgagcatctttttagctttttctgcatctcaacagacagcaccaggccgcaagtcctagagattgctccttgtattcctgcatcggctgccctgattttcagccccagcaatggctgatttagagcatgcagttctgttgttcccatgtcttaatccgctacagtgattcttaacctctttggttgtgtccctatttaggaatctgatgagggccactgactaaccagagaaaagttaaatatacacaaccttttgtatatttggtggggatggcagcttcagaggctccctgaagcccttccatggacttagtatccatggtgcctaggttaaaaagccctcctctaaacacttaacatcatacgttaccgtgtggggaggtgggagggaaagagggggagtaagagggcatgcggaaggatgtcccgtaattgtcactaataccttcaaagagttgtttggaagcccctggctctaatatttatgagtgattcctactgacctccaaatagagaataatagttccaagagtgtgtttttgaaccaaaaaagagaaaagataagaaaataatggataaaatgcaaacacagtgattaagtcgtattatgggaaataagcagaaatttaccttccaggaagtatgagttcagtagtaacaaggagccagatagggaacctgaacttgtactcccgcctggcagtaacagggtgtcatcacttcattctcttgctggagtgatgtcagagaaagccggctaaagcaggttgaggtaaaattcagagtctcataacagaatactcaaaatgtttgtgcttcagttaaaaatcactcactatgccaagaaccaggaatatctcaatcttaatgaaaataaaagcaatcagtagatgccaattccaagataacagagatgttagaatagtctgacagattttaaagcagccatgataaaaatgcttcatcaaggaattacaaacaccctcaaaataaatggaaaaaatagaaaatctcagttaagaagtagaagccgtaaagaagacacaaatagaaatttaacaactgataaatataataatcaaaataaacagaagggagctccacaacagaatggaggaaacagaggaatgaattggtgaatgtgaagataagacaattgaaactgcccaagctgaaaaacagaaaaaaatactgaagaaaaagtaaaattgaacagtgcctcaggggacctatgaatcagtaacaaaagatctaacattggagtcccagaaagaaaagaaaaagagggtgaggtggaaaaagtgcttgaagaaataatggtggaggcatccaaattggaaaggaagaaataaaattatctctatatacagatgacatgatctcatatggagaaagctctgaagattacacacacacaccaaaaaatgttagaactaataagtgaattaagcaaggtagcaggatacagatcaacacacaaaaatcagttgtatttctaaacgctaaaaatgaacaattcaaaaacaaaattaagagaataatgctatttgcaataacacaaaaccaagtaagttattatctgagaataactgaataagttattctccatgaagaaggcataaataaggagaatgacatctcatgttcataggttcgaagacttagtattattaagatgtcaatattacccaaaataatcttcagattcaatgcaatctctatcaaaatcccaatggcttttttggggaagaagtagaaaaatacatcttgaaatatatatggaacctcaaggaatcccaaatagccaaaagcagtcttgaaaaagaagaagaaatatggagaactcacagttcttgattttaaaatttacgagaaagctacagtagtcaaaacagggtgatactggaatagatggacatatagaccaatggaatagaatagagagcccagaaataaaccctcgcatatatgatcaaatgattttcaacatggatgccaagaccactcaatggaaaaatgacagtctcttcaacaaatagtgttggggaagctgcatatccacatgcaaaagaataaagttagaccctttcttaacaccatataaagtaactcaaaatggatcaaagacctaaacatatgagcaaaagcttctactagactcttagaagaacacattaaggaaaaagcctcatgacattgggcatagtgatgatttcttggatatggcaccaaagctacaggcaacaaaagaaaatataaacaaattggacttcaccaaaattaaacacttttgggcatcaaaggataccatcaacaaaataaaaagcaacccatagaatgggatatatacatacaagggaatattattcagccttaaaaaggaataaaattgtgacacatgctacacataaatgaaccttgaaggcattatgcaaagtgaaataagcctgacagagaagaacaaatatcatattattccacttatatgaggtacctagaatagtgaaatacctagagacagaagtagaacagtggttaccagagtgtgaagggaggaggggatgggaagctattgtttaatgggtacacagtttcagtacaagatgatgcaaaagttatggctatatggatagtagtaatggttgcacaacaatgtgaatgtacttaatgctactcaagagttaaaaatagttaaaatggtaactattagtgttttgtgtactttaccatattgtttttaaaaaaagaattaatagtggaaaactttgcaaatttggcaggcgacataaacctgtagatttaagaagctaagcaaaccccgaacagtataaaccgaaagcagttcacaccaagactgtggatcatactcaaacttctgaaaactaaagacaaaaaaaaaaaaagtcctaaaagcagcaagagaaaaatgacaacttacctgtacaggaaaaacaatttgaatgacagtgattttctcatcagaaaccacagaagccagatgaaagtagcatatttttttcaagtactgaaagaaaagaactgttaacccaaagcttgggttgcccttagaatgtatgttgtccagcaagaatatccttcaggaatgaagaagaaatcaagacattttcagatgaaggaaaactaaaagaacttatcgctagcagacttactgtaaaagaatggctaaagaagttctctaaacagaaagaaaatgataaaagaaagctcttggaacatcaggaaagaagaaagaatatggtcagcaaaagtgtgggtaagtaaaatgatctttccttctccccttgagttttctagattgtttgatagttgaagcaaaaattataacactatctgatatgattctaaatgtatgtagtagaaatatttagggcaattgtattacaaatgggggagtgggggagggtaaaatgtaaagggaaggtttctacacttgagttcaatgggtaaaatgatgacactagtaaagtatgataagttatatacatatatatctgtatatatacatatataatatgcatacacatgtatattatatacaagttatatatacatatatatgtgtgtgtatatatatataaaatatatataaataataagacgtggagcaaccacaaaactatataaagtaatacactcaaaagcactagagaatgaaattctaaaaaaaagtttaacccacagaaaggcaggaaaaagaaagaaaaagagagcaaacagaaaacaaaaaattaaatggcagatttaagccctgatgtattaataataacattgtaaattatgtcagtagtctatgtaaaagatgtaaattgcctaaatataccaattaaaagacagagattagtagaacagatttttaacaaatgactcaagcatatgttgtctgtaagaattctttttaaatagaatgatacaaataggttgaaagcaaaatgatggaaaaagatacattataaaaacacaatcaaaagaaagctggagtagctatatcaatattaagtaaagtagacttcagagcaaagaaaatgttatgagagacagagagggacattgtataatgaaaaaaaggtcagtctaccaaaaagacatagtagtactaaatatgtatgcaccaaacaacacagttgcaaaacatgagaaacaaaaactgatagaactgaaaggagaaatgagcaaatagacaagcacagctgggaacatcagacctcctctgtcaacagttggtagaacaactagacagaaactgaggagggatacaaaataattccataacaccatcaaccaatgggacctgacatttagaaaacacttcacccagcaataacagaatgcacatttttaagtaactataataccaaaagagaccattttatgccacaaaacagatatcaataaacataaaaagattcaagttaatacaaagtaaattatctgaccacaatggaattaaattagaaatcagtaacaatatttggaaacaaaaccaaatccacgccttgtagctgtgtctggcatggcacattgtacaacacattgggacttgggttgcccttagaatttatattgtccagtctcattatttagctgaggaaacataacttcttcagagtctctcagagttcaattaatatgtactgattgattgattaaacagtgatacaacagccatgctttttctggaatggctactaccactggaaagcacagacctgagctcaccacatctgtaacccctcctgagggtgccgtggggccacctggttcctccttcctctgggcgccccagcactttgcatctctgttgaacacacactgttccactgcaatgatctggtatttacattctgtccctctgactatgccagagcttctcccagggcaagggccaagttttattcattaaagctgctcagacagtattgagtgaatgaatgggtagatgttatctctaaggaaattctgcctcccaaaaggacatattcctccagcggaatacacacttgaagttatccaagatgtagagtggagtggggtctccaggggtgctgctgagctgaggtggatcatcaaagtctttgggattctctgctgtccttgcaaagggctttttgtgcctccagagctgcttaatgtgttgtacctcttgcttcttgcatttcctcctttgaatgccccagaccagcttcctcctccctgtgccccaccctctgcttttctttcattctgagttgggcagaataagaaaacctgctttattttttcccgtcgtgatttgattccaggggttcttatcatgcatacatttcttttccctctgattttatatccatatttaaatcatacttgggaagtcacttactagattcctcaagctcatggtagaaactgtttgagatccttgataagcttaatatattcatattaaaattaataggagaggtatattgtttccaactttatgatttgatttaaattcattttatttaatatatgaccacaattctaaaattacttaaaaaaacagatgagattgaaatcaattctggggaccctttctctattactgagttaactgtatgcctgtaatgtggcagacaagctatgctgcttttctcatgtgacatttcgagtctggatgtgggtgtagcaggcaccctccttggaggcttcaaatgagtgctctgtgaaagattatgtgcaggctctttttaaatgctaccattaaaaaaaataaaatttaatggaaagagataagcttttcccaacaccagcctgctccaattttatatttccttaatctgttttatatgctactgcaggaaattaaaccagaattgtcctctctgacatgcgcatgggtgacagatgggagtggtaggagaagggagacacagagctacttgaaacaattgctctcgtttgtcagaaatttattgtaacttttttgggggatggtaatgtgaggggaagccctcctcatcttcctgctgtactgaagggctgtgcccagggccacacagggccctctccgtacatcgttgaggactgtctgccccagctcacccagtgctgaagggctgtgcccagggccacacagggccctctccgtacattgttgaggactgtctgccccagctcacccataggcccaggtgatgttcaagacaaggaccagatgtcctcatcaccaggtgtgaattgcagcttcctgctgacctgtgtcacaccattcatccacgcacacatccgcacacacagtcactaacatattttgcacattactgaatcctacttctttcttctcgtttttctctccctttctcatctacatctgcccatctttcagagaaaagtatgtttgcttgtgaattaatcaaatctatatggcgttttactttctagacagatgatgtagtttcttttttttttttttcagttgcttcagattagttctctgcccctacccatacccatttcctctctgtttctagccaccctatggacgagatcctctaaacttagtatctcagactctacacacacattcctgagggttgcccctgttcccctttgctactggtgatgcattcagcatcaagtaagagaacacagaacatgaccagcagcatcttgacaaggaaggcacctgtgtcccctcagggtatctctgcagccatgtccaggagagcctctgctcctctccttggtcactgcagtctgttcatacggggaggctgcacaatgcagtcatggaatggacacactgggttgagtcctgagagccgagaggtcatccttagtctaactctcaagccaggtgacctcaggaagcacttccttccataacatgagggtattggactagatgatccttctggtctttcctcaaggaagcaggctgtgaggtgtggatgtgaagctggaggaaggccaggaaactcccccttcctggctgtggctctaattccagaatggctgaagaactggaagtagttaccgtactgtgggatgggcaggtctgccccttccatgaacaggaatatactggatcagtggggagtagaccttactcttaaagctgcaaaagaggagaaagtgaaactcaccactggaactggaagaaaagagcgaggaaggaagcctggagcctgtagtatgttcaaagcatgccagtgaacttatgttgttgaagtgacaagaagatggctttgtcatttagcctctgagtcaagtcagagagaagcacagatcattcttcagatggggaacctggggaatgtaaccaggagggcaaaaaagaggctggtctggaaattctgagcaacaaggccaggccctcacccagccgagggcctctgtgagggcagggagggaggcgaggccgagcaggttaggtctggcctttttcaggacggagggttacgtccctctctgcaaagatctttccaggcagtgattctgccccattcatcttcctttgccagatcacaagcactctggctctttgttgagtaaaagggaagagaacatctaagagtgctttcaagtaagaaaatttcccatgaaggctctctgatctgagaaaccttctctttccgcaatcgtgctgtcacacaggtctctgcctcagacctcaagatgtccagagcagcggaggatccagggcagtgtggagaaaagagaataaaacacgaggcatgtgctccatgaatgccatcaaacatttgtttttaatcttctgcccaggggaatctcatagagctgggctgcttgcaaggtgggggctggtcccaactcctcccctgcactccggacagccccctgcctagggatttgctggcagatgctgtgcacccacagagcagacttgctcgcatgaataggaagtcaattcccaccgccagcatctcagctccagccaccttctgggctttgcagctggagtgtcacagggtgaggggccagactgccagtgcggggtcacaactggactcagagcagagctgtcttccaggctgagaggccagggtctgaggcgctggccctttctctctctctctctttttctctctctctttctctctctctctttctctctctctctctttctctttctctctgtctctctgtctctctctctctttctctctctttctctctctctcagcagcaaatctagaccccctctgtctgcctgttttccttccagcctaaagggaacattcaagaggtgaaaaaagaagccagaaacagaggttgaaattacccatccccctgaaatgctttgtttctcgaagcttcagcgtttttccaacgtagaatggaaagttttcctgcatgcagaattgcaaaatgcaggcgtctcaccacatgaccaccaaggtctgaaatctctgtggttttcaagatgttcatgctcaagaattccacccctagcaattgctcttaaatatccaagaaaggcaaaaaatctattctggaaggtctgcatcatatcctaataaacaattggaggtgatctaaatttccaggagtagcttagtaaataatggtttataagcatgatggcattcattatatacaacaattaaaatggtaattcttctggctataaattaacactgaatcatgagtagttgatgttatttgttgagagtttgctctatcagttgttttcaaccttgagaacatgttggaatctcctggggcctaggcctcattcctggagagcaggcttcagctgttgatgtgcagggtctggccctcggtgtctcttttgaagctccctggttgatcctgctgtgtagctaaggctgagagcctcagtgccacttccaggtactttgggtgcataacagccaccagagtcatatctttacaagtctcctgggcacatttacatcaaatgcagtggttctggtgtccctcccttctccccagtccaccccaccccaccccacccccccatttgggcagggcaggataatattgcttatctcttatttattacaaaaatattttcaaggatactctggttgtttgttgttccataaccatcccaaaactgaatggagtaaacaacggcaaaattattgcacaaatgctgtgtgtcaggaattggcacacagcataagaatggctttcttcttttctacaatgtctggtgtttcatctgggaagacagatctggcagtcttcagctgggtgctggaatcgtctgaaggtttatttatgtacatgtctggtgccttgtctagaatgacttgaaagatgagcttggctaagactgccagccagagtgcctgtacacggcctccctctatgtggcttgggcttccttgcagcatggagtctcttggttctgggagcaaacatactgaccagtaaacaacacagaggcctttttgacctagtctcacaagtcagttgctttacttctattatactctattattgaagtactcataagcccacacagatttcagaaatattttgaagataagagttgacaagatttaataatggaccaaatatgagcagtgaaggagaggactgttgaaatgccagtgctataatatgatatgaaaaaaaatgtgagaatacatgtatataataatcctggtgcatatagatgagaattgaatggagtgtgcaataaagaaaaattttaaggtggtagcagcatggtctttcatatgactcaatcattttggtaactcttcttatccctgtgactacccaccaaacctgtgcactgacagtctttgaagatcatcgattgtcactgggccccagcatgactcgaatagtgagtctgctttccaaataccacattcagaaatcacccttttcatgtgactttccagctgggagaaccacagtgctgtaagcctgttaaagactgttcaccctgtaaacctgtggggttcaccaggcccctggcatcatggggtaaaggtggggaatggcctgagctcacctattttggggtctaatctctcttccgtcctttctctttaggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggatgcc

SEQ ID NO: 38440 - DNA, 1437 bp, Homo sapiens
ctcgccaggatacccctcgttaaaggcaaggcggcttctggctcttccgcaggctcagttatgggttcctgtgtgcttagtcatcgggtccgacacaggctggactgatctggggagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggaggtgttatcgcagctcgaatttcagtttaaacgaacacctttcctctggccctcacttagcttgtgaacaggcctttttaaaatcctttcttggtgtagcagcaatcgtgttgttttatttttagatggatgtattttcatttaatacgtgggagttatatgaatatgtcctagcactaagggaagtgtaacagttgattgatttaggtggttttatgcagccagaacgattggatcaggaaaggtgtggaagggatattcttaggtcgtcacaaagctgagctgatgggagcaccctccccagaggtcaacaatccattcgttaactcagacacttaacctttacctttacttctgttggcgaaaaagaagtgctcctttttattacactgatttatccttccatcttttccttggcatttaccatcttccatctcccccttcacttttttcagatatgtctacaaacagactccaatctcagtcgcactaaaaataagaacaaaacctaaaccttacagttctttcaaattattaaatcaatttattattcctttctttggcaaaggttccaaatttttactttatatttgtaattttactatttgcattcagtcccagcgcattaatctgaatctgctgtcctaaaatacactggtgaaaacattacttgtacaatctcctatcagaaaactgttcatctactcactgtagtgccctccttgaaatgtgtgtttgttcattcaactaacaatatttggggatccctgtagtaaacactgtatgaattttacacagtctggccatcaagaaagatcacggagtatattctagatggggaggctactaagtgaataggaatcaccacgctgggctgtttattaggtacagtaataaacataagtactggttgcagtg

SEQ ID NO: 38441 - DNA, 21692 bp, Homo sapiens
acctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcgggtgagcgggtgtgggcgccggaaggcgagggctccggagaccccgggcgcgcctggcgggacccggcagggactggggagcctggggctgggcggactcgacacccggccccggagcctaggctcctcggtggctttggctgtaggactaggcggttaagggtgtggcctctgaagtcaggctggcctgagttcgaatctactccctgtgagtcacgtaactctgagcctcagtgtcttcatctgtagtttggggacaacaacaataataatagcgcgtatttattagagttgtgagaaataaataagatagtgggtaaaatgcttagcgataaggggatccaggctccccaggccccttccattgctctgttgaggaagctggggctggcatgaaaggctcagctgctccagttctcagcgcagggtgtgccccagctcccgcccctgtggaaactgacactgataaaatccagcgcgaccgtatcccttaacccctggactcaaagcccccctcctcctttcgcctcttccccctgctcctaaccccttctggcttctggtgcggtgatctctttttcgctttcaggattggccttgactgtacttcaggctggtttaagggcttcagctggataaacggtgggggtagggagaatatcaggggattccccttcacccaggctttctcgccacctccacttccagctcggctccagggtggccacctccttgtcatcaccattctcctgagctgctgagattgggagagtcgaagtcaccttgggcttctctgtggcccctggggatttccttgcaatttgattaaacagcttgtttctcccaacccgactctgcagttcacccctgctgtgaagcctgagggctctggctggggacttcgcctacccagagtgacctgtaataaacacatcttatatagggtgctgggctcgggaggggttcagtttttcagcaacacccaaaagctcctggttcgtcctacctgttacctctatcaacaataatgatgacaaaaataaacctggataacgcggtgtaatcaacttgcataatggacaaaaaaatttgcaaactccaaagtacttaaatgtctgtcatctcattctgtcttgaccacgcctttgaaggggtcctacctacattttacagatgaggcactggaggctcggaacaaggcagtaactcctccaagcttcctaatgttcaggggtgggacccagggagtcattgactaggcaagaggaaactgctgctttgcttcggcggttggagggaggaagtgatgctaatgggggtgagaatgtcatggaaaccttaaaagtagctatcaggactggatttgagtggtggaaagagtgaagcctcgggcaggtggcaggcctggtgctagtttcggtactaccctagggaaccttctttgaacccctctgaggccgtatgcatatttatctcctttgcctgaagggaggtgggtcttaccctctcttccaccaaattagagtagatttctgtcttttgcacattccttcctctatccatccagtcagcaaataaatctcaccctagggcaagattattaccaaaaccagcaccagttctactgctctcctacctctggattcctgccctgtggtttttcagaagccttctcagtgctcttagtccatggtgcatggtgatcacagcttcctcctagtcaactcaattctgtaactttgtatttggacctatgaaatgtaactaatttctacttctgggtggaaagatttacaagggcttcctggaagaggtagctaagttgccttttggcagatggaactgaggcagaactcttagggggaacagtggagggactgctgcttggataggctctaggtatcacctggagaaacggagagcaaaagcagggccctggcccataccttcttggggaagtcacttctctttgggcctcagctttcccgtttctttctctttcctttttttttaaaatttatttacttatatttatttatttttgagacagtctcactctgtcacccaggctggagtgtggagtgcagtggtgctatttcagctcactgcaacctctgcttcctagattcaagagattctcccacctcagcctcccgagtagctgggactacaggcgcatgccactacgcctggctaatttttgtattttttggtagagatggggtttcaccacgttggccaggctggtctcgaactcctgatctcaggtgatccgcccacctcagcctcccaaagtgttgggattacaggtgtgagccaccgtgcccggccagctttcccatttctaaaactcccctgagctcatggatgatgctcatagctttgagagccatgaactgctgaacctcttgtggtcaaggcagtgggtgttcgttcattcaacaaatatttattcagggccttctatgttcagaaactctctttgaggtactaggacatagagaagtcagacttatggtgcttctgttccagtggtgggggagacagatacccaaaaaggtaaacaaacacataatatatagtcagagagttataagtgcaagggagaaaaataaagcaaagtaagagattgggtgaggagggagatggtcagggaagacctctctgaagagatgacatctgaatgcagttggggagtgagacacacacacacacacacacacagactggtggaaacggaactgcaggtgcaaaggcactgaagtcaggacaagtttggtacatttaaggaacagaaagaaggccagcatggatagaggtagaaagtgatgttggagaaataagctgagtcacatcaggtggggctaggttggctaagctaagaagcctgatgtcattgtgagtgtactgaaagccattggagggttttgagtaggggcatgacctggtctgatttccttacaaaaggtggctctggctagctggggggttgggggtgcagggtacccagttaagaggttctaacagtggttcctgtgagagatcatggcaacctggatagaataactggagtagaggtgaccagaggagagagagagactttggagatggggttgataggactcactaatggaattgatgtggggttggagacaaactcctgggtttttggtctgggtaacaggtgaatgattgatggtgctgcttaatgaatgaggataacttggcagagagcagttctggacagaacagaaggtatggacagtcaggcagctgagtatgacggaggaccaagagtgtgtgcgccagaaagtggttataacgggctgagcgtggtggctcacacctgtaacatcccagcactttggggggctgaggcgggaggattgcttgagcccaggagttggagaccaacctatgcaacatggcaaaagtccatctctacaaaaaatgcaaaaagtagccaggtgtggtggcacgtgcctgtagttctagctactcaggaaggacatgggaggatcacttgagcctggaaggtcaaggctgcagtgagtcttgatcatgccactgcactcagcctggacgacaagcaagactctatctcaaaataaatacataaataaatttaaaaagaaacaaacgcctgggtgcggtggctcacacctgtaatcccagcactttgagaggtcagggcgggcagatcacctgaggtctggagttcgaaaccagcctggccaacatggtgaaaccctgtctctactaaaaatacaaaaattagctgggtgtggtgacacacacctgtaatcccagctacttgggaggctgaagcaggagaatcgcttgaacctgggaggtggaagttgcagtgagccgagatcgcaccactgcactccagcctgggcaaccgagtgagactctgcctcaaaaaataaataaataaaaaaaaataaaaataaacacaagacaaaatggactttaaggcaaacatagtactaaagataaagtcacttagagaatgtgcagttcaccagcaacatataatgattctaatcttaaatgtttctaaataatatagcctgagaatattcatagagcaaaaatttgttttaaagttattataatgataggctggggttctgggatgaagacggaggtgaggtcacagaaggggatgatggacagtgaaaggtagtcccactagtgtgttggtggcctcaactgagctgttgctggaataggtatcctagaattagggagtgagaaggatagggcatggtggggagagtgtggatccttgaaatggagatttaggaggtggtacagtttttgataatgatgagatctgggctatgaccatgggagtgggtggctgacatgtggtaacaggagaaaatcactgggatggagtgaatggctcaggtacatggaccaagatgccacaagcgttgtttgtgttgcagaacaagattgtggaccagtgtgagaggctgcagttacagagtgctgccatcaccaagtatgtggcggacgtcctgccggggaagaatcaaagagcagtggtaattcctcttctttcctctctactcagccccctcccaggataaggccttagacttagggacttgggcaagtctagggtcccttaccaacctcacagactcattgtgctactagcaaagcttctcatccctcagagactcaattttaccatctgggcagggtgggcttgttcctgtaccatacttggtgcaaagactctgctagcaaatgactttcttgggtatcttggcataggggatcaagaagggtcgtattcttctaccatctggtcattttctgcccagctgcagaattataaaataacctaggacttttacattgaatattctctgtgacaatcttatgaagtagatagcagtaacatccccatttacaaataggaaaatgggtccttatagaggttaaagaggttaactgacctgtccaaggaccccatagcctcctggcagtcggttctgtgacctggatcttctgtctcctaggctagtgctccttctgctgcatcccactgctgattcttttttttaattttttttctttttgagatggggcctcactctgttgcccaggctggagtgcagtggtgtgatcttggcccacagtaacccctggttcaagcaattctcctgcctcagcctcccaaagtgctgggattacagatgcctgccaccatgagtggctaactttgtaaatttttagtagagacggggttttaccatattgaccaggctggtctcgaactcctgggcttaagccaacctccctccttggccttccaaagtactaggattacaggtgtgagccgccatgcctggcctccactgcagatttttttattcagtggactcattaccactgctgtgtcatcactttcaagtatgcctatcaggggcagagcctatgaatttctttctgcatatcccctccctcctttccctatagtacacggaacagacttggtaccacattagtcagagttcttttaattgcatggaacagaacccagttgaacaagtataagcaaaatggggcatttcctgacaggacactaggggtcctcttaggacctaaaaggggctagaccaggaaccagaaagctgctaggagtccaggcagctacttggtgcccatctatgctttgcttttgcatgatggtctccatctccctcccctgccctcttcccctcttcttctttatcctttttattttcttgtcttactgcactggttatgaccttagtactgtgttaaatagaagctagtgtggcaaatcctggcttttttttttttttgagacagagtttcactcttgttgctcagactggagtgcaatggcgcgatctcggctcactgaaacctccgtctcctgggttcgagcgattctcctgcttcagcctcccgtgtagctgggattacaagcgcccaccacgacacccagctaattttttgtatttttagtagagatggagtttcaccatgttggccaggctgttcttgaactcctgaccttaggtgatctgcccacctcggcctcccaaagtgctgggattacaggcgtgagccactgtgcctggcccgacaaatcctgactttaagaggaaagctaccaatatttcaccagttatttatttaacaaatctttattgagcacctaccatgtgccagatactgttgttcaatgggttaggcattctccagtgaacaaaacagaaattcctattttcatgaagcctacattcttgtcacagaagagggacagtaacaaaatctatgttatgtccgaaggtgatatgtgctatggggaaatataaaacagaaaggggaataggacgggttgcaattacatgtgctgtgaccaggaatgacttcattaagaaggttgaggctgggcgcagtggctcatgcctgtaatcccagcactttaggaggctgaggcgggtggatcacgaggtcaggagttccagaccatcctggctaacgcggtgaaaccccgtctctactaaaaatacaaaaaaattagcagggcatggtggcgggcgcctgtattctcagctacttgggaggctgaggcaggagaatcacttgaacccgggaggcggaggttgcagtgagctgagactgcgcactgcactgcagcctgggcaacagtgcgagactctgtctcaaaaaaaaaagaaagaaacactttggctgctatgtttagaagtgattataggcggcaaaggttaaagcagggagaccagttaggaagccattgtaataatccaggtgggaaacaagtgtggtctggacccaagcaatggtggcaaagctagtgagaagtggctagattctgcatatattttgaagaggcaacaggatttgctgatggactagatgtaggctatgaaagaaagaggggaggtgtcaggataatgctgaagtttttttatttgagcaactggcaggatggagcagccatgaactgggtgggggaaggactgcatgtggagtgatggttggcggaggcagggaggggagtgggggagagcaggcatgctaagttgttgtgggcatgttatgtttgagatacctatttgacatccaagtgaaggtgctgagtaggtagctgcatatatgagttgggagagggctgggttggagatataaatttgggatttatcagtgtataaatagtattgaaagccgtgggagaggatgacatcactaagtgaatgagtgtagacacgaaagagcagcggtccaaagactgagccctagggcacttcacctcctattgagaagacagaaggaaccagcgaacggggaccaagaaatcagctaatgaaacggaagtaaactaagagagcagagtgtcccagcatgggttccaaggaggtgggagagatcactgctctcaaatggtgtatatttatttaactatcttatcacaggcatagattcatgtgattactaccacaattaaaatacagaacagttccatcactaggactccttgtgctacccttttatagccacatgtaccctttcctatccccttgtattattaatacaaaatttctgaatttggattgctaatctcagtaaagcattttttatttttgttttaggatttttgcttgtatgctcaggagtgagattagtctatgaatttcatttcttgtacagtcctcatcagatttggtatcaaggttatgtgagccttattcaatggattggaaaacagaactcttttttcttaagggtttacttaagataaagttgttcttagttttgatcaaagttgccacaggtttgactgttagtctttagaaccagcttctagtatttttggtctactcttttgtatctttgtcttaatttcattattatttctttctctttttttagacaaagtctcactccattgcccaggctgaaatgcagtggcgcaatcatagctcactgcagccttgaactcctgggctcaagtgatcctgctgccttggcctcccaaactgcttggattaccagcatgacccggtactgtgcctggcctgtagagttctatatatatatatatatatatatatatatatatatatatatatatatatatatatatctctattaagcttattcattgggctgagcatggtagctcatgcctataatcccagcactttgggaggccaaggccaggaggatcacttgaacccaggagttcgagactgttttgggcaatatagcaagaccctatctctacaaaaaattaaaaaattatccagacatgatggcatgggcctatagtcccaactatttgggagggtgaggtgagaggatcacttgagcctaggagtttgaggctgcagtgagctatgattgcatcactgcattctagcctgggtgacagagcgagaccctgtctcaaaaaacaaaaaataaaaacctctttttttttcttttttgagacagagtcttgccctgtcacccaggctggagtgcagtggtgcgatctcagctcactgcagcctccacctcccagcttcaagcaattctcctgcctcagcctcctgagtaactgggattacaggctcccaccaccaggcccagctaatttttgtattttagtagaggcggggtttcaccttattggccaggttggtcttaaactcctgaccttgggtgatccacctgcctcagcctcccaaagtgctgggattacaggtatgagccaccgtgtccagccacaaccacacttttaaaaggatgcttgggctatttttccagcatttctctactttattctgagagggtttttggtttgtctactctctgtcatgtgtttggaaagggaagtttttcttttctttgctctccttttctgggaatggctcaacaaacttgttgagaatgactagagtcttttaggcaggaatcagaatctgattcatcttgggtgaggatctgttttgatccaggatcacacagtacaaccatggtttcaggggctcaccctgtgggtaaggcattaaagtgggataaacaggagaataatcgtgggctggatgcagttgctcatgactgtaatcccagcactttggaagactgaggcaggaggatcgcttgagcccaggagttcaaagctgcagtgagctatgattgtgccactgcatttcagcctgggcatcagagcaagactgtgtctcttaaagaaaagaaaagaaaagaaaaaaaaaagataaagaagagcaatagtgaatgaatgttattgaacacataatgtagcaggctttgttctacttactttatatatattaacacatttaaccctcactatagccttatgaggtaggtactattattatcctcattttacagattagaaaatagaggcatagggaagataaggaatatgttctaagttccacagctaatgagcggagcagttaagatttaaatctacacactacctctaaagcttaatttcctgaccactatgttatgttgcctcaagagcacactataaacttggagtcttaccttctgggttcacttgccattcacttagctagtctctcctccctgtaaggcaaactgtgggtctcagtgttttctgtaaaataggaatgattgccctgtgcactgtacaaagcaggtcttaagggacagggcatagggaaagctgctggctgtccctgactttctgacatgaaggaggcagttctattcccacttgtctggcaagagtacaagtgcagctgccttatgcaacaggtgcctttgggaaggattggttgccaggtggcatctggtgtaggggaatgggactggactgagagtcaagagaattgggttcgagtctcagctttgctactgaattgccatgtgagcactatgaagagatcttttactaagtcagaaaaaatttcctgggtgggcacagtggctcatgcctataatcccagcgctttgtggggctgagttgggcttatttattgagcctaggagtttgagaccagcttgggcaacatggtgaaactccatctctattaaaaaaaatttaaaaaaaaaaatttcccattcagtcaatatttgagtacctactgcatgccaggcactgtgctaagaattacaagaagacacctgttaattgtctgagaattgatttcaggcctcttctgtggcagataaaaattctaccacataaccagttgaaatggacagttttaggaagtcatcagttttttccctcaaacatggtgaaatatcaactgtaccactgctggtatggatcctgctgatggggatgactttttaggccctctgctctgcaattctgtgattctctgaccttgatcctttgaccttgtattcccaactgtgattaagcagagtattctagttgggctctaagtcctgcccaggtcttccattatgtgatcatggctccctgagatatggcctatgtgtctgcatctcaaatttctttaccctaaaccatatttgggaagtcttggggcagagatgtcaaagtaaaaggcttacatgctattatttccattactaagcccgtggcagacattgctaatcaatctcaacactcctttccactgagcctaaaccctcttaaatcctgaccggggctttgcacagaccacccaactcctcattttatccctcattagagcatggccagtgcagcgagggaactggttatccagcggttgagtctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattgtaagtcaggcaagggtgagggcatgaccagttggccaggctccccaaaagcctgaaaatatcgagaatgtttgtcggtatgaggagggtggaaatgagaatttggagcagggatgagtgacaaagattctttgcttggccaaactttagtcaggcttctgagccttctcccaggcccatctgtgcacttcattataaaatccagtttttgcaaaataaccctgctaagtcagtgtagccagaaacccccatccttgatatctgatcatccttgatatctgatcaggttcctcatccaccaccatcccctaggtgatgtctgatcactgtgttctgtctgcagcaagaatcctgttaggtaggtttagccataatcccccttacccccaatgtttcctcttagtaattttccatccactaacccccaaccctgctccttagctataaattcctacctgcccacgctgtattcagagttgaacccagtctctctcccattgcaagaccccattgcaatgaggtcttgaataaagtctgccttactgtgctctaacaggtatcattgaataatttcttctctgacatgaggcaagggaataaaactatgtttctttggcactgataatagttttcttttgatagtgagtcattgtatactgagtgcctattatatgtgaagcactgtgctatggggcagagtaacgagatgcagctgtcagctgctcccagccttacaaaggagacaaatacactggctgacaattaggatatggaaggatatgtgctatggtagaggaactcacccatgctagggacggacaatccaggctaggggaaagaggggtcagggaaggttcccggatgaagcgacttagaagctgatgcctgaaagataagaaaactagctgtgtcaaaggaagtgaggaggtggaaagagttcaggagcatgtagagagaacactgtgctccggggagctgacaaggtcttcgatatgaaaacacagagctcatccttaatcctaccacccagaaatcaccatgattcatatttggtacatagcctttcaaagtattttatatagataggcagctgcctgcagttttgaggggagaaggtggcatctgagtcacaagcagaggaaagagaatgtggaacacctgagctgtcccactgcctctgcaagtagggcagtttctatgactgctcgaaactgtgcattcatttagtcacagcatccatggacagagcatgctctttcacagacactgggacagtcacaatagaagactcagaaagagtcgcagccgtccaggagctaacagtcttcatgggagatgctgttgggtgaacaggcgatggtcctgagtggagttgaggggaatccaggatgccctgggacatggggtagagtgattcattctgagcatgtgttatgggtgtgtgtgtgtgtgtgtgtgtgtgtgtgtgtgtgtgtgtagaatagcctagaaagctttatgctggtcttaaagactagaagtttttattctagagtccacatggagccctttctggtagttaaatctgtcttagcattgactccctgctgggtatctggtgccaagcttgactttgttttcttttctcacagcagaaggagcaagagattttcgagaggtgagtatagaccccgtgatttgactgggtagtcttggagacccttagacctcttcacactccactgccttcagccctgctgctcttgggagaatgcacagggtgtgcagctgagtggcttttctggagcctggctctgtggacagggaatgtctctgcccttggcttagagaactgctttaaaacacatggaaaggcagtggaatacttagtaatccaaggcttgccactgctttcttaaacttcctctgtaaaaaggtagtcaccctgttggagggttttaccacctccatgtgcagatgaaaatgttgagattctaaaaggggaagggatctccctaagcctggaaccaggggttggacccatctaacacctgccccggtactgttgcctctgcctcacttctcctttccctgatggaggaatctttgaaacttaagtctgcattaccattcagattttgcattttagctcttcagtaataaaagaatttcaccaggtcctgcctgagttctaaaagagctgagggcctgaggaagtggccaagaggacataatttgccaggcagagtaattcacaaaccttctgtgtgaaatttcagagttatacttagggaacacagtccattcttcttatttatttacttatttttctgtatttcaatgggtataaattatttatttttatattgaagtttcaatagtaatacatgtgcatgagagaaaaaaaatccaccaatataaagccatttaaaatgaaaaatgaatcttgctgggcatggtgtcttacacctgtaattccagcactttgggaggccaaggcaggatggtagcttgaagctaggagtttgagaccagcctgggcaatacaataagacctgatatctacaaaaaaaaaattagccatgcttcgtgctgagagcctatagtcccagcttctcagaaggctgagacaggagcatcacttgaacctgggtggttgaggctacagtgagctgtgctcacaccactgcactcagcctgggcaacagagtaagaccctgtctcaaagaaaaagaaaaaagaaaaagaaaaatgagtctgcattaccctttcccaatcctattccctgacagtgatgggtttgaacagatgtgcatttgtggacttatatatagtcataggagggtatgtggcggttttttggttgttgtcttaaaaatgttttttaggcccggtggctcatgcctataatcccagcactttgggaggccgaggaaggtggatcacttgaggtcaggagttcaaaaccagcctgggccaagatagtgaaatcctgtctctactaaaaatacaaaaattaggtgtggtggtgtgtgcctgtagtcccagctactcaggaggctgaggcaggagaatctcttgaacccaggaggcggaggttgcagtgagctgagatgcgccactgcactccagcctgggtgacagagtgagactccacctcaaaaaaaaaaaaaaaaaaaaaaaaaaaaaaagctgggcgtgatgactcacgcctgtaatcccatcacttagggaggcctaggcaggcagatcgcttgaggtcaggagttcacaaccagcctggccaatatggcgaaagaaacctattaaaaatacaaaaattagctaggtgcggtagcgtacccctgtaatctcagttactggggaagctgaggcaagaggatcacttgagcccaggaggcggaggttatagtgagctgagagcctgccactgcactccagactgggtgatgggagtgaaaccctgtctcaaaaaaaacaaaaaaatcaaaacacagataggatcattttatacctgttgttgtgaaacttgttaggctatctgggacatctttccacatcagtacatttacattcacgtcacttttttgaaagtttgtgaaatattgcagtgtagacggatcatatttattttactgtctcctaacgcatgcttggcttgttcccacttctccccttgtacaatcttttcacacttctgcccatcttctctatctcctttatctttgtcatcttcctttaatacagtgtgtccttaatatcaagctgatctgattttttaattgatctttaattttttattcaaatgattcatttattcaaatgatttcaaacttagaaaaaagttgcaaaggtagtataacgagcttcacgtagaaaatatcaattgttgacattttgccacattcattgtcgctcgttctctctgtcttcctatttatctatctagtatatatgttagaaacttatttttttatggtatatttgagggtaaattccagaaaacatgaatttttctttcaagatacttcagcatgtttctcctagaaacaaagacattcccttacatcaccccagtgtaaattaaggaaatttaacattgatataatactataatctaatacacagtccatatccaactgttgccaattgtgcaaaagttcttaatagtgttttattttgttttcctaattcagctgtctttttaagtctagaattattccttagcttgtttttttttttttttttaacatttttaaagagtcaaggccagttttataggatctccttcagttgggtttatctgatgttatcttatgattagattcaagttatacatttttagcaggaatacttcataagtgatctgtcttcagttcatcatatctgggggcacatgatgtccctttgtccgttatcaaggatgtcaattttgagcacttggatgtctgccaggtttcctcattataaagttatgcttttccttttataattaataagcagtctgtgaggagacactttctgcatatatatcctgtgtcccttcagactttctcccaatagttttagcatccattggtcactcctgcctgaattattccttttatttgcttgtttgttcccttattcaatattaatacagactgatggattcttattttattcagtgcattataatctgtcactgttattactaattttgacattcagactgtcccagatttggcctgtagaagccctttcaagctggaccctgtgtccttttgaaaagttcccatcattctttgagcactttcttgctctctttcacaagaagcacaagaagaaaaccccagctcaacttgtgcttttcctgcccctgaatcagctgcttctccagggcacctggttgtttttagtggagaatgatatttagaaaccaagatctgagcattaagggtactcagtgaccttgcttctaggcctcactcagctcactcagcatatagcagatggaactaggaagggagaaagagaaagagagagagagagagagtgtgtgtgtgtgtgtgtagctgtttgatgcatgagtttgtgtcacagcttcttttttttttttttttttttgagatggagtcttactctgtcacttaggctggagtgcagtggcgcaatcttgcctcactgcaacttccacctcctgggtccaagcgattctcctgcctcagcctgccaagtagctgggattacaggcatgtgtcaccacacccagctaatttttgtaattttagtggagacaaggtttcaccatattagccaggctggtctcgaactcttgacctcaagtgatccttccacctcagtctcccaaagtgctgggattacaggcataagccaccatgcccagcctgtatcacagattctaattccaatgtaacacctcaaggtttttcctttgccctctccctttctacatttgtaccttttgttattttacagtgaggactccagcccccaacaacatcagtatttgctcagtcctacaatacatacaaagttgtccgagcattgctaagcccatactactattgaaaggcctatccatagagttccagatttgtctgtagttctttatgcccccaggctgagcgaatatactctcaaagtagtgttcaaaagttgtgaagccccatctagccggaaactcacttatctgagaagtgccttgttggctctggtgtttccacgcttgtagctgggctcaactctgactggacactgcagcagatcctgccgcaccatctgggcattctgatcctggccagggcctgctgtgttcaggccctttttcatttccacccctttggggccatgagttttgtcttcggtaccatagggcagctagcccgggtggttcgctgtagacttcactatgttcagcctcacatttgccctgggatgacagcttagcaccgctgacatcagctcctctttcttccccacctgttggcgggagctcctgcgttctgagaagatggcaatagaccctctgttgtcctgaccacaaagagcctttgttactagagcttgctcccagcatttctaaggttctgttcaccttatacctcccaagacagaacagtgacagtcttgcaaagagccatcagggcacatgccccacccctgtgcccactccatttatgcacagagccatgagatatggggagagagtgtgtgtactcggaaccactgcctgatctcaacgccatcttcaggattggaggcagtaggaaaggtctttctcagcacctaggtcaaaaggctgcaaagctccatggtaaacccctactttgccctatattcctttgagatttcacttcaggtcaaggaaaaaattatgttgaatgctgcctgggcttcatcccagttttgttctatttttgcatggaggcatgacttgaatctagctcccctttttagctctgaatctgttctgtcctgttaaatcagataaccactacctcccaggttatagcaaagttgaggtatgattctgtagagaaaacagcaaacccaggccctcactgctgatacatggcagttttcaactcctaggcatcatattgtcccaaaatacctctccagcaaaacccagcccccattgtgagctgaggggagagttattgagagcacacagtgccatgattcatttgtggctggggtgataactgatggccctttcctctgtggacccctcaggtgtttgcatttttaaagtagaggagtggctgtaccttctgacaaaacccagggaaacatgactgccccaacaggtctgagagggaggtgagatattttccaggcaagggcaagatgttggagtagaaagactatcgtgcaggggttccagaggcccaggaggtcttagccccagctctgccattaacttactgagggactctggcaagttgcttcctctgcagagcacaccaccttcaatttctaatactggcaccaagaacacatcttcctataaactgtccaccagctttgctaaaattaaggcttctggggggcacaggggaaatggccaccttcccttttggcccaagcacctgtgtggggcctggatgccactcttttttttttttttgagacagggtctcactctgtcacccaggctggagtgcagtggcatgatcttggctcactgcagcctcgaactcctgggcttaagcaatcttcccacctcagcctcccaggtagctgggactacaggtgcatgccaccacacccagctaatttttaaattttttgtagagatggagtcttattatgttgcccatgctggtctcaaactcctgggctcaagtgatcctctcccacatcaggccttccaaagtgctagggtcacaggggtgagccactgcacctggccctagctgccaatcttggtatcgcctgataggagattttacttctgttcttctcttcaccccatattgatccagatatatttccagaaccatcctgaatctctgtctctgtttttccccatataaggaccgaagaagcagagggcattttggatccccaggagtcggaaatgttaaactttaatgagaagtgcactcggagcccactactgacccaactctgggcaacggcggttcttgggtctctctcaggttaggagcagtagagcccaggaccattaggacaactgggcttctgtctgtctgtctggggttcactcctggttcacaatggggacccgtgcttctgagatgatagcttaaacaagtcatgctggatgcaggctggtcagtagggtcaaggttccagacaggcctggggcagctgggccaagtccttcccatttccggactaacatgttctgtggttgggtcaaagataaatctcattcctataagtcatgtcttccttatatcctgacctactagggcagcccagtattatttattggaaacctggggtttctctttaagaagataaaattgatggccaactgaagaacatctggaccaagaatcaaactgcctgatttgcctcacttattcactttacacacactgactcaggccaactgtgggccccaccctgtgccacatgctggggccacagaggtaaactgacatggtcttctgcctccaggaattcccatttagcacagaggttctccagagcaggcctcctccaagttagatggaagcttccattctcccaatggtagtctttcacaattcgtggaacagttaggttaatagactgattttttttttttttcagttttaatcctccctcctcgtattatccttacaattttggtagaagctgtagcttctctactctagattctggtatcaaatgatgcctgatttaccagcagtttagatatttgctagaaattgcttatctcatgcttcctagctcccagaggctgtgtttctaggacacgtccaatctggaggccacagatatgaccaagtagaaagagtataatcagtgctacgtataggaacaaaatgttttgtcttcattttgcccctcccaccaagtcagtgtgtaaacttgggcaactccctttttctctctgggccttatttctatcagagtttacagttgagggtcttgactgatagtaactattgttatgaaggctacagtttatagagcacttacatgctgggcactttacatgtatgattctgtttaattctcgtgatcacccagtgagaagtcctattttgacccccgttttgcagacaaggctcagagagagtaaatggcttatatgaggtcaccatgctagtgagtggtgaggaaccttttgctacctggcaggaccaggttagggcaggggtgggccctcggcaactctgagaattctttctggcaggcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagctaaaaaaaaaaaaaaagtctgtgtataatttttgtgatatctgccaccacagataagcaaaaaagtccttgcattcaaagggttggagattgctgctttgagtgctgggtacctgtggggaacctactactccctgggccttagtctcccaaatccaccatgcatctgcccctctgagggtgtcttcactttgtctctggcatctagcatggtgcctggtgcatagtgagcatgcaataaatatttggcaggtgagtggatggatagatggataggtgaatgtaggtggacaggtgactgggtggatgttgtggtctctggagaagcactgccattcagcctcctgctccagctgttcacatgcagaaatgctctcttcacaggcagagaagcctgtggctaaagtttccacatcccattaactcagtgcttttgtctttttcatgacatggcacatagagaaaatatttttttctagcacacaagagcaacctgaaaggctgctcctggccagaggactctgtcccgggggaccgtgtcctcccccatgtcctgcctaggccctcagaggaccaggggatcatgtctccaggtaacccgactgtagcccctgctggctgagctccagcctgtgcccactgataatagcagggacggccttttctcttagagcagctgataagtttccctacctgatggccccctctgacataaactgcacacctggggtgatggcttaaagccagaaagagctgagggagttaagagggccaaccttagggcacgtgggcattattaaaggtcttaaaagcattgaagattt

SEQ ID NO: 38442 - DNA, 23447 bp, Homo sapiens
gtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtgagaggtcggcccgggctggggctggtggggcgaggaccgtgtgccaggccaggagtctcgccctgacacacatcttcagagctttactcgcgcggagcggggctcgggttgggtccagaagaagggaaaacagcagtagccagtgactccccaggctcttgagcaaaggacctgctggggttaggacagccccggaacttccagttttgccctgatggcgcagccatcagtaagcgctgcttaagacgcatgggagtcgcctggggatcctgctacgttgcagattctgattcagcaggtgtggagtagtgccccaggtcagcatttctattaagggtctaggtgaacttgaatacaagggtgcagtgcacttctgtgtgaccattttgaaggtggtttgtcagagctgaagggctgaagggactttagtgataggaaccactcttaactgagattacagtggataagaggtcgttgcctttggaaacaaactttataactgctttttctcagggtttgctggaggccatttgagatctcctgaagttttttttttgtaacaagtgttgtattctagggttctccttttctatttaaggttactaaacctatagtgggagggatctgaggtcggaacaaatttaaaatgggctagtctgtggcagtaatgttttaaaaatctgtctggttttgtcaggataattatgactaaagcacaaatagtttaaaaaaaaaatgattatctttcctggatgtgactttttatagcagaaaggcctagtgaagaggaacaggcaacctgaaatccccaaactcccaggtattacacctgtggagtgcttttgtatcgttggtcttccaggttgatgttggaggaggtcgaaaagattgtccaaaattgatgttaggtatactcttcataataacagttgctttctagaaaccttcaggattgtgtctttacattgtacaactggaaacccatttttcaaggttggccgcacatgaaattaaacttctaaagcattttccacataaataaatacatttggaaggcacttaattctattaccaggtttctagttagccttactctggctttaccacttgctctctggaaccgggatttcttctttcattttgattctttgatttttttttcagtctcttactttgcctttttatattagatcactaaattttccttatgattttgtatacagcccatctctgatgctccccttcccccaattcttctctatttattcttggtacagaaggactggggaatcacatgtaggaatatatattatattcacgtagaagacaaaaaattatcagtggtaatggagagtaaaactttgaatgtgtaggcctagacctagtatgtaccatatatatatatatatatatcctgaaggcactaggaaaagatttagattcttttagggctttatccctaagggagagtgggtgtgtgatggatatcttctgcctttatggttgaaaggtccgttgtagcttaggataccagcttcattcatcttcaatctgtgtagccacaaaatagcatctgaatccatggcctgactttgcaattagagaaggcatattacctctcctttctgctcatattctccagactttagacagatgctttaaacgtcttcggctctctagtataaagttgtgtgcatgaaaatcaggggtgaaccaactctctttcaatttaggctatgagcaaatattagcctcttaaaacttgtttctggatagtctctgtccagtgttcatttcaagatccaatttgatagaggttgttattgggattttttttttttgagacagaatcttgttctgttgcaaggctggagtgcagtgacgcgatctcggctcactgcaacctccgcctctcgggtttaagcaattctcttgcctcagcctcccgagtagctgagactataggtgcacaccaccaggcccgactaatttttgtatttttactagagacgaggtttcatcatgttggccaggatggtctcgatatcttgatctcatgatccgcctgcttcaagtctcccaaagtgctgggattacaggcgtgagccagcacccggccgttattgggattttttaatcttcttggttctgctattaattatagtcagaagggactgcctggcaaaaattttttgtctttggtacatgtttcctgatttctgactggtttatagattaatatatgtgacaagtcacttcattcagccatctcacaaattctcagaaagtagcatgatttaaaactagatgttttggctgggtgtggtggctcatgcctgtaatcccagcactttgggaggctgaggcaggtggatcaagaggtcaggagttcgagatcagcccggccaaaatggtgaaaccccatctctactaaaaatacaaaaattagcccggtgtggtggtgggcgcctgtaatcccagctactcgggaggctgaggcaggagaattgcttgaacccgggaggcggaggttgcagtgagccaagattgggtcactgcactctaccctgggtgatagagcaagactccatctcaaaaacaaaaaacaaaaaactagtgttttattgggttgttttcttatggcttgaatggctgttggtttaacctgttttgctaaaagattgtgctttggaaataaaaatatagaacttgattggccattttttttcctgatcattagagcagatccaaatgcactatcaaaagaaaagatttggcactgcttccaggcttccctcaactcccctgggtgtcaagatggcctccacccagggagattcctcagtttttataaaataaagtccaacctaccccagcttcactgttgattaagacatttgggtccctatttatttgacaatatagatgagctgggaagcataatgtaagaatcttttattgcttagtacctttccaaaactcagctaaaagaagcggtattcaagaagcattacatgaggtccacccattcttcaggatcgatggttcttaaccgtggtgaacattggagtcaactggaaagctttaaaaaatacacatgccagggtctccctccgaaggattctaatttaattggtccggggtatccagataatgtaaaagactctctggtgaagcttgagaattatctggactgaagagcattaaaaaagtggaggccccacttttttgggggataatccaaatgcggttatcccaggttgggactcaggcatcagtaacttttaaaaaatgtcctggtaataccagtatacagacaaggtttaatatgattgctttattttaaaatctacacctgggaggtttttgtttacttttatgtagatttgttcttttacctggaatgtagtatatcaatcccagtacagaattgccttcgctgaaatgtgctttggtaagaggttatctttctgtgttgagagaactaggagaaacaatcccacagaactcattgctgtgactgctgaaaagatgttcattatattactctatcctctttatgaggacccttgggaggaatttgtctgttagcattaggaatggtgtgcttctcctgaacaattggcttgcttttttctttaaactagtctagctgatcaagtttgtttctttatgtaaaagtcaggaagctgggtgccaagtctgtggcccacctatagtaagtaaacagatcttcatggtgtacatattttagtaaccgtgttactgcatccatttctttgtccctacatttgtttgcttttgtctttcttgcctactttgaattggttgtcttactatattttaatttttgctatatctactttattaccccttgaagaggggtatacacaaaataagtaaaattatcaagttagtctttgccactaactgggaagcttaagagcaggaatgagaatgagagtgtgtatgtggggtggacactattatatgaaactgatgtatcatccattcttgaaaatctgaaaactgtactttagacttgatgtgacctggactccagactcctaggagacgccaagggtcctctcttggtgaatgtgcctaacagatttcttagtgaggctgaatggccctgtggagctttgtgtcaggccctgtggtggacactggaactacaaggatggataattcagtcttgcctttaaaggagtttcaatgtgataaagcagagacaacagatatcaattaaggcaatatgctgggagcactgggaacacaaaggaggtgtctccaaatgtccaaaactgaaatcagctttccacctgtttttctgtcttggtcttagttttagtcaaggaatatctccattacaaggctcaaaaatcaaagtagtctcttttttgttcttctgtgtttacctaccaacacagtccccacataaagcttttatttactcacttgccaagtctaactcaaatgtcttacatctacctcctctattgttaactggcttagatgaggccttaggctctcatgtggactattgctaacatctcaaaatgggcttttctgcatctagtcttcccattccaattgtgatgtatgctgccaggtttcagatttattctgtggagcctgtgggctaagaggatgttgagcggctggggctgtgggattccctcctacttcaactagagaaattcgagtttttgcctttatacatacaaatctaaagttaaactttatgtggtattttctgatttaaaaattggaaaaccattcccaggttgaggcaaaccaaaccacttctttgccatacacattctttaccatctctgctttgcgcaagctttctagttatttttggaattctgaatgtcaccctttataagtacaggtatttgcttgtctaaatactattcatttaaaatgctattccctcaatgaaacttctcctgaatccccagccagaagagaaggtctgtcttgcctttgaactgctatggccttcatatggtttcttgcagcacatgtcagcttctattatggtattgctgtcatttacattcacagctggccttttttctttactaacttgaacacccaggaaaggcagggtcaagttttctcaagatgggtatcttccacaggagctggcaaattgttggagctattaattgtacctactgtgtgtgaggccctttgctgggaaacagaagtcaatagatgaccgagtctctgttctcaggaagccaggacagaccagtaaaggagctcgtttaatacactttggtaaaggctactaaagagagccactgaagctactgtgaaagcataaggccatgaccaaggtttctgggaacacttaagctaagtcttaaggaatgaacaaaagtctttctaaatgaatgaggagagaaaattccaggcataagaaacatgatactgaaaggccatgaaatatgagaaaggaaaggaagttgcgtggctagtgagtaagtatgtagaatagggaagaagtggtaagggggctgctagagaggaggtggggccacatgagccatgaaccctcgaagggttttttttatccagaggggttagagggtcagaaagagggagcagtgattaactgtgaaagaaggaagaaggcctctctgtgaacacctggtcctctgatgtgtcagaaggaggttcaggtgttggagaccaggtgccagtgggactgacacatgcctttgggaagaatggagggctccctagatgccaagagaatctgaggctcccagtaccattctcctgggatagttcggggagggtagaagataaatatgacgatatgtgacatagtaggtttccaaatgttagttttaaaactaaacaaagtagtaggaaattgagttaaatttttttttgttatcaatgttataggaattcagatttaaaagataaccatcaaaagccagagtggtcagtgatagggaagtaagacttgagctatccttgaacattgaagacaaggtgatgggcagataggaacaggagtccctccaagcaagagaagcaagctggaagaagatgcagaaacagtgggcaggttctaggttggaggggaggaaagaggcagtgaagctgagtacaggggctggacaaagggggtagaagtccttttttaaaatttttttaagagatggggtcttgctgtgttgcccaggctgatcttgaactcctggcctcaagtgatgctcccacctcagcctcccaaagtgctaggattacaggtatgagccactgcactcagccacgatgtagaagttcttgaaggacagatgctttcctctgagacattaggaaaaagttactgatatgatgacactggcttagcaagattaattaggtgattttgaaacatacaatgcattattatttattgtagtcaccatcctgtacaatagatcactaaagcttattcttcctgtgtaactgaaattttgtacccattgataaaaatctctctttccccatttactgcacccccccagcctctgataaccatcactctactctctaattctgtgactttgacttctttagattctacacagacaagcataccttgaagatattgcagattcaggtctagaccaccacaataaagcaaatatcgcaataaagtgagacccacagttgttttttgtttcccagtgcatataaaagttgtgtttacactcttctgtatcctatcatgcaatagcatgtctaaaaatgtacataccttaatttaaaaatgttttattcctaaaaagtgctagtgattacctgagccttcagtgagtcatgatctttttgccagtggagggtcttgccttgatgttgatggctgctgactgatcagggtagtagttgctaaaggttggggtggctgtggcaatttctaaaaataagacaacagtaaagtttgccacattgatagactcttcctttcatgaaagatttctctgtagcttatgacacagtttaatagcattttacccacaatagaacatcttttgaaattggagtcaatcttctcaaactctgccactgctttatcaattaagtttatgtaataaatccattgttgtaatttcaacagtgttcacactatcttcaccaggactagattccctctcaaggaaccacttctttgtagtaacttctcatgcattcaagttttatcatgagattgcagcaattcagtcagaacttaaggttccacatctaattctagttctcttgctatttccatcacatctgcagttacttcttccacggaagcctgaatcttcaaagtcatccatgagggttggagtcaaatcttccaaacttcgcttaatgttgctattttgacctcctccttataaatgttcttaatgacatctagaatggtgaattctttccataaggttttcaatttactttgcccagattcatcagaggaatcactatctagggcaacaatagccttacaaaatgtatttcttaaataataaagacttgaaagtcaaaattactccttgggccatgggctgcagaaaggacattgtgttagcaggcacaaaaacaatattaattttgtacatctccattagcgcctttgggtgactaggtgcattgtcaatgagcagtaatatttggaaaggaatcaattttttcttttgagcagtaggtctcaacagtgggcttaaaatattaagtagaccatgctgtaaacagatgtcctgccatgcaggctttgttgttccatttatacagcacagtcagagtacatttagcataattcttaagggctgtaggatttgcagaatagtaaatgagccttggcttcaccttaaggaaaccagctgcattaatccctaatgagaatcagcctgtcctttgaagctttgaagccaggcattgactttctctctagctatgaaagtcttagctgggatcttcttcctatataggctgtttcttctgcattgaatatctccatgttatcaataaggttgtttcactttctcattgtttgtgtgttcaccagagtagtacttttaatttcctccaagaacttttcctttgcattcataacttggctgtttggtgcaagaggcataggttttggcttatcttagctttctacatgccttccttactaagcttaatcatttctagctttggatttaaagtgagaaacttgaaacttttcctttcacttaacacttagaggccattgtagggttattaactggactaattttaatattgttgtgtctcaggaaataaggaggctcaaggagagggagagagatgggggaaataccagtcagcagagcactcagaaaacacacaacatttattgattaagtttggcatcttatatgggggcggtttgtggcgctcccaaatagttaaaatagtaacatcaaagatcacagagttcaggatcagcctgggaaacatggcaaaaccctgtctctcaaaaaaaaaaaaattagctgggcatgatggtatatgcctgtagtcccagctgctcgggaggctgaggtgagaggatgagccaaggtaatgccactgcactccaggaggcagacgtttcagtgagccaagatcatgccactgtactccagcctgggcaacagagccagaccccatttcaaaaagaaaaacaaatcataaatcatagatcaccttgacagatttaatagtaatgaaaaagtttggaatattatgagaattaccagattttacacagagacatgaatgagcacatgctgttggaaaaatggcactgatagacttgctcaatgcagagttctccaaaccttcaatttgtgaaaaatgcaatctctgtaaagagcaataaaatgatgtatgcctatgttactaaaaggttaactttacatattttcatcacgtaaaaatgaaagtatgtgagctgatggattttgtttacattagttaatcatatatcaaatgtaaatatatatgaaaacatcacattgtactccataaatatatacaatatacaattatttgtcaattaaaaataaaacaaaatatttaaatgcaataaaaatattttttccaaaaagattaattagttggctatggatagatggattgtgcaggtgaaagggaggagtttgtcacaggcactaataaggtttacattctacaataagataatggaaggaccattgggagggacttttcttctaggcagtgatcaacagggcttggtgtggggatagtggatccacagggagccaaaggtttgaggtttggggcctaggagaactgtggtaacattgagagggacatagtagattgggaaggggaactggtctatgggattagacttgtttttaaaattgaagtattcacatctgactcaatgagtgtcagagttttatgaacagttggagctatgagacctgtggccactagtgatgttttgaaatcattacagcacagttggggcaggagccagattgcaaggaataatggaagatgatgaaaaagcaacatcttctgagatggcagctgcttgtttcacgaattgcatgaaaggaggaaaaaagtatattagttacaagggacattaagtagaatccttaagctgggatagggcatataaacctccagattaattccttataaattcttacatatggtcactgacatcttatttctttcatccatctattcgttcattcaccacgtatccgcatgccaggcattctggtcacttctcccctttacttcagtgtgggctaagtgccagagcagccccttagcagtcattactagtgtagcaataacaggacataggctaaggacacctggaataataaatcaccatcttttcttcccttaattttagctaacatttctttccttccatcccataggaaggttgcaggcctagtgtcagtgattccagccatgtgttctgagtgcttgagatgttaatgctatacatttcaagaaccatttttaaacaatgtggtgtgttttttttgtactaacaggtagagtggaacccccagctattagaggtcccaccccaaactcagtttgattacacagtcaccaatctagctggtggtccgaaaccatattctccttacgactctcaataccatgagaccaccctgaaggtgagcaatgcttccttgctctggggagccccactgcaaaggttgggttgttttctctgggctgagttcagcaggctgtcaggtgttttcattcttctttctctttcttccctactttaggggggcatgtttgctgggcagctgaccaaggtgggcatgcagcaaatgtttgccttgggagagagactgaggaagaactatgtggaagacattccctttctttcaccaaccttcaacccacaggaggtcttgtgagtcacttgaaaggggatgttgcacttaatttaaggtcttgaacatgaggatacctgtcctgactccccaagatggttcccactgtcacccaaggtagtttgggggacaacttgtcatgctgcatacccttatgtcacaggatctggtgaacaggtcgttcctggaggtcgcattcattgcacttcgagtctctcaggggctgacatcccacagaaaagtgaagcattcttcctagttccatagctctccttatgtactcttgaaagacccctggagcgtatgtggaataaaatagagtgtatataattaaatattccttttatgagtgtcactattttctcatttttttcagtattcgttccactaacatttttcggaatctggagtccacccgttgtttgctggctgggcttttccagtgtcagaaagaaggttcgtatttggggtcccagtcagtccctgtccctgaggggtcttgcttctcacttccgaagcccctatctctttcttggtgcctgttcccttgactttttttctcctgcatgtgtgacttccagtgtgtacctagtccagtgggtctttccctgtctggccttatggtgcccctgccagcctgacctccacagcagcagcagtgtagcagctgctctgatctgcctctggctcctggcttctcccctcaagcttctacacaagctgcacaaggcagtcctaaccatgttttgtgaacaatcgagggggctttttatttaggtgagacattgctggaaaggaaggacactgggacccaacactgctgctactgccctaatcttggtgataatccacagcatgaacactgttccgtctagcctttcctagttgagaaagtccatcgagtttgggttttgatacattcagcccctgaatggttgcagtcagtggttcccaaccttttcatccccaaggactgcattaattattttccctcatggatcccatgtgttgagagcctttggccatcacatgaagctgcattttgtcatttgttattggctcaaatttacatttaattactggtctgagtttcagatcatcatgaccttattaaaaaggtgccaaaaagcaaaggttcttgttactttgtttagctttttggcagtatctcaaatggaaacaaaatttccatcacattttttaagaaatatgtaaaataatggaaccttcaggaaagaggaatctggtcttgcccccaactgggttggatactgctgctagttctggctgtagttggctgctgcacacaaacagtacgtgtctaggtcacataaagcaggatgggctgccccttacttcttgggaagccttgagtttaggagtgatccacagcacctgatcttctgaaagctctcaactgctcagcttctaaaaggcaaagatcttctcagaaacatcagaagtggtactgagaaggaaagatgtttattggtggcaacattctctttaggcaggtcccagactgggaatgtcccaggtttccatcagggaaggaaatcactagcctcaggtgcaggtgtctgggtagcagctccctgcgctggacctacagttgttgggactccagattggcttcttttgtagctacttccatgcctttcctatatgaagggacttgaacaaagaatcccagaaggggccaggcacagtagttcacgcttgtaatcctagcactttgggaggccgaggcgggtggatcatgagatcaggagttcaagaccagcctggccaagatggtgaaaccccatctgtactaaaaatacaaaaattagccaggcgtggtggtgggcgcctgtaatcccagctattcaggaggctgaggcaggagaatcgtttgaactcgggaggcggaggttgcagtgagccgagatcgcaccactgcactccagcctgggtgacagcgagactccatctcaaaaaacaaacaaacaaaaaaagaatcccagaaggtggcactgttgatggaaatggtgcaactttgggatattgctttaggagtaaaatcctagaaaaatcccagtggttacgtataggctacagagaatcaggctgtggggaaagctggagattgttggtctgcccactggccaagtcatttgctcaatgtacatttgtctactcaagtgtgccttatttatcataaactgggtccaaaatccagacaccaatatcagactccagatggaaatattagaggtttataatattattagtgttataagtttaagtcatagttattctaacacataaaggacttagtacagtcattccacagtatccaaaagggattgattccaggacaaccctctccccgggcagataccaaaatctacagatgctcaagtcccttttataaaatggcatagctttgcatataacctatgcccatcctcccatgtacttcaaatcatctgtagatgacataatacccaatacaatgtaaatgctgtgtattatcctgtactattttctaatttatgttatttttattgtgttattttgtattgttcttttttactcaaatattgttaatccatggttgattgaatccatagatgtagaatccaaggacatggaggaccaattgtatgcagcaaactttgttctaagaacttcgcatatattaacttgtttaattcttgtagtaaccctataagataggtgtcattatccccttttacagataagagaaccaagacacagagaggctcagtgacttgcccagggacacaaaactggtaaatggtggaattaggattcaaactctggcagtcttggttcagaatcctactttttccttttatgctcaactgtttatttgaggacatgtatatctggaggcggcatcggatcatttggtttttccttttcacaacaaatcttgcagaaccccaggattcttcagaggggtctgaggaagcacagaaaaggaggggatgggacatgcaagtggactatgctttcgatctccaccttgcagccatcagcacctcttcttttattattatactttacataatagccgtaggttggaggaggttctgtggctgatatagtcctacccctttgatttacagatgaaccccagagaatggtagtgacttcccagggcgactgctggttagttctggactgaagactaaactcatgactttcagtgtggtttcttcttctgtccagaccaacgatgtgtgtgtgaattctgatattctagtaaagttataggctatttttaaagcccttggttctgactatcaataatttgggaataaatacccctttgggactttgattcagctgatcactctgtagatggacctcagtgaatcccaaattgctgctggggagctccttcttttgccatcaggcttgagcagtgtggaaaaagaacctaccacacagagatggcacttgccatctctgacacagagcaaagcatgggaaggcgttaggacactttctttgggcattgacgggaggggacaatggtactgagggggtctgaatagcaatgagctgccatgagatatatgagaaacattgtagtttctttggttagatctttggttagaccagcaattcatctaaaagcctggctttttattttgggcaaggctatggggtctctgagaggatctgtggccttgtgtccacttttctcagtttgttatgtgataagtcaccatagtggcctataggatcaggcttcaggaagcaacttagttctgataacactattatttattagaatgcccaaatgctggtagtgctttacagcagggattttttggaaggtgtcagggagttgccagtctgtttcaggtctattacctgctctagtctatttgtggcccgataggagggcttgcgctagacagaacaaggctgctgccactaacttttttcattgctcagattataggagagcctcctttggcagggccagggcatgttgaaggcattttctgtccttaaggagtaaccttgatgatctgcctctcagagcagatctctgctccatctctgtagacaaagagaagggggtggagatgctgggaagaacaagctgaagcctctgcctgcctgtgcttcctccctttcttccaggacccatcatcatccacactgatgaagcagattcagaagtcttgtatcccaactaccaaagctgctggagcctgaggcagagaaccaggtaactgcccctgggttcttgctcaccagttggggacaaccttttacaacctttgctggcagaactctgtctatactgagggcctgtccaggcttaccctactggcgaataatggatgggaaggtttaaattacacttaagtgtgacatcagctgtctaggaagcgaagaagtcttgttcacaatgacagacccatggtgaaggccaggaattctgggaagagccgcacactgggctagcgagatgatacatacagccacgagtgggcctttgccatttacaaagtatgatccttctgacaaccccggtctctcaggtggggcaaatgagaaaaccaacaggttaaataaaagatgattgagactgtctttaaccggcaaatccagttgtacaagcccaacaagacacagatttttcttctcttaccaatatgtttctatgtaagatagatcggtttgggctgatgacacttttcaggtatctctaggctgcactaagactatatggtatttattccgtaaagaaaagaaaatgctgttttcagacagacctgggccatgcttgcatcatttttgatgcaatgcaaatgctagagtgagatttggaaaatttcatcctgttatcctaaccctggtacttgctaacttaacgttataagtcatttgaccttatagagccttagtttattcatctataaaattgggataataccagctaaccccattgggttgtggggattaaatgatatcccaaatgataacccaagtgtgaagcacactttgtaaactgttaatcactatagaatataaggctttactttttattttttgtcagaggccggaggcagactgcctctttacagccaggaatctcagaggatttgaaaaaggtgaaggacaggatgggcattgacagtagtgataaagtggacttcttcatcctcctggacaacgtggctgccgagcaggtgagtcctggggttggggagcctgggataatagccttggtgggctggctccggagttagaaccgggtggagagaagtgggtggaggcctcctggtttgaaggcaactgtgataagacctacagatagaatgggtgtggggactgagggatagggagcaatcgaggaagactccttacccaggtaggaacacagacactgaactctagaccagagcttcttgaggcatgttccccagaacacccaatatgcagtttgtgtttgggcaggcaggggcaatgggtagggagggatgagtagggtctaaaaattttggaatccttatttattgcatcacttcttgagagtactatatgtacatcagcatattaaaaaaatctgagatgcccttcataaagaaagctggttaatctttaaatctgttttccttaagcttatttagccataggatctttttttctgtaataaatacataaagaagactaacaatgggaaaggtttctctagatttaaaagttggacatccaaagttatataggatcctccccactcttgtgaaaataaaatgactgtgtaccctaaaggcagaaatgcaccttgcttttatgtgtaaaataggtttaaggttagaaggcaagagttcatatcatgtatttgtatggcgtattttttagacttcattttgggaaaatgaagatcaagtaggaatttatgaattccttgctttgtattttattcatcttttttttttttaagttaaaaaatacaggccaggcatggcggctcatgcctataatcccagcactttgggaggctgaggtgggaggatcacaaggtcaggagttcgagaccagcctggccaatatggagaaatcctgtctctactaaaaatacaaaatttagccgtgtgtggtggtgcatgtctgtagtcccagccactcaggaggctgaggcagaatacttgcttgaacctgggaggcaggggttgcagtgagccgagatcacgccactgcattccaacctgggtgacagggcaagactccatctcaaaaaaaaaaaccagtaaaacaggccgggcgcggtggctcacacctgtaatcccagcaatttgggaggccgagaagggtggatcacgaggtcaggagattgagaccatcctggctaacacggtgaaaccccgtctctactaaaaatacaaaaaaattagccgggcgtggtggcgggcacctgtagtcccagctactcaggaggctgagacaggaaaatggcgtgaaagcgggaggtggagcttgcagtgagccgagatcacgccactgcattccaacctgggtgacagggcaagactccatctcaaaaaaaaaaaaaccagtaaaacaggccaggcgcggtggctcacacctgtaatcccagcaatttgggaggccgagaagggtggatcacgaggtcaggagattgagaccatcctggctaacacggtgaaaccccgtctctactaaaaatacaaaaaaattagccgggcgtggtggcgggcacctgtagtcccagctactcaggaggctgagacaggaaaatggcgtgaacccaggaggtggagcttgcagtgagccgagatcgtgccactgcactccagcctgggcgacagagcgggactccgtctcaaaaaaaaccaaaaaaacaacaaaaatgcttttcatttttgagtggatggggagtcatcagaaagggaagaaaccctttctttttttttttttttcctggccttcaggtatctagtaatagctttggaagagctttagagacatagcttcttgacctgttaacagacatagctgttcttgagcctgtcttctcttccccaggagaagatgggctcctgcaggttccatggaagctgatcagctgccagaatcagtaggtaagaagcatttttttctaaaactacatgtggccctttcaggcacacaacctcccaagctgccccatgctgaagagatttgcaaggatgatcgaacagagagctgtggacacatccttgtacatactgcccaaggaagacaggtgaggggctctcactgctggcatgaagtcacgcttggtcagacatccaagtgtatggggaagaggagttcatcaggcccactcacacctgacagctgatgtctcctcgtgtaaggaggctgaaccccattctgcccacctaccagtaggccctaggtcctcgcacttctacagctgggactggtggcctagtgcttctgttccctgttatgcagaaccaggagccaccaccctcatgactttatcacttgccttttccttttgctttaaggtttaaaggatttgggtggggggagctgaagaaagaatattcatttctgtctttagtcatcatgttacaatttgcaaaccattttcacattctcactgtgaggtgagagagatacctttctccctggctttatagataaagaaactgaggctgggagatattgcctacctggtctaggcccagctagcaagtgatggagccagaacttggacccagatccactgactgcctattctgtgttttcgctatattactagcagttagggttctgtttcctgactaccagaatggaaagtttttctctcaccaaatttcagaagacacctttttttctgatttgttgagagcattcaacttgcactaaaaataggtgacttgatagaggaggggaggtaggaagtagccctgggaaagatgagtaggggggaaaggcatctaacagttcaagaatttgcacggttgggtgcccaaggataagagcccctgactgcattccttccactcagggtcagtgtgtccacttctgtgcaagcctagggcatctagaaggttcctgccaagccacacagcttgctgccactccctgggacttgccagcttcccttttctgcttgtgaaggggtgccaccatacctaaattgttacttacttccctctcctttatcaacacacacacacatatttagtaaatattttaagctgtcaggatcatgcaatttctgttacaactactcatctctgcccttgtaacatgaagcaaccaaagacaatatgcaaacaaatagacatggctgtgtgccagtaaaatttgtttaccaaaactggtcagatttggcctatggtatagtttgctttattctggtgtaaatcattttaaacaggaccttgtctattccattccaattagccctggttttgtaaaactaacatttcttcaaggacaaatggttacaacctcacaaggccatccaacttggctttgcctgtatacattcttctgaaaagtatgtgttgcatacagtgttggttgcctgctcttcatccattgctgcaacattccttgacttataaagatggtcatttacccaatcaccacaaataaggatttgtctaagccaatcatggcaaccttgttttcatttgtcagtggctgggttctgggaattctaggaggggtgtttttttctctttgataaaaagtgagaagcacaaaaacaaggagaagaccagtctctgaagtctccatggaagctgatcagctgctaggatgagtagatgagaaacatttctttcttctatagtaagtggactttgttcactactgtgagtgaacatgctttaagctgcagtagtcacctgtggccatgatgtgacaggcctgagaatgaaagtggtggagccacacagccaagcctgggagcacgaccactgaacttcttctgtaaaataaataagacataaataagaaatgtctttatggcccaaactccaaaagaaggaaggctggcacataggaaacaaaattaaggatgttcttgttccttctgattatttttctaagggccttctagaattcctggaaattattaccccttcttcttcccagcttgtcagctttgttctttgattccccaaggcctagttggtcacggcttatccaggttaccactctcctgctccctcagcccctcccatctcagttgtgttcacaacaggtctgtgtgctggtgcctgtgttgttgggagtcttcattcacagaggaccccaagaccggactcggtgccatttctctccttctggcccgttgctggcccttatgcattacttgcctttttctcagctctgtctggactcatgaggtcctgggggcagaatcagtctgtgtcccctgaatgctgagtgccctctaggtgcttaaatgttgttcacttttcacagggaaagtcttcagatggcagtaggcccattcctccacatcctagagagcaacctgctgaaagccgtggactctgccactgcccccgacaagatcaggtacctggcacagcaactctgctttgtgcagctaagggccgtgggaacttctggctgtagggagggaacccaaatcttagtgaggcaagaaccaggctgtcagtgaccgaaggtagatgtttaacaggcctcaagtgtcaaagaggttcacaatcttttaacctttcttcctgctgcacccctcctaccatgttttgaaaattttatttttgctttctctctctcttttttttattaattgaagatatgtcaaacagtagccaattatgatgtcacactgatttgatatgataatagtccaaaacaaagataaattgcttaatggattgtgtagtttgaaccactttcattgagtgtaaagaaggtatgatatccataaggcatttaaaaatattggaagtggccaggtgcagtggctcacgcctgtaatcccagcactttgggaggccaaggtgagtggatcacgaggtcaggagattgaaaacatcctggccaacatggtgaaaccctgctctactaaaaatacaaaaattatccgggcatggtggcacgcacctttagtctcagctactcgggaggttgagtcaggagagttgcttgaacccaggaggcggaggttgcagttagccaagatcacaccactgtactccagcctggtgacagagccaggctctgtctcaaaaaaaaaaaaatgttggaagtagctcatgagcctccattgccacttttggagccttgaatccaaggttgggactacggctgtggaatattatgtgtcctaggcacttgctaagtgcgttctgcaggaaaacagcttcaccgttgcccaagaactcatcaggttctcaggctccagcctgatctactaaatcagcatctgcagtttaacaagatccccaggtgattgatagtcacctgaattttggagaagcactgttgtggtatcacagctagaaactcatgatggcgtaagaggaataggagacagtgagttgaaacaggaactttgggccaagatttgtaatagcaaatcttgtgaataccatttcctgtccttcacagtacctgcaatgacagtacattttttctggcttttgccaccttgccaccttctgccttggatctttagaacaccacaggatccaatgctagtcttctaggatgggggtccataaataaaatccttggtctttcctaagagatggatactggtgtcaggcagatgtagattaaaatggcattcttattacagattaaagccatttggagaatgtgctgagggccaaatgggcttgtgaatattattttgaaataaacttaataccccaaaacttcaagcttccccaacaaggagccctactaaactcatcccatggctgagagtaggaagggcattcatgtaggctggcaggacccaaagagagaagagaggtagggtctaagccacacacgctcagtttcttctttgaaactcaccagggaggagtgagtaggtggcaaggaggaggccaggagaatttctctggcggggaccctcctcatgaagacacggggagtgggaacaagggttcttcccacgatctactgcaaaggacttttataccaggctcagctgatttctagatgtcacctagtttctgaggcaagtgtgtcttacgtaaaggaggcaggccacatcctgaccttcagagtcctgaggcagagaattgtggagagctgtttcctcttgcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggtaatacccctgaggtggggttgggtggtggtgaggcaccctcctgcaaaacccacctacctgagttagcaccaagtctccctcctcaggcccagtggagtctctcttggcacagtcagctctctgaatcctatagggcaactcctggctatggcccaggggtcaggcagaacttgacagatggtggcaggatggggcttgagccttatcccagttctgttacagactcctaggaacagggtccccctcctcttctcctgagcgtccctgtcaggatgtcgcctcctggctgtgagacctgttttggagattgttggtggtatctttgggaggtgatgtgtgctgctgttagcacccgtggtgttggctgcttcatcagggctggggtccagggcagaggccagagcacgccccagggatgagcctgttggttctcccagctcggggatgtaactcgactctttcttcccagtcaattcaacactttttgagtgacttttacaagcagagcatagtgcttttattctggaagctcaccgggtagtggggccttcctgtctgtaatatgtatgcacatgtataccacatggatcagagcctctcagatctctgggcttagctggaaatagcagaaggacaggttcctcggcggacctgctgagttatgtttcttctgcaggagcaggtgccgagaggttgccctgatgggctctgcccgctggacatgttcttgaatgccatgtcagtttataccttaagcccagaaaaataccacgcactctgctctcaaactcaggtgatggaagttggaaatgaagagtaactgatttataaaagcaggatgtgttgattttaaaataaagtgcctttatacaatgcc

SEQ ID NO: 38443 - DNA, 67574 bp, Homo sapiens
gacttcgggtttgcactccccggagccagaactccgtggcggctccgggcctccgtggatccgagcagagactggctgcccgcctgccactcgcaggctgggaaaacgccagccggtgcctcgccgggaaagttctcggcaaagctggggatgagccctcagcagggcaggctcccggtgcagcgcgcccccatccattgcccgcgcgcaagaacccggaatgggccccacctgggccgggactcgggcgtgcgatcccgagggcgccctggggaccacgcatcgggtggggaccctggccgagggcgtgagctgactcagtttttaaaaactcgcttcctccttccctacttgtgccggtcactcacctcgctgggaaccagcccagggcagaagggggagagggaggcggtggcctccccaggaaggaggagaggtgagtatcccgccaggtaaaggcggggcggctggcggagctgtgcctcggcgtctgcgcctggtgtgggaggaaagcgggtctcccagctccacttaaacccctaaaacctgggacttctagcttgagacattccccgaccaccacccgtcacacacacgcgcgtgcgcgcacacacgcatgcacaccgattctctgggccctagggaggaggggggatcagggctctattttctcccgaccccctcttatccaactcggctggcaagggttggggagaacttaggcccagcccccggcacacgctcagcgcgctccagcggcatacgctggggagtgggtgcccgcctcgctcagctgcgatccctcgcctcgggcccgggggtggtgccgagggccgggagggagggtcggccggtgggcggtgcttctccgggctggaggccgctcctggccggcaccgccctccgcctcccgcggtccctccctcccgcacgccggcgctcccaggccgcgcttcctgcgtccccaacccggtccctgagagggcagtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccgggtgagtctcagccgccgcgccttgcgcccgctgcttcccgcggcgcgctgtcggttccccacagggccgtgtaagggggccgaggcccgtttgggtctcctgtccgtccgtctgtccgccgagcgcttcccgcctggggtcgaccaccgggaggactccgcaccccgcaccctctgcggccgcgccccgccggcgcgggacgctcccgcctcccgggcaccgcgcctggccagctggcctcggctggggaaggcagctggccttgggggccccctgttggcgggaacaggtgctatccgcccggcgggcttcgaacccttggcttcgccagaagcgctttcagcgcgtggttaggagcagaacttcccagtaggtcccaggaaaccaccttggcgctttgctcgcgcatcccttactgtatggaagtcggggccttttagggatttagattcgtgtgtgtgtatgtgtgtgtgtcgctctacaagcaaacacgggggtaaagaatcgggcatgagcaaagtggattgaaactcgagtccttccctgagcgcgtcggtttcttcatctgtgaaactgacatgacaacgtcccagggtgcggcggggcattcatgcccagcacccagcaagcactcagcggtaagttacgttaccgggcctaggggagagcagagtacaaatcagatctcaaatcagcgcacaaacgggaggcgcttggcccggcgcgcctggtctgcattacaggataatggtctctttcccaaccagcggtgggggcgagagacctggcccctcccccacggtttccccagggagcagcccgtggggtgtcctgcgcagcgctccgaggtgcctgtgacggtgcatgggactgcgggtccttcccaacagcaggggaggtctggctgctgggaacccgggcgctgccggagtggggtgggcggggacgaggtgggcggggcagggacccgaaccgggaggtaagtcagcgggtggaaggctttcccctctaggaccggccggcttctggctttccttttgaatgggttacccggagaacagcttgtctagggaactgttggccctgggaccgtgaacagctttcacaccccggaaacctgtcacaagaggatcctgacctattgggacagagcccctgcccctccaaatatctcactccaccaattgagaggtacccccagactgggagaaaaggccaaagaaagagagaggaggctagtggtgaacctgctcctcacggcttcggagctgacagctctctgatggggtgtctggggcctgccccagtgacccagagcccagaagcctcagggagcccccagcctagtgagggagtcagggatactcatgaaaagtgttgcagaattggcgatacagtcaggccacaccacttgctggctgtgtgacctgacctctctgagcctcagcttcttcatctgtaaaatgggatgatgatctccaagggcgaggtggggtatttatgcctagcacatgaagtattctatagtaagttatgtcacagggcttagacgagaacagaagaaaggaaataactcaggaggtcctgctaagaaaagagtattagaatattcatcagggaactggagtccccccagggaacaggggaggaagggtgtctgggcagatcgaacagcacaggcaaaggcacagcgacaggagagtgcctggggtgtgctgggctggggaaggtgctcaggcagtggagggtgtggaaaagtaaagggaatggaaggtccggagtgagctggactggacaggtgggggctttcttggaatcattcaacatatgttggccgagcaccttctgtgggccaggcgctgttctaggtgctcaacaaagatgaacaacatggagaaagacgtccctttcattcaagttctctaagcagggaagtcgtctgatcccatccatatgttaagaagataatcctggctgcctggaagttggcgaggatcctagagaagactcctaggagagagaggctggcctgtgggttggtgggggcagtgggaatgaatgggggagctggaggagaggcccatacaggaagcagagagtaatgtgtggccttcactcatgactgttggtcaagggtaagattctggggttctacatgaggcccaaactgccagcctggtcccctgccagagagaagtagtgagtgagtgtctggggtattggcaggacccaagcccctccagctgcgactctccggctcgctggctccagatgtcacgaggcctgggagtttctctgtctgcgtgagggatgggaaagctggaggcagaggccagctggagcttctggggctcccgttttaataggttgtgtttctggtcaacgttcctccctccctctgcaggcctggctgtaaacccctcaggcttcttgggctggaagaggccagagtgtgaggagctttagtgtggattctcttcccccagccccaaattaaggtgggagtcatgcaaaagagaagcattgtctccctcggtgctgggaaagtttcagaagctcaggtgtcttctgacttgggatgtggtatgggggctgctgacttttgctttcacttttgtttctgctctgaagctgggaggaatcctcctcttgcagcgaaagctgtgagaatatccttctccatgcttcaagtctccctttgcttggagggaaaaggaaggtcctagaatgtctcaggtggaggggaccttcaggtcatcagagacatcattctcatttgacaaacaaaactcagagaggggatgggacttacccaaggacacacaacagttcagcagcagaactgggactggaacccagccctcctgactcccttctagggccctttactttaacccaggagacctggccacattcgggaccaagactgttttgggccccaggtttctcaacctctcagtctttcaagcggcttcatagagttgagctcctccccagcctggacaggtggtgcagcctcccctgccaatgttttattctcccttcctctggattgagccctcgctgccatggccacccctcctgggagctcttgctcctgagaaagaaaacaggccgtttgtttggaagaaacaagccacctgtttggtttcccaataccaggccacacagccctgtccctcccagacagccccaagatgctgaccagagatagccctctgagggtctctgctgagctcccctgaccctcgactcctcccctcagctcccgtctcaagactgctggttggtcctcaccttctgtctgtggtgtttacttgggcggagcaacctaaagtctccacattctctcttgccctggatttatcagacttagcagcccttaaacctgaatgcgtagcttcagatcttagaatatcggggccagagggatcttagccatcagaaaatccactctgcttatttgacaactggggagaccaagacccagggaagaggagatttgcctgagatcacagccaggaccagaacccgaggttccagagtttgtcttgaatgattttgaggatgattcttgaaaaacaaaacagggcaccctccccctccaagatcccctttctgtctgcacttcacactaccaggtgtttttgtggcatccgtggtgacatggtcaggaggagtaagggccaagggtcctgaaagatgaggtgtgcacattgaggagtgtgtctgcgcatttccaggtcctgtctgttcaaactggcattaacaccacggcatgagctagtgagtgcatttatctggcactcccttagccagacttgataatgtgtctttggatggcaggcttttaaagttgtcttcgtccacagattacaaaagaagtaggtgctccttgtaaaaacgagcagatgacatcgtgaaggctggcgaccactgttaatatggtggcgttttattcaggtttttgtttgctgagctgtttcatgtcctggtttgttgttgttgcttttgaaaaaatagagacaaggtctctgtgtgttgcccaggttagtcttgaactcctgggctcaagtgatcctcccacctcagcctcccaaagtgctgggattccaggcaagagccactatgcccagcccgtatcctggtttttcaactcgtcattacagtgcctgttatcttcatgagataatgtgagtgacttcacgcaggatctaacctgtaggtctcacgtgcttccaccccttgatggctagcaggtattcccttggccaaaaccctgtgacgctgtgcaaagtgcaaagacgtttccaattcaccactgtgggagtccagagggccgtttttctgcatcaccatggggtttgggaaagcaattctctctgaactcttagaaatggaagccacgggccatctgggtgtgatgcgtgtgacccaaattcatacagagggagggagacagctttgtttcttctgacttttatgtgtttatttttgctgtgtttgttttaacccatccaagtgccgccaccccaccatcactgccccttgccccaaatctccctgggattaggcatggggttaggcaagttgcaggtctctagaaaaatcggtatttggcatgctcatctccaaaccctggctcttgcagagtaggcgtttcaatagcaaagatgtgcagagaatttgtttcctaatcggtgattcaggtaggacaccccattctgggaacaggatggggcggggtctctgtctctctctaccaggatcacagctttgttaatgccataaatcatcagtactggaagtactcgtatcttggggattttctaagctcatgttcacagaatggacagccacttactagtggatttgagcatcgttgagtggttttccgctggatttttaaaagtgaagtagaagacagtggactagaaaatagcatgcatttcctgtcacgagaaatattccttagtaaaactttcagttatctgtttgtggatgtgcactgagtcactaggtaaaaacgtctctcctcctgcatggtaagaaccttgcgcaatgtagctccggttatactgtgatcctgggaaaccttggatgggtcctagaagcaactcaggggtttgcagggacagagctgagtggtggaggcagggccgacaggaaggaagctcggcttatgctaaggatacaaaacatccacttttaaaactctgtgactttaaaaataaaacagaaagttggaagccattgttcgtctagcctcctcaattcctagaagaaactgaggccacaaaacagaggctggggcctttgctgcaggggaggtagcactcaggcctcacattgaggagaatctgcagatgtagacccttgacccctccacaaatgagcgactcaaaacacacgttcacggtgcagcctgtgacccccataggcctcactgttgcgtgcactaggaattcatgtttatcctaaagcctgtcgctctcgtgccaacaacccaatttatattgctgagatgcacaaagcattaattttttcaatgccacatttcaaacaaagaagagttaataaccctgttctggcatttctttttttgttttgttttgttttttgagacagagtctcgctctgttgccaggctggactgcagtggtgcaatcttggctcacagcaacctccacctcccaggttcaagcgattctcctacctcagcctccctagtagctgggactacaggcatgcgccaccacacccagctaatttttgtatttttagtagcgatgggatttcaccatgttggccaggatggtctcgatctcttgacctcgtgatccgcctgcctcggcctaggcatgaaccaccacacctagccttcttctttttttaatgtccccagagctttaccaatggaagcttcccaggcccatcccctggcctgagaggcctttgagatgataagcccagggtcaccaaatcctggcagaacctggcagaatgagaactcaccacagggagcaagttcttttttttaagatcgtggactcacatgatgtgcagttctggatgtctccaggaggttttgctatttcctcaacaggtaaaattaggtggctctaaatcttgggcaattttatgtcttttccatgtttttctcctcacatgtggtctagggaggggtgtagagaagcaggtggaatttacttgccttaccttatcctaccttttcctggaacccacaggttgggcctgtgctggttagggtgtggggcatgatttgttgatatttggtgagggaaaatgactttattttattttatttatttcttttgagacagagtgtcactctgttgcccaggctggagtgcagtggtgcaatcttggctcactgcaacctctgcctcctggattcaagcaattctcttgcctcagcctcctgagtagctgggattacaggtgcatgccaccacgcccggccaatttttgtatttttaatagagatagggtttcaccatgttggccaagctggtcttgaactcctgacctcaagtgatccacctgcctcagcctctcaaagtgctaggattacaggcgtgagccaccacacccagcaagaacatgattttaaaaaacaaaacaaacactcaaactttcttaagttaccataagaggcctcacatacagcttccttaaaactgcctgcaatttggagagaagcagttaggtactggaactgcctgtgggtaattattgttttcaaacagtgacagatgcaaattctcttcttttgggggaaattgcctgtagctaaacaccggcgccatcactttaaacaaatctcctgatacatatggtatgccaggcgctgagcccaggaacgagggagagtcagcccccgccccccaccccgatggagctgatcccccacgggaggcagcagggattgtaccttaacaacatgtgaataaagatgaggaagcacagcccgtgaaggaggaggcttaacccaaacttggagagtcaggaaggattttcagaaagagtgcagtctgagctgaaatggggagcggggagggcaggtgcagccgccaccgccaaaggtcttcctggtggaggcaactgcctgtgcaaaggcctcaaggtgtaaaagagcttcgttaacacaggccaatactgagtgtagaaacgctgcactcagggcagatgctgaaggcagaggtggaaaaagtattttatatagtttcttcttaaaagtcattttgggggctgggcatggtggctcatacctgtaatcccagcactttgggaggccaaagcaggtggattgcttgaggtcaggagttcacgactagcctggccaacatggtgaaaccccatctctactaaaaatagaaaaattacccggtatggtggcaggtgcctgtaatcccagctactcaggaggctgaccacaggaatcgcttgaacctggaaagcagaggttgcagtgagccgagatcgtgccactgaactccagcctgggcaacagagtgagactcatctcaaaaaaacaaaagtcatttttctcaaaaaattaaaatcgaataaccataggatccagcagtttcacttctgggtgcatacttgtcttagtccatttgtgttgctgtaaagaaatacctgagattgggtaatttataaagaaaagagatttattggccgggcgcagtggctcacgccggtaatcccagcactttgggaaaccgaggcaggcagatcacgagatcgagaccatcctggccaacatggtgaaacccagtctttactaaaaatacaaaaattagccaggcatggtggcgggcacctgtagtcccagctactcaggaggctgaggcagaagaatggcttgaacccgggaggcggaggttgcagtgagccgagatggagccactgcactccagcctagcgacagagcaagactccatctcaaaaaaagagagaaagaggtttatttagcccatggcatctcagatgcatcagcatctgcttctagtgagggcctcgggcagaaggacagcaggcgtcatgtggtgagagagaagaggagagaaggagtggggagcagactctttaacaaccagatctttgggcaccaagccattcaagagggatccactcccaacaaccaaacacccactaggccccacctccaacattggggatcaaatttctcttctttttttgagacagtcttactctgttgcccagactggagtgcagtggcacaatcttggctcactgcaaactctgcctcctgggttcatgcgattctcatgcctcagcttcccaagtagctgggattacaggcatgtgccaccatgtccagctaatttttgtatttttagtagagatggggtttcaccatgttggccaagctggtcttgaactcctggcctcgagtgatccacatgcctcggcctcccaaattgctgggattacaggcatggccaccgcatccagcctggggatcaaatttcaacatgagatttggagaggaccaatatccaaactatatcaatgctcaaaagaattgaaaacaggtttttgaagagatatttgtacacccatgtttatatgagcattactcataatagctaaaatatgaaaacaacccaagtatccatcaaaggatgaatgaataaacaaaatgtggtctatccatacagtggaatattattcagcctccatgtggaaggaaattctgacaccatgctgcaacatggacgaaccttgaggacatcatgctaagtgaaataagccagtcacaaaaagacagatactatatgattctacttgtatgaggaatctagacatcatagaaatggaaagtagaatgttggttgccaggggctgggggaagaggaatggggagttagggtttaatgggtaaggggtttcagttttgtaaaatgaaagcgttctgtgaatgcatgatggtgatggttgcacagcagtatgaatgtacttaatgccactgaactgttcatggaaaaatggttaagatagtcaactttatgttatgtgcattttatcacactaaaaagttggtgggtgggggagtcattttggaaacaagactcagatagtcatttggccatatcattgcgttctctctacagaccaggtgttcttccaggctttggggggaaacggtgcctaagacaggctcagttcctgccctcttggagcttacaccttattaggcagcagggaggagtcagtcaagtaggaaaccaacaagtaaaataacaaatcaataacatgtcaaatgcactgatctgaaatctttgccccttccctatgctggcaggatcaagccaaagctaagctctttaactttcaacactataaagcccggacttcttagagtcagcctctgttaatcttttcagacctattactgctgccttaccccaacttcaactgcatcagtcacaaggaactactttccacccccacctacctcgtacccctgctcaaagccaggaactttggcggcttttttccttcctgttctttctgcttttctttctagactgcccagaggctttagaaaacaccataatttcaattctagaagtttatcctaagaaaacagttaatgagtataaggagttagtttcgagactgttattttttgtaataatagcaacaaaattagaaagccattttgtttttaatctgtccagagatggtcctagccacgaccctttaaataaatttttgtttaattttggaataattttagatttatagaaaagttgcaaaggtaatatggggcatttttgtctacccttcacccaacttcccctaatgttggctttttttggggggggggaggggggaggggacaaagtctcactctgttacccaggctggagtacagtggcgtggtctcggctcacagcaacctccacctcctggggtcaagtgattctcctgcctcagcctcccgagtagctgggatttacaggcatgcaccaccatgcctggctaatttttgtatttttagtagagacagggtttcaccatgttggccaggctggtcttgaactcctgacctcaggtgatccgcccacctcggcctcccaaagtgctgggattacaggcgtgagccaccatgcccggcctaatgttggcatcttacataatcgtattatacttatcaaagctaagaaattgacatcacaactaactaaactacagactttattttgatttcgctggatttcccactgcatttttattcaccaggatccaattcaagatgccacattgcatttggtcatcttgtctccttagtatcttctgaactgtgacactttctcagtcttttcttaaatttcatgaccttgagaactttgaagagtactggttagtgttttgtagaacttccctgaatttcggtttgcctgatgtcttctcgtgactggactgggcctttgggttttgggaaagaatcctacaaaggtgaagtgtgcttctcactgaatcatgttaggatggagataatatcaatgtaacttcttattgatgacatcagccttggtcacttggttaaggtggtgtctgccacatttctccactgtaaagttactacagcccctttttggaagggtattctttaacatgagagcgaaaggcaacattataaaagagattattgaaacgatttttagattaggcacctaaaatttaaaaactttgatatatcaaatgataaactggggacaatatttgcaacacagaacagacaaagagttgtgttctgaatccatgcgggagctttgctttttttttttttttccttttttttttttttgagacggagtctcgctctgtcgccaggccagagtgcagtggcacaatctcggctcactgcaacctctgcctcccgagttcaagcaattcttctgcctcagcctcccgagtagctgggactacaggtgcgcgccaccacacccagctaatttttgtatttgtagtagagacgaggtttcaccatgttggccaggatggtctccacctcttgaccttgtgatccgcccacctcgacctcccaaagtgctgggattacaggcatgagccaccaagcccagcctgcttttctagttagtaaggaaaagctgaatgccctagttgagaaatgggctaaagaagaaatgctgaggccaggcacagtggctgacacctgcaatcccaacgttttgggaggctgaggtgggaggattacatgagcccaggaggtagaggctacagtgagccgtgactatgccactgcagtccagtctgggtgaccctgtctcaaaaaaaagaagaagaaatgctggtggccaattagtacatgggaaaaaaaagaatcagtattcagcctcattgtattaaaggaaatgccaattaaaacaatgccgtctttcacacaggaaatctaaaatgttttaaaagttttaaaattttaatttaaataatgctaactgggaggtagtgctttcaggagctcagcatagaagtgtaaactggagaacagtctgaaaacacaggcccaaacctttaaagcacttagctttaaaacacttttaattccaagattttaaccttgttattaatatcttcaataccaagattttatcccgaggtaacaatttatggttgtatacggagttaatttcaacagtattttttataatagcaataaaactaaaaatcaaatatatttgcagcaacagggaattggtgacataaattgcagctctttcatatactgaagtggtcctcaaccactaaaaattccagtattgatgaatactgatgatacgaaagattgttcattgtacatcaaatttttcaaaattaaggttatactgggaggtggaggttgcggtgagccgagattgcgccactgcactccagcctgggtgacagtgagatttcatctcaaaaaaaaagttagggttataaaacatattgcagcaatatcccatttttgtaaaaaacaaaaaagtattttgtttacacagcacacaagaaagcatggataccatcatagatatttatcagcagttatggatgggggtagccatggggggtttcgatattctttctgctaatctgtatttaactaatttttatttcttaaacaagcattgttttcataacaaaactgttattgataacaccttctcctcccatttggaactttaatgacctgtgctgaagacccataggcttgttatgcatcccacagggattactgccaggcaaggtgctttgggaactgtagagagctttgaagacatcagctgccactcctggtggttggtttacccttcaaacttcgagtatctgggcctcccttctgagacttaggaagctgagataggagcatggtggaagccacagcagccgactcataggcaactgtgagaaaatactcacccaaggctgggcacggtggctcacactgtaatcccagcactttgggaggccaaggccggtggatcacttgaggtcaggaatttgagaccagcctgaccaacgtggtgaaaccccgtctctactaaaaatacaaaattagctgggtgtggtggcaggtacctgtaatcccagatactcaggaggctaaggcaggagaaccccttgaacccaggaggcggaggttgtagtgagccaagatcagagcactacactctagtctggatgacagagtgagactctatctcaaaaaaagaaagaaaagaaaatactcgcccagcattgtattttatatatatgtatgtaattttccatttgaacacagttcgatgagttttgactcacaagcaatcatgtaaccaccaccacaatcaagatgtagcaaagttccatcaccccccaaaatactctcctgctgcctctttgtagtctttcctgtctccaccccccagcagccactgatcttttttctgtccttatagttttgccctttccaggatatcacgtaaatagaatcatacagtatggtgcctttggagtctggctgcttctactcagtagaatacatttgaaatggctgggtgcggtggctcacgcctgtaatcccagcactttgggaggccgaggcgggcagatcacgaggtcaggagatcgagaccatcctggctaacatggttaaaccccgtctctcctaaaaaaacaaaaaattagccaggcgtggtggcgggcgcctgtagtcccagctactcgggaagctgaggcaggagaatggcatgaacctgggaagcgcagcttgcagtgagccgagatgacgccactgcactccagcctgggcgacagagcgagactccatctcaaaaaaaaaaaaaaaaaaaaaaaaaaaaaagaatacatttgagatttccccatactgcatttattccatggtatgaatgtgcaggacgacagtttacttatcccttcacctgttaaaaggatatttggattgtgtctactttttggtgattacgattaaagctgctataaacattcagaggttttagtatcaacatatgatttcatttctcttggggaaatacctaggagtggaattattgggtttgtatgtgagtgtatgtttatctttatatgaaatgactaaacttaggaggttagggccagttcctccagccagcaccagggctatgcagggacctaatgaaacattgataatatcctcccctcccatttggaacttcagtgacctatgttgaagacccggtgaaaccatctgtcttttctggagtgatgctttcactttgccagctgatgtgggtttcaccctgctggtaggaggttgaccacctccccattgatgactctccctttcccatatcacaggcatggaaatgacaatgagtagtgatcgttcttaacttaaataactttttcattaactctttttctttaattaggaaactaatatatgcacatggtataaaaaaatcaaatggtgtaaaaggatgtccaatgaaaaaatatacatctccctctcattccaggctcccagtcccttatacgagcgtagccaccatctgctatttcttgtatatacttctagaaattgtctctgcatataatgatgcttttagatgctgcttttagatgtttgcctggtcatcaaagcaataaagtattatagtggtcaggatcattatgaaattgttgggtaatttcaaacttgtaataactcctatgagggtcctcaatcacctttaaggacccactaaccacctgaaatggtctgtcaagcattctctgtcaagtattctatctctgcatttttctgtggcaggtcagtagctttcatcagattctcaaaggggtctgtgcaccaaaagaaagaaggggaatggggaagaaaagaaggaaggaaggactgtagaggcaatcttttacagacaaatggtagataaatgtataatgagcttggatacatctgcaattagctgtaactcagaatgtataagttccaattttatgtattattgccccttggttttatgattggaagctggtagaaccactgatttaacagcataggctgttttgtcttgggctaagaggaactgtgcctggctgagccaagagagacgaaggccatagagttcttcaaccttgcctgtgtgtttgtactgactcactgcatctgaggaagtctgttggtagcttagaacacgcgtactgtctctcccagggtgagccagtgactgggaacgtctcacagaaaggagcagacaaacttgcttcccacaagagggcttcaggctgaaaaatattcaagaagagtttaggggaattcctgggagtcagagccatatccggctcatgataaaagttacagatatttggggactacccttattagagtcaatatctggagttggagtggggagcaactaagctttcccatcactcttaagtcatttgatgctcaaaacagttctatgttagggaaaccgaggcaggagtatgctagctacatacagtgcaaactaccccacatctgaaggacttaaggcactccagttacattttcatatattgggtgggaaggtggggtcttggctccacacagtcattcagagacccaggcttctatctttagcacttcttctccaagagtttagtgagctaataacagggcccacagctagaaagtgagggagtcgggatttgaacccagccagtctcattctgaactatgatgctatggtgagaaacaatagtactggcatctaactagatctacctggcatgtaacttcagaactgggaagtgggagataacttgggattctgaggaacatttgttccttgttgccaaggaatcaagctcttctttttaaggagtgagatgggtaaatctgagagactttttttttttactttgtcttcagttgagaattttcagattcaacacataaaaatgagagccttttccctccaaaagtttgcccctgaaataaatgtgcgtgagactatgttgcctggtgcttgggtcttttcattagcaaatatcaacccccaaaagctgatcgcccttccaccatgttactgctcattgcagggaggaagtttgagacatttcagcaacctgattaaaagattttttcccagttgaaatgtcttcttgtagaaacaacccaaatgtcccataaaagcctatggtttctacaaggttatacaaggggaacaccacatggccattcaacatggcaatgacacagaaggctctgaaagacatagaaagatgagtctagtgtgccaatgtaaaaaggcagattacgaagctgtccattttttatttcaaaattccctaatacgcaaagaataaaaatttgactatttactataatgtttctaatgtttattcctaacagattacaagtaatttttattccctttctccctgtcttctcttttctaacctgtactttctgagtttcccacagagaaacatgtatgactttgtattaaagtaacagctttaagttcaaatggtcctaatgatctgggtgaccttgagccatggctcactttctcgaaatggggagaatagttttaggatgttgtgaagattcaactataaatgtacttaaaacagtacatgctcaatacatttttaggtgttactgtcataattatttttgaaaatctttccattctagtaagtccattccaaatccaagccaaacacacctgagagtcgtggggctttatctcagaatgcctgggagtacagacccatgagcaagccaacttcctcctttccctcctctcccccggccctctgctgcagggcaaggtaaagctaggtgcctgggatactgctgggtttttttttatctttttttttttttgagatggagtcactgcaacctccgccttccagtttcaagcgattctcctgcctcagcctcctgagtagctgggattacaggtgcgcaccaccacgcccggctaatttttgtattttttggtagaaacggggttttgccatgttgcccagactggtatcaaactcccaggctcaagtgatctgcccacctcaggctcccaaagtgctgggattataggcgtgagtcaccaccacacctggcctattttaaccatttttaagtgtacaattctgggacattaagcacatttacagtgctgtgtgaccatcgccactgtcttttttccagaactactacatcatcccaaacagaaatggaggcaggttttctttttttgagacggagtctccctctgtcgcccaggctggagtgcagtgttgcgatctcagctcactgcaagctccgcctcccgggttcatgccattctcctgcctcagcctcccaagcagctgggactacaggcgccctccaccacgcctggctaattttttgtatttttagtagagacggggtttaaccgtgttaatcaggatggtctcgatctcctgacctcatgatccgcccgcctcggcctccctagaggcaggttttctaaatgcttgcatgagtggttctccatcttcagcttgtgttagaatcctctggggtggggggcttgttaaaacatagattgctgggtcctccctcctcctccaccccccgccacatcccccacccccagttgctgattcagtaggtctgagtggggccccaggatttgcatttctaaccagctcctgggtgacgctgatgctgttgatttggggccacgcctggaagatcgctgtttgagatcaaaaggtttgcaggtcagagtggatgacggcatccttccaggtcaatgagagaagccaaacttctatgacctatgagataaggggtttgttataggaattagttcttatgcattcatagggggggcggcagaaaggaaggtggaagagttgccggggaccaggggcatcgccacctggccctgggtacacgggcaaactggtggagaagtctacagccagccgttgtctggtccatccccagccaagtgtccgcgggggggcctgggctgctgttggttaacaggaccagcagtcaggagaaagagctggatgcagaatggaggacaggctcgaatgtgctggaacccacggggctgtctctcacctcatccaatcatgatgacctctaaagtgtaatggtcgctgcttcacttccatctcccagctttccacagattcctcttttgaccaattataacccagaaccagtcagagaaggggattctgggaaaagtagttccagcttaaccaagcccgcacagcaggaactaccacagctgatcaatcagtccttgccgcggaacctcctccttgaacccacaggtggtttctggggctctgctgggcgttccctgactctcttgacaggaccttctagcagaaacagatgtggtccatcccaacaaccccttgctcagatcatcagctgagaacttaataaaagcagatttccaggccccagcccaggcctgccgagtcagacttcagcagtgggactcaggaatcagattttcaaacaagctctctagctgattaacatacccagccacgtttgaaacttctgaagtatggaaaagaaagtggactctgtccaggcacagtggctcacacctgtaatcccagcactttgggaggctgaggcaggtggatcgcttgagcccaggagtgcaagaccagcctgggcaacatggcaaaactccatttctgcaaaaaagaaaaaataccaaaattagtggagcatggtgacacgtgcctgtagtcccagctacttggaaggctgaggtggtagggtcacctgaccctgggaggtcaaggctgcagtgagccaagattgtgccactgcaccccagcctgggcaacagagtgagtgagaccctgtctcaaaaaaaaaaaaaaaaaaaaaggaaggaaggaggagggagggaggaaagaaaagaatggaaaggaaggaaggagagagagaaagaagaaaaaagaaagagaagaaggagagagagagagacagagacagaagaaaaaggaaaagagaaagtaagtgaactctggggctagacagccacgggttagaattctggttccaccacgtgccagctttgtgatcctgagcaagtgacttaaccctttatgatcctatattgtctacaagagttcctccttttctatcatttcactctccactgtttcagttacccatagccaactacaatctgaaaatattaaatggaaaattccggaaagatatgattcataagttttaaattgcatcccattctgagtagtgtgatgaaatctcacactgtcccactctgtcctgctccagacgtgaatcgtctctttgtccagcagatgggtgctgtcgacactacctgctcattggtcacttaggagcggtctgggttatcagatcagaaaacgtcgtcgttatgtgtaaggtcgggtgctgtctgttgtttcaggcatccactgggggtcttggaacgtatcccccgaggatatgtactcagctgttaaatgggctcaatgcctacctttttcatggagggttgtgggaaccgaatgaggccatgtgtaataaacttctggcaggtgaaatattattgtgcttaatccagttaatagttgtgcctggacatgcctagggagtaggtcagatgggcccagcatctcctctttctgcttaggaatctggggtttaacctgatcatattctttttttttttttttttttttttgaaacggagtttcgctcttttgcctaggctagagtgcagtggcgcaatctcggctcactacaacctctgcctcccaggttcaagcgattctcccgcctcagccttccgagtagctgggattacaagcgcacactaccacgcccagctaattttttgtatttttagtagagacggggtttcaccatgttggccaggctggtctcgaactcctgacctcaagtgatccacccacctcagcctcccaaagtgctgggattacaggcgtgagctactgcgcctggccaacctgatagtattcttaacacagattgttttcctgccatcatgaaaactagacttgctttaaagtctttagagtctcagttcatattccaggcattgttttacataaatatcatctgtttattttttctttaagcaaatttcacaaactccatctaaaaaaaaaaaaacacaaacaaaattcatctgtcaaagaagagcctttcaacttctagttctgtttatctaaaaacaccctttcttcaacctggaatcttggacattttgccacatgctgaacgtttctatgaatttctttttgtgtctgtcaccttgacgttagttgtcaccttaactaggtaagacttaggttgtggtctgcatgagtagaacaagctagtttttcaagaaagcaagttggaaggtttcataacacctgctcttcaatgggttaaggcagtgctccggggccaggccatctgataaagggagtggtaactttgaagtgtggcttataaagaagctgttatttccacagcaagcgaaagcagcagtaaagaaaacagggttttgcagttccgctggaaggaggttggggaaggtcagaaatcagggcgggaacttcgagagcagctgtcagcactgggcaaaggctgagacaggtgagcattgggcatctctgaatgacatgcagggttctgtgccttagacacacttctgtagccttcgttgatagaatcccatcattttcctttttctttttctgatggatttcactctcttgtccaggctggagtacagtggcttgatcgtggctcactacagcctccacctcctggactcaagcaaacctcccacctcagcctcctgagtagctgggactatggacacgctgccaccacacacagctattctttagtttttgtagaaaccgggtcttgctgtgttgcccaggctggtctcaaattcctggggtcaggtgatcctcctgccttagcctttcaaagtgctggggattactgacatgagtcaccacacccaaccccctcattttcctatatcggtctcaactctgaagtgtttcaacctggagacctaggtaaatttcattcgttatttgagattttcctatgtcagtaaagggctcaggttgccatataaatatcatacactgggtggcttacacaatagaaatttattttcttgaagttctggggggtgtagtttaagacccagcagtgttcaatttctggcgagggctctcttcctggcttgcagatggccgcctactcactgtgccctcacatgaactttccttgatgcacgtgtgcagagagagctctctggagtctcttttataagggcactaatcccattagaccaccttcatgacctcatctaacctgaattacctacccaaagccctatctcctaatatgttgggagttagagcttcatatgaattttggatggacacaaatattcagtctggacagcaccctaccatccttttggtcgctgacactaaaatcctctgtccccttcatctctcctgcccaaatcaaactcatcacaagttcttctccatttgtcaactttgactctaaactagggccgtaggctgggtgcagtggctcacacctataatcctagcactttgggaggccgaggtgggtggattatctgaggtcaggagttcaagaccagcctggccaacatggcaaaaccccatctctactaaaaatacaaaaattagctggacgttgtggcgagtgcctgtaatcccagctattcgggaggctgaggaaggagaatagcttgaacctgggaggcagaggttgcagtgagccgagaccataccactgcactccagtctgggcaataagagcgaaactccatctcaacaaataaataaattaaataaaataaaataaactagggctgtaagctcctaagtggttttctgttccccttctatcttgcccatcctccaaggtgatttctgcctcagggcctttgcactggctacctctgtgtattagtctgttctcatgtggctaataaagacatacccgagactgggtaatttacaaaggaaagaggtttaattgactcacagttccacatggctggggaggcctcactgtcatggcagaaggtgaatgaggagcaaagtcatgtcttacatggtggcaggcaagagacagagcttgtgcaggggaactgccatttataaaaccatcagatctcatgagacttattcactaccaggagaacagtatgggggaagctgcccccatgattcagttatcttcacctggccccgcccttgacacatgggattcattacaattcaaggtgagatttgggtgggcgcacagccaaaccatatcactctgcctgggacttccccacctccccagtctgctgccaccgtgtcagtctcagtgaaaatgttgtcctctctgaaagccctttcttgatcactctgtcaaaagaacccatcttccaccttgactcttacattcttctgttttcttttccagacatcttgtgataggttatccctttacttgtttgtctctttcaggaaaagagaagctttgtgagaacaggcctttggcttgttcacttctgtgtttgtagtgcccaacaacccagtggttgctcagtcaatgtttattgaaatgaatgaatgaagtcaacagagatttgttgaggcttcctgtgaacagtcctatgcccagtgttagaggagtcccagaaaaatataaaaagccccagaggcggcagtgagaacacaggtgttcagccctgcgtgttaaactttagttagagagagaaagcgggaatgaaaccagcaccctcaagacgactctaaatggccggtagcaattggctgatacaaacaacctgcatgaacagaacttgagagccactccccgctggccatggcaggaggcttctggaagaaaggggaatagaaccggatgtggaaggagaggccttcaggatggggtaggggaggagagaaaggcaagacacagagagtggagggctgcagaggctggaagatagacccaggaccgtttccctccttggacatgttcaggacattactctggtcttcccctgagagagaacatgtttttctccaccctgcatcattggtgcctggtacagggccctgcacaaagtgcatggtcaaggaattaaagaattcaggttggatgaggtagttcacagcctccctggggagctggggctttatcctgtgggctgtgagggacactgaagttctgatagacacagtggctggagggttagcatggctgggcctgaaagctagggaagacttagaggagtcagttatcaccatcagccaggcctgagaagtgagaaggagatggatgaggcaggaagaatcactgaaaaggactctgacaaaaagaagcaacgtatttgggagccaactgaacatggatatgggcgggagttgcagatgtctgaaaggagccagtgggggatattaaggagagagtctggccagatgggaggcagcagggagtagtggggattgtggcaaagtggggtgccaagccccttccctaggacagagccatgactcagcaccatgtgagaatttaggccagagacgccagattttcaagttttacatgcaagatcacccatgttctcaatattggcaattactccatattacataaaataaataacaaacacttcacaggccaaagaagacacttccatgggccagatatagtcctggagctgccagtttgaaaccagagagtgtgtgtatgttagaggggtggagtcagggaagggagagaatgcccaaggtcactgagatttcaagcccaggccaccaggaaagtgatatgtccttgcactggaatagggaagtcgggaggaaccaggggccggggaggatgggcagggagtggaagatgctgcagcaatggggatggtcatttgacaaaagaggacacagactgagaacagctcatcccgagcaagcagctggatcccaaatgcagttggtcacagactgaaggggggggcctgtccctgtggttaattggtgatgggcgtgcagtgtctctctgggaccttgtctatgcttctcttaagcatttgattgttttagatttgggggatttttaaatttgattgattgattgattgattaagattgcatgatttgcacccttgtatgaagcaactgtaagaacaccggtgttaaacctcagagaatgggttgcagaatatttcccaggttatcagtggtcaccaaccccatccccatccctaaagaggaagcgagataagcccagcgctgtagcataacaaccgcgcatagcatgcctaacgtcacgcgaagtcttctaacccatacgcgctgatgaatcctggcaactccgttagggagacacgacttatcaaacccttttcatggcccagctgaaatgacacactgacgttcacccagccaggaaggaagtaacacagctgggagtcgaacctagaaccagaacctttgaccctggctcaataatgcctgccttgcacaggcatttagcacttagctgagttgacccatcaggccacatgaggtccttgtggctggagacctgtgtggccaggctggagtcttgctaggtgagcaggggtggaagagggattccctggggcagagccaggagacagtcctggtggaggagtagagcggtcccttcggttgcccatggtggctcttccaagccttaactcccttcctggtcctcccaccccacctgtctctatatccttgagctcagccgattcctcagagtcctcttgggtccacaccccaggatgaggactctgaggctttagtgagcatcaggatcacttggctaattaaaagcagatgccgggccttacctcgcattctgattctgtaagtccttcatctggcccaagaatctgcatgtttagcagaccgcaaggtagtgcttccggggtcttcagataacggccgggtctcaaactgctgctccctttgcttcctgacccccatctgctgctcacctaccatctccttttatatacctcatatactccagtatcgtgagttagtactggtggtgtgcccattttacagatgaggacattgaggctcagaaagttgaagcaacttgcctaaaaccatccagacagacctggatttttatctccactgactctaaccaccttgctttactgcctctgctagatctgcattggtcccctggaggtcccttagcggagagtttaggggaaggactgagaatggtgcgatttagcagtgtgttcaatgggcatgaaacctggttgatgccttggcagccggaactttccttgtgttatctccatgggcttttagccctcatatgaacggctgacatcattagtcagaacaaaccacccagaatcggttcaactttcaaagctaaatggaaatcaaaatgtggaatgactcagggactgctcgttaggaaaactgattcctctgtgactcagagcagatcttgtaacctccaggggcttggcatctggacatggggcttaaaagagaacagactggggaatcgcaccccaactgggcagctgtggcacctggacaggtgattaaaattagcacttctacctgtgacccagcaattgcacttctgggtatttatagagagaaaggcaaacagctgcctttttcacacaggctggtacacagaggttcagagcagcattatgcctgacattatgcatttcctctagtggaggaaacatcccagctgtccctcagcaggccaacagctaaacaaactgatacagtcacacagctgatggctactcagcaagttaaaggaaggaaaggaaacgggatacaggccacaccatgggtgagcaaaggaaggcaaacagaagagcactttctgggtgattccacttccctaaacttttggccggtgcaatagctcctgcctgtaatcccatcactttgagaggccgaggtgggaggatcacttgagcccaggagtgcaagaccagcctgggcaacatggcaaaaccctgtctctacaaaaaatataaaaattagcgggcgtggtggcgcatgcctgtaacctcagctacttgggaggctgaaacgggaaggatggcttgagcccaggagttgaagctgcagtgagccaagatcatgccattgtactccagcctgggtgacagagcacgaccttgtctcaaaaagcaacacaaacaaatgcaaaaccttctaatataagcaaaactaaccgctgttaaaataaggcagaaaggtagactgaaagaaggtatgcacatatgagggaactttctgggatcatggaaatgtcttctctctgggcaatggttacatggatatatacagttctcaaaagtgcatctaagtgtacactaagatctgtgcattttactatatataaactgcatcttaagtaaataaataagtaaagggcagatgcctccgccccagccctggcaactgagtcagcagacctagggtgtggcccacgagcatctccatgctcagcaagtgctgagtgttgatgcccagcctgcggtgggcaccaccagacactaattgctaaagtctcttctggctttagcaggatggctgagtctttgcagttgttgagcatttaccattagtctgtttttaagcataaacctaattgcggtcaaagtctggtcccagggctgtctcctgatcgtcagcaagaccagctctaagctatggacaaaggctcctcagtcaccaggcagatcctggccatgtgccgggcatcacagggcccgctgtgctgggaacagaggccagcactcacttgcagggctgcagacacacatcaggtattgggcgtcgggcagaaccagacaggcactctctgatcagtttctgcctccctggaagccctccagataatgattttggctgtgtgctgaggagcttttgtgttatagacactatgctgattgttttgggggcatgtttaattatatgagcggatgcattgtgtagttcttagaggctggagctaagagcccccacttctccatgattgcctatgtttctctgtataagtgacctaacctctctgaggctcagctcctcttctgtaaaacgaagacagtggccgtacttcttccctcacagagcctttagcacggggagcatttagcaaatgctggctattattatctaatttaatccttataataaccctataggcaaggtgctattcttatctgcagagcaaaaaccaaggctcagaaaggtcaagtccctcgcccaaggtcatatagctagaaaatggaggagctgggattgaaacttgggtctgctcaactcctgcctctgttcactgcaccatgctgtcatcagctttgtgggatggggatcaatgcagaagaccccctgcagactggacggagaatccatcgctggctgagtgagagcctgtccttccggaaggctgtgtgcactggttccaagagtgatttcacatccctcttctaccagctgtgggaccttggacaagttacttaatgcctcaagcctcagtttcttcatctttaaaatgggagtgctaataccagccttaacaagctacagtgaggatggaatgagtcaatagatgtaaggcatatagaacggcaccctgaacactgtaaaccttttgtacttgtctgctgatatttgctgtcatctgcgaggtcactcacctgtctaggtttgtaactgagctgggtggggctccaggttgcagtaggatgggaagttgtccttcatgcctttgaggaagtgacaggatagcctccaggtggcatgtggcaacaggtgtagcaaaaagcctttttgaactacatccagggactcttaagcgctcaaattaaaccgtcttttggattctctcatttttaaaaactcaaagcctcgttcccaggcttcggttcctaaccatctttctttactcccttgcaagagattcgggctgatggttaccgtcatgtctaagtaaacgatgagcttcccaccccacagccctggctctcaggtcatggcagcaggttctcgaccagacggggctcaaggtgaacaaacaacctttctgtttatttattttgtatgcttgctttagtgttttgcctgtgttgtgggaaccacagcatgggtttctcaagctgctctgttttctttgggttgaaaacaaaaataaaaggtgaaccatcaaaccgtgacgtctggctgcctgcatgaaactccacgagggctggtttataaatttaaaatgtgtgactgtccgggagtggtgtctcacgcctgttaatcccagcactttgggaggccaaagtgggtggattatctgaggccaggagttcaagaccagcctgacccatatggcaaaaccttgtctctactaaaaatacaaaaattagctgggcgtggtggtgtgcacctgtaatcccagctactcgggaggctgaggcaggagaatcgcttgaacccaggaggtggaggttgcagttagccgagattgcgccattgcactccaacctgggcaacaaaagcaaaactccatctcaaataaataaataaataaataaataaataaataaataaataaataactgcactaggctgaaagcagaatggcagtacataataagagcatcccttctggagtcaaatccctgctctcttcttggctgcatgaccttgagaatgtgtcactcttcctctgtgagcctcagtctcctcatctgtaaaatggacatagccatggcgcctgcccaatcggactgtcgtaagatcaagcaggcaagcttttggcacagcgtcagcaagcctcagcttatgtgatcatcagtataccaggaccactccgagttgagctgttcaagctctgggtctctcgccaactggcagtgtgaccttgagcaaataattcacctctctgagcttcaggttcttcatttgcaaaattgaggccccatgttctatctaaatggattgtcctgcatattaaattctggaaataagtaccttaggcagttgggagcaagaaagaggacaggcaagaagggccatagaaggaaagtactggatccccaaagctaaaagattatttacctggtggctgtgaggagggaaggccagcctgacagaggacacagaaatatccactgtttcttcttttggggggcacagaatctcactctgtcacccaggctggagtgcagtggcgtgatctcatcccactgcaacctctgcctcctgggctcaactgattctcctaccacagcctccatagtaactgggattgcaggcacctgccaccacacccagctaatttttgtgtttttagtagagatggagtttcaccatgttggccaggctggtctcaaactcctgacctcaagtgatcctcccgcctcaaccttccaaagtactaggataacagatgtgagccaccacgcccagccaatggcttctaaatttgagtagccccagcatcttccctgttggacttgttttatgtctgctggtagaatcaacactctttgggaacatatggatctatggactttgcttaaacagattctgaatccaagatgtcatttaccaaaaaagcacacaagggataaatatcccccaacagcagaattctttattttatagaagcattcactaggaaattcctttcaatgttatgcatccgtcatgtgcgtaatatgctacttgatttacaaataaggcagtatcgtgcagaggtaaaaggtacagtgatgggagcaagatcactccccacctagccccaggtaccccgattctgccgattaccagctgcaaaactttatgtccctttgcctccatttcctcatttgtaaaagggagattatcgtacatggtatctatctcgcctataggttgcatgaagaataaacaagataactatagattgcatgaagataattcttgtaaagaaaacttactaccacatagtaaaggcacaatatatgtagctagtattccttccaatactattttctgagtgccttctgtgtgtttggtgccatctgccctgtgtctgccttcatagagcttacaccagggatgtgggctatggacatagaaacaggcaaggcaacaaataacataaataaacaagatgattacatgttgtggtcatagctatgtccaaaaccagcaagatgctgagacagagaactgcatggacaactacttgcaaatgtccggtttggaaagcctcactgtggaggtcacatttaagtgacagatgagaagaagccagcgagaaggacagtggggccgcagccgctcatttcaaacatgaaggtgcacgtgcctcctgcaagatccaactcagcaggtccggggtggccctgagtgtctgcatttctttctttccttctttcctttccttcttctttccttccttccttccgcctttcttttttttgacggagtctcactttgtcaccaggctggagtgcagtggcacgatctcagttcactgcaactctgcctcccaggttcaagtgattctcctgcacagcctcccgagtcaggcgtgcgccaccacaccaggataatatttgtatttttagtagagacggggtttcaccatgttggccaggatgatcttgatctcttgacctcgtgatccgcccacctcggcctcccaaaattctgggattacaggtgtgaaccaccacgcctggccttgcctttctcaccagctctcagggctgttgacactgcaggaccacactgtgagtggccagggactagcagaggacagggggcagagggtggatccaggtccagacgacagagtaccttgaaggcaagtggggagtttggattttattctcaggatagtaggaagccaggcagaggagtgacatgactgaaggatgcttctagaagctcattttggctgctgcgtaaagacttgctagggccagggcagctgcagagagaccaggttggaaactgatatcgttgtccaggtgacagtggcttagacaaaggtggtagtgatggcagaagcaggaagtaggtggatttgaaacctttggacaggtaaaatcaaccacacttgctgaggtgttaaataaagccatccatcatcatataagatatgtgcttatcttaattttttaaaactcaatagtatagagtatagagctctcaagcaggggtgatcttgccctcgcgtgggacatttggcaatgtctagagacatttttggttgcccccagctggggagatgctattggtatctagtaggtagagaccagagatgctgttatacaaccgacattgcacagcacagcactcccaacaaagaattatctgccagtatgtcagtggagccaggggaaagaaaccttgcatagaagtacaggaaggcagaaatgtcctgcctgccccacccccatctgacccccacaccccaaagataactactgttcccagtgtgcttgatggtccagactttgttctgtgcgtatacgcagatttcccataagccacctcaccggtgaagtaatgcttgggaaatgctcaaaacttaggagccctgagcccaccataggaaaagactgttcattttgtcaaatctgttctattcctaccccatggggaaggttactgccacattgcccaaaactgtattcattctatcagttgtgatattttttctttttctccaaagaactttccaaaaattgctatccttgtgacctaggcagccttctctaactgggactaactcatgaaacctgagaatttcagtgcaggaagaaatgttgggataatatagtcctacccaagttcttactgtacaggtgggaaaactgaggcccaatacttcttggaagtggggaaatccccttataataagtagtctcttcttcatttactgggatattaatttcagattttcagtttaatacacggttatggcttatgtttctgatttatttttcttggtcgtgtctatatgtgaggttggttacaatgggtgacgaaagggacattcttagccttgtacttccagagtgctgtgacaggtgatctccaaaagatgggaggaattttaccagtctgtgaacttgaattctgtagtctgggaagaccagttgaatctcttttcactggctgaactgagtgtcatcttcctatgcccatctgtgggtaccacagctgtgcagaggtcagttttgagttcaggctcatacgtggaatgctgtagcctgtggccatcctcctattatccatgctgtcatccttttaaacgtccacagagacctccaagtggaaagaaccatgtctaccccattagaaccccaagcaaggactctgcaggtcagagaggctgactccatggcagcaatgagggctccaacagctggaatccagtcctgtcctccagctacctgtgtcctgagcccaagggagggaccctgccccctcctcccactcagccagtagagagaggcgggagcctcttgagaggcttaggaaggcaccctgggaagcctccctacttgttttcccaaacccctcaggttgggggtaaatggcgtgaaggagtctggtctttgattctttggcactggggagccactgaaagttcttgagcaggaagtaactggatagaaaatggctattccaggaggatcaaaatggcagcagtgtgctgggtgaattggatggacaggaaagacggggaaggaagcctggtgggtacagtgaggaataacagtctaccccagaatggcagcagtgaaaacagaaaagggggaagagatgggcatttgtgactaatggatgtttgtgacttgcccctgaatgagggagagcggggggtcatggatgaccttggttttgaccctagatgaggaaaatagtgactctgccgataggggaaatgggcaaagtttacttagcctctcccagcttcacttaagacatctgtagaatggggttgtgtattgagtggtggggaagattaaatgaaattgtgcatggaaattaacccaggcctgaggggagtggcaggcactaggaccacgaagagccttatgagcagggctttatcctgctaggccatagggagccatgaagggatgttgcctgagggtgggatggtcacatttgccttttggaaggacctctctgagagcagtggagagagggcaggccagggggcagggagaccacaggggaggcctttgcagtctgtatccaggtgaggtgtggggttggtccagaccaagcagaaagtagggggcagtcctgaagcaggccggctgccttgtgtgcctcctcccctttgtgcttggggaaaccactgggaggaatgcgaggtggccagcatgtgtcccggcaaccccactgtcggggggtatgtgtgactgatgggccatctctacacaaaacctgcactgggccgggccctccagcagctgcaggacatcagaggctgagctgtttgaccagagaggccacagctatccagtgggagtgtgcggccccaggcagagtcaccctccttccaacacagcacccccatcccccaacccccatccacccctccccgagtcagatccccatcccccactgactccttggggactggatcttaattcgccctgttgccaccactctgccctcatctcttcctcccctgcgcttccacaggtcccctgcacttctgctcgcttttccctcatctgtgctgtccatgcctctctgttccttcctgcccctggcccctagcatgtggtctcactgcggcttcttctctctttgcccatcttgggcatgcaggaggctgagggcagagggtggtgatgcctgtaggtcctagtaccatgcccggcccatgggggcagatggagccccaggggctgtctgcctgctctgtcaatccatctctgcttcctttcttttctcctgtatctgtttgctggatgtagatcataaccttgacaataacgttttcaagggcaggcctggttcttccaccctctatttcctgctaacagcccagaggcattcccaccacggtgatttatgaccctctctatggggtggcgtcttctagggcagtggcctaggagacattttccaacttgcagccccgggactctgtccttcttccctcactgctggggccacagccctctctcagtgagtgaccttagcagccatcctcaaaacaccccggccaaggaaagagctctgataaaaccctcagagcctgactctcagcccccattcctgagcccccactttgcagctgccagcgacctgactgtgcaagctgagaggatgcatgggcacaggtggcattagctgctcgcgctgttggcaccaagctggcctcagaaaagggggggtaggttttgttttactgttttggtcacttatttcatttaaaaaaatttattagatgagagtgtttttggctcatacaacggaaacattgctaggtccagctggatttctgggtccagtggtaccctctggagtttctctgaatctccacctcggctcgcgttagctccctgctggtcccctcctcaggcagcctctccccttgtgatgacaagacggccaccagcagctgcaggctgcatcctgtccttcctgcaaacccagagggacagggaagtctcagtgtttcccccaaagcaaagaactgagcctcactggtgctgactgggccacagccccaccccctgggacacagaagaactgattggctaggcctgaccatgcccagccttagaacctgcaaggaagaggccctgcctggtaggcaagcacatgacatggccaccacatcacctgagtgctcagcaaggtaacccagggcagcccagctcacccagcccagcatggccataccccagggcccccaaagacccttgttgggaatcacttgtgcaacaggcttggatagctttacactccagaaagacagtagcattctacttgaagggtctctgcagtgacttcttttctgataacaagaagcattcctcagtttacctgtttgggacattcctatttggtgttaggcttttgtaaagagagggcgtacctgtgggggacctggcactgggtcatttccccaagatgccattgccgtgtcccccagcacctgggtgactgctacatcactgcctgtgacctcaactctcttccttcctcttacagcagggatgagatcacagccaggaagtgttgggatgattccattacaaagatgatgtttgttgaatggatgtctggagagagacagcagccagaggtcagcagctttgctcctgcctctccagggtccacccttactgggcagtaccatccaaccatccatgcccagctcatagagggcactcaggaaatagcagctgatatttggtcattatatatttttttggagacagaatctcgctgtgttgcccaggcgggaatacagtggtgtggtctaggctcactgcaacctccacctcccaggttaagggattctcccacctcagcctcccgagcaactgggattacacgcacccttcaccacacccagctaatttttccttttttttttttttttttttttagtagagacagggtttcaccatgttagccaggctagtctcaaactcctgacctcaggtgatccacctgcctcggcctcccaaagtgctgggattacaggcgtgagctacctcgcccagccattgtcattactattgttattgtgctggttgttcagcctggaagtttctccaggctcaggaagcagtcttgacccttgctggccttcacctctctggctgcctccattccatgcctaaacatttggagttacaattccttagctcatcttttggatctaaacaccccagagggtagagatgatgctggcatagctcctggcctgagggaacactcactgatctaccagaggctgggacacccaccgtggggcttgcaggaggatgatctggttttgaatctgcacagtgctggttatgagcctgtgatctccactcccttccctcctcttacagcagggacaagacagcagccagggagtgttgggatgattccatttacaaagatgacatgcaaaatgtccagctcagtggctggtaccggggcagggctctaggcctgtgggttgtgattcatctgtgaagcccagagagggcaaagttcctggacataaggcctcaggcagccccgtgagccctggatagcaggggctaacccaaggtggcagagaggccctttcggcattcagccttgacccctgtcttccaaggcaggttgcttaagacattggtatttgtctttgctactgacggcctgggacaacccctcatccccttccctctctctgtcattagcaaacctctgcttctgaccttagataaaggagtgctttgttcatggaactggtgtgtagattaaaaactccttcttttagagcagggcttgggggcaggtgagagacgggattttagaggggttcagaggatggactctggactcactatctgtctcacagccgtgctctgctacttattaacatgaggctttgggcaggttaaggaacctctctgggctcgagtgtttgtgactctagcatgggattggcagtggtggctgcttcgtgatgacatgaggtcatctgggctcagaggaagcattcagtgcatgtgaactcttctaagcacaatgtgaagatgcatcttttaaaaatgaaacgccctctgataaaatgtgtactcctcccaatttggaacctgacacacattgtctagatccacctgaagctgcaagagccctgctgccagataccagggcaggaaatcttatcctgggggacactccaggaaaagccagtgaattccctttaaattatacaggattgtgcctgtggcccttgtggtaggctaaataatgctcccctaccctacccccaaaagatctacatcctaatcttagaatctgtgactatttacgttacatggtaaaagggcctttgcaggtgtgattaagttagggctcttgagacaggaacatgatcccaggttatccaagtgagcatgatgtagtcccaagagtttttttgttttgtttttggtttttggttttttgttttgtttttgtttttgttttttgagacagagtctcactctgtcgcccaagctggagtgcagtggccctatttcggttcactgcgacctccacctcccgggttcaagcaattctcctgcctcagcctccccagaagatggaattataggcacgtgccaccacacccggctaattttttgtatttttagtagagatggggtttcaccgtgctagccaggatggtcttgatctcctgacctggtgatctgccagccttggcctcccaaagtgctgggattacaggcgtgagccactgctcccggccccacaagagttcttataaggaggaggcaggcaggccggagtcagagaaggaggtgtggtgaccaaagcagaagctggatgcatatgctttgaaggtggaagaaggttccagcagccaacaagggcaggtggcctctagaagctggaagaggcaaggaaatggatttcttccctgaagcctccagaaggaacacagccgttggtcaccttgattgtagacctctgacctccagaacgacaagagaatacctttgtgttgcttgaagccacaagttggtggcagtttgctatatcagaagtggctggagaagcaacatgaaattaacacagcccttcttggggcggtgggtagccgtttatcaggttttcacccacgtcgagtcagctgaggaacagtcactggtccaagtcgcctcacctggcccccagaggcccctgctgggaagggcagccaccactgccattcccatgctagaggcacagacactcaggcccagagagtttccttcatctgcccaaagcctcactttaataagtagcagagcacggctgtgagatgactgctattttctcttcctcctcctcagcctccgtgttcctagatcactcatcccaaatgcaaatatatttttcagtagtaattgcttctctggggagaaatttttttttttgaagtttgcaaatctttttatttccagctgttgagacaatatttttgagagctgatgttactctagtggccaaaccagtgccagctattaaacagccagaaagctacagtaattgacttacgtgaccatttctcttttagcacgttgtttgttctccttttccagaagttgtaggcgtctatttagtttgattatgtgtcgtcttagtgaagctgcgtctacaacagtcaggtcatccgatgttccttcagttgttgcgtctgtatttgaaatgccatacgtgatgttgtcatgatgaggattagaagtggccggagcagacctgccacgcgacacagggagagaatcatttctgaccagctgtccgttttgatgaacagcattttcattcatagaccgtgccctctttagtctgccggctgcaaagatttcttcattttcaggggttgtaagagatctttctaaatccagaaaatctggtggtctttcacttagtttttagcaccaggggtttgaagggagttgattgaataaggtcaggatctactggtcttgaaagtggaatatcttcattatttcttacaacaccaaccctctccagaacctgcacactagtatcaggaactccttcttggaatccttgctccaggtcagcgtttggcagtgctactttttttctttctttctttctttcttttcttttcctttttttttatgacagaatcttgctctgctgcccaggctggagtgcagtggcatgatctcctggctcactgcaacctccgcctcccgggttcaagcaattatctgcctcagcctcccgagtagctggaattacaggtgcgcaccagcacacccggctactttttgtatttttagtagagacaggtttcaccatcgtggtcaggctggtcttgaactcctgacctcgtgatccacccacctcggcctcccaaagtgctgggattacaggcgtgagccactgcgcctggccggtggtgctacttttaacttttctgggatcctcacttactgactaatgcctgcagtctattccatttcttactgaattcaacggatttctgccatctctgcagcagtgggagaaggaaatgctgccccactcacaaatgtgtacttgctatttggcacggtttgcttctatgcttcatagtaaatcctttgacttgcttcaatgtgcatgtgctggattgagagccacttttgtccccctgggcccacaggagggtcccagtgagggctgccacccgccagttcccgggggcattggggcgggtgcttagaggctgttggctgagagcacggaggcgcccaggcacagcaccggcgtagcagcccgcagagggcccctctggggaggaatctgagaagcccacagaacagcctgcgctgtcatctgggggtttctgaattagagccattccaggtgacccatggaggtacctctcctagtccccagttgcaccagctgccggccctaggcctccctctccaggctgccactgcctgtctttgtggggaaactggctgtagttcctgcagtgggatggatatgggcccttctgtcttgggataaacctctgagcagctgcttgagatcacaggctggcacctaacgtggagttatcattcacacacccagaaaggcaacagccctgtggcactgttctctggcctccccaggtttcccacagcaaatgacaacagcagcttgcagtgtgcctgtcctgtgccggacctggactctcagaagtggctggggaagtagacagcattttctttttcttttctttctttcttttttttttttttttttttgagacagggtctcactctgtcgcccaagctggagtgcagtggcacggtctcggctcactgcaacctccatctcctgggttcaagtgattcaggattacaggtgcgtgccaccacgcccagctaatttttgtatttttatttagtagagacagggtttcaccatgttggccaggctggtctcgaactcctgacctcaggtgatccaactgccttggcctcccagagtgctgggattacaggcgtgagccactgcgcctggccagcattttctttttaacaggtgaggaggtgaagggcattgccaggggtgtacagaattaaacctacatcccacagactccaaaatccatctatattccactctactgctaagccaactactgattcactcaacagattccactataccactatgctgtgctattccttcattcaacaaacatctattaagctcctctggcctgtgccaggcttgttcttggactagagagggcagtgaacaaaaatgacaaaaattcacacccttgaaagtttacctcctgcagccacactttccaacagaaatagaattcaaggcccatatataattttaaatttcctggtaaccacaccttttttaaaaaggacaaagaaacaggcaaaattaattttaataatatatttagctcgacatgttcaaaatatgtcaacatgaaattaatataaaaatgttagtgaggtattctttttgtcctcctaagcctcagaaacttgatgaaagctagttccctctggccacctgacagcaagctgggtgtgattgtcattgggtcacctggagctcagccccgcattgtccatcagtccattcctgccacgtgccccttgggactgcactggccatagcagtgggctccgtggctccctgttgctgtggaattggggagccaccatttctctggatttagagaggtgctgggcctcagctcagagggctaggttaatgcacctctcagtttgtaacatgtcattgttactgggccctacacagccgcttcctatcttttcgttgttattcttttattcctcttttctcccctctcctattccatccagggcacccatcctaacatgtttaacatgcctcttgttggctgtggtcttgtacattgtgtctttctcatttccgtggatgatattgcgttctgtctcattctgattggttatcccctaccttacgtttttcagccagcaattttattttcctggccataaattcaagagcgcacctgcagcaacactatccaatggaaagagaattcaagccccatatataattttactttttttttttttttttttttttgagacagggtcttgctgtgtgtcacccaggctggagtgcaatggcgcgatctcatctcactgcaacctccactgcccaggctcaagtgatcctcccacttcagcctcccaagtagctgggactacaggcactcaccaccatgccccgttagtttttttgtgtgtgtattttttgtagagatggggtttcgtcatgttgcccaggctggtctcgatttcctgagctcaagcaatctgcctacctcggcctcccaaagtgctgggattacaagcgtgggccactgcaccggcctgccccatatataatcttaaatttcctggcaaccacatctttttataaaaggacaaagaaacaggaaaattaattttaataatagattttacttgatatatccaaaatctgtcatctcaacacgtaattaatataaaaatgttagtgagattttctttttgtcctgataagccttggcaatctagtgtgtgttttacacttgaatagcacatcccaatgcagactggccacatcttgagtcccatagagtttattgggactctcttgtccccatagtttgttcccatgagtcccccaccctcgttcatcttctctaggctacctcaaaggaaccggtttgccctcattctctaggatgttctagctccttctctgagtctcttgactcatcgattcttccttgagttctgagattactaccagctagggcttgctatatgacatgtcactttgtcctcacatcacccccattctgagactgagggaagagctggcccagggttgcacacctagtgggtactgagcctgattccagactccagcagcctgagcacagagcccagctcctaacgagcatctcctgcccaaccgactgccctcggccttgacccagcaggattcccaggagacgtggcttgtgggaaagaagcccaagcagtcctggctgaacttctttttctgagatgtgttgagagtatcaattatgtgtgggtcctcagagacctgcaactccgtggcttactcaaggcaaaaagttccctccccatcacttaaaagatggaggcagtcctcagccctgagtttttattcctgcgactttgctgtgtgtgcatctcactcactgcatctgacaattgcatggcactgcatggtgtgcgcctagctcatccacccatccatcccccacccagagacacccagactgctgcagtggacagcctcacccacgggccctgtgtgggatgtgaactcagctggagacctgccgtgctgtgccagagtgagcttggaccactttacaacagccaattatgcacatctcctccctactccgagttcagtgacatcgtgtcagtagctcgatagtgctgtgatgggaatatttacaccacagcgatgggccgtggcaatcactacaaatctgggctgtgtgtgtgtgtgcatgtgtgtgtgtgtgtgcgtgtgcatgcacacatgtgaaagagagagggggagggagagagagctagtttaccagcataccactgtgagggagtatgtggagactttgttttctagagacatggtgcaccagcacacacagcaagagacagggtctttctatgtttcctgggctggtctcaaactcctggcctcaaacaatcctcccacttgagcctcgcaaagcactggcattacaggcatgaactattgtacccagccctttaattttattgaattaagtgcttccagactggtaccagaatgaccatccaattttacatgtcatttcaaaaaaattgttttcccagtttccaatttaaaaagacttatgaacaagtatgtgcattaaacaacagtgacaacataatttcaagtcacctattaattcagctagttggccctgggatgtagtgcagaattctaaagataagtgttgactagaattcagtttctagttttggcattctaggactctttcaaatgcaggagacagaaaactcagtgtaatgaatgagctcttatcactcagccctccagggttcttcagacacagcgggatccaggtttgcaaacagtgccatgaggactcactccctgccgtttggttctgctttttgctgtgttcattcattcccaggcaggctttctctgcccaatgctctgagctgcctatgcaatggaggagtgtctctttctcagcaattccagggaaagttaaaatttgaaactcattggcccagtgtgggttacgtgtccgtcttgaaattatcactgtgccccagagtgtgggaggccctgattggccaggcctgggcatgtgcctgccccttgagccagaatcaaagtcatatggactgagaatggggagggccctagagaaggaaaaccaggcactgttcccagcaggttaggagtgcctgctgggcaggtaaaacaacagcatcctctcaacttctctggggcgcttgagactgaccggtgcccctccctgttggacacctcctcctgtgacctttggaccctgcgttttcagggcttcccggcctctctgactgaagaggccttctctgcatctttacccaggccatcttcttaccctgcttctggctgaggctctctccaaaagccccgtactgaggctctctccaaaagccccgtactgaatcactcacctcattcctgctaagtgtgtgttgtgaccagtgctccgattatgggcacaggctctgtgtactctcttgtcgggatggtatcattgttgccattttacagatgaggaaaccgaggctctcagtggtggaaggagcagctagtgaagcagatgcacaccagggtcctttccttcagctgccgtagccctccacttccctgatctcgctgtgtctgtcaccagggccctccagctctgaaactatgtccctttccttgtggtatctgcacccagccagccaccacctttcctcccacaaccgtgaacctctcagcctgtgtggacaggcgtagctttggctatacatgacaaaaaaaaaaaaaaaaaagcagattcaataagataaacctttatttttctcttatgtaaacagagtccagaggtcagcagtccagggctgaaaaggcagcaccgtgatcctcagggacctaggctccttctatcttgctgctctgccagtctctacctcacatcctagtatggctgcttgagctccaaccatcacatctgcactagaaccaataggaagtgggaagcagggggagacatgtctcctcatttaacatgtttcccttcctgaatgtgccccaccccctatacacaccctgcttatatcccattggccagaacttagtcacatgcaaccgctagtgagctgcctaagaggctgggtactgctatctttattctaggaagccacggaaagccgagcatcagcttactatggaggaaggggaacacggatattgggaaccacaaataggcaaaattagtattactattattttttgaaacagagtctcactgtgttgcccaggctggagtgcagtagcgtgatctcagctcactacaacctctgcctcccgggttcaagtgattctcggtgcctcagcctcccgagtagctgggactacaggtgtccgccaccacgcctggctaatttttgtatttttagtagagacggggtttcaccatgttgaccaggctggtcttgaactcctgacctcaagtgatctgcctgcctcggcctcccaaagtgctgggatcacaggcgtgagccaccccacctggccaactggcaaaactcagccaccctgccgaccaaatgaaaacatcagaccagtgaattggcacgctctcttttctttccctccagcacagggagaaggaggaaagagcagcaggctcactgtgcttggaggtgagctgtgccgggcaggtgacatctcaccttggccagatctctctggtgcattcctcaggaggtcaaccccgtttccggcccttagctgggacctgcttggtgtttacagattgacgtggcagaggggaaaaacacccaagatgtgcccactgagccctgtgaaatcgttttccagcatggaagtttcaccagggcttctctatagacagtgaggccacttctgaatgccataatgccatgctggctgtgaagaaagtcgattgtgtctttttttagttcacggagactttttttttttttggagacgaagtttcactcttgttgcccaggctggagtgcaacggcgcaatctcagctcactgcaacctccgcctcctgggttcaagcaattctcctgcctcagcctcccgagtagctgggattacaggcgcacgccaccatgcctggctgattttttatattttaagtagagatggggtcccaccatgttggccaggctggtctcaaactcctgacttttagctgatccaccctccttgccctcccaaagtgctgggattacaggcatgagccaccacacccggtcagttcacagagattttaaaacccaggggggcaggtggttgtgagggtgggctagccacgggttgggggaatcataatgccagctttccctgcagcatcatgtcttggcagcaccaaacacagaagaggaaactgagattctgagaggcgtaaggagcagctactgaagcagatgcatgccagggtccttgccttcagctgccatagtctcccatctccccagtctccatgtttctctgtcaccagggccctccagctctgaaatgatatactttccctgtggtacctgcacacagccagccaaacactctgttggataaccctccacgtggataacacgctcacccctcaaccctatgagaccaatattgtatcctagctgctgctgggcagaggtgggatttagttccctcctgtgagctgttgtgccctgacttctctgcgaagtggggaccgtagcacttccttcccggggctgctgggagatgatgtgtgaaacatattagcaataccgtggaggttgtgagcactcggcccagggtagatcttttttattacccagtgggaaagagggcctaagcgaagcaaatgtgggctggattgcgtcccccgccaaattcctttgttgaagccccctgtccccagtactcagaatgggattgcatttggagataaggcctttacataggggatcaaggtgaagtaaagtcatatgagtgggccctaatccaatatcactggtgtccttgtgagaagaggatctcctgagcccaggatttcaagaccagcctgggccatactgggagactccatctttacaaaaaaatgccaggcttggtggcatgcacctatagtccccagctactcagaaggctaaggcagaaggattgcctgagcctgggatatcgagactgcagtgaactgtgatcatgccactgtactccagcctgggcaacagagcgagactctgtctcaaaaaaaaaaaaaaaaaaaaaaaaagagagagattaggacagagacacacacggagggacaaccgcgtgaggacagagggaacaggtggccatctacaggccacagagagaggcctcagaaggaaccaaccttgctcagaaggaaccaaccttgatcttggacttccagcctatagaattgtgaaaaaatagatttctgttgtttcaggcaccctgactgtggtactggttatatcagccccagcaaactaatacaagctcttaatctctcttcccctccccttccctgcaagctgtccccttttaaccttaattccagttttatgattaaacatctcagcgtcaattatttacaacacatccagatgagtatcagagctgcaggggactgaatgactcacactggggaagctggttttcatgaagggaaaaacgacactaagaaaaacagggaattgtatctcctgaccacagagactgaaactgacctagggaaagtttctgtcagccgcagcacagggaggatctcttcgtgggagtggggggcccgggaggcaccaggcagtggagtgtgccacaggtgcctcacacctgtatatggcacctgccagcacgcaggctgtttacttacccaatagttggtttgactgggcacaattccttcatccagataaaactaatcactcggagtgagtcgtgtctagtttgaatctttgctgcaccattcactgtgtgactttgagcaagtttcttaacttccctaactacaggctcctcttctgtgaaatggggcttattctagaaactttttcatcagcttgggaagtttaagcatggtaataaataactgagaaattagactgtgattatattaagtaaataatattcgtaataggtcgttaagaaaaataaatatattaaaattttataaataaaaacaaaacagaatacataaaattaataaagaaaagtaaatatataatgagtattaaaattgtataaataaaatttaaaaatggaatacataaaattaatagtaataataagtaataaataataataaaggcatgtaaggcacccagcactggcatttcataggagcttaggagaatgttcactgtagttgccacaattccgaaatgtaacagttggaaaaagaatcaagtgtgacaagtgacttcctaaaaatcgaagacaggaaggaaacccaggactcgagaaagcagctctggctaagatgcttcgagtaggaaagtcaggtataaagtggagatgagggaacggggaatggcgaggggagggggacaagctcggctcaataccaaaagagctcttggcagcaggtttgggaaccacttctacagagacagcattgcggtggctaaaaaagaaaatgtccagatatgggcaggacaaactttctcaaacggcgtcctaatctccagaatcagagctggtctaagaaaagtctgggaacacagagggcttgcttctgcaggactcgtgggcctgcagagggctggctgtctgcttcacgtacctcgacttttggcttaaaagccctcatataatgagtacttaaagtaaacgtcagtcttgtcctgtcgtcagcactttggaactgcagttttgagcccccaggaagtggggtgcctgctgactcaagcacgagaatacctttatcaagtttgttggtcccagcaatgttagaacaagtgtaaacttggctcgttagcagaatcctgggttaaaatgtaaacttggtagaggagcaccgccatgccaagcctccctccaacctggccacacgaggaaagggcgcataattcaccaagcgattggttttatcaggattgagaaactgtgcctaatcaaatcagctattgagtaggtaaacagtctgtgctggcaggcaccatacacaggtgtgaacgggaatgccacctgcaggagttgcctgggtctgccataacaaattaccccaaacttcatggctgaaaacaacacacatttattgtcttgcaataaatgtgttctggaggccagaagtccagcctcagtttcatgggttaacatcacaatgtgggcagggctggttcctccagaggctctaggagagcatgcgtcttcttgccttttccagctcctggaggcacctgcatccctggacttgtgactctctcctcacatcctcctgcttccatgattccatctcctgcttcctcctttgacctttctgcttccctcttataaggctactactcatcaaattgggcccacctggatgatccaacgtaatctccccatctcaagattcttaacttaatcatgtccaaaaaggcactttttccatataggctagaagttacaaattttgattaggacccggatatctttgaagaccacgattcagcctcccatgtgcctgttcccaaattccaagaaacacagggtggtgagcagcaaagaaccctgtgcaggaccccgcttcttctctgcccctaacttgaatggccttcagttagtctctgaccccttctgggcctctgtaaagattaatggacgcccacctgcctccataggcctttaaaggatttctggcacaattagagcagctactgtctgcagggcattgggtcaaggccctcaatgtattcactcatggattcttcagctttatggtccctgaaaagtgctgggcaggctcctgacttagagccttggctctgtggttccctcctctgcctggaatgttcttccccaggtattcatgtgattcctccctcgcatccttcaaatctctgctcagatatcattttcttggtgactgtgtacctggccaccgttttttgttttttgtttttgagacagagtctcgctctgtcacccaggctggagtgcagtggcgtgatctcggctcacttgcaacctccgcctccctggttcaagccattctcctgcctcagcctcccgagtagctgggattacaggcgtgcgccacccctcccggctaatttttgtattttttttttttcagtagagacagagtttcaccatgttggtcaggctggtctcgaactcctgacctcatgatccacccgcatcggcttcccaaggtgttgggattatagacatgagccaccacacctggcctgtttttaaaatcactacccacagctctgttattttcttttagcttgtattacctgctaccataccacagactctaatgtgagctctatggggacaaggccttctgtctgttttgattgtttctatgtcctcagtgcttagatcaggacttggtccatagtaggtgctcagttaatattgtgttaggtaaatgaataaacacctgtaatcaaaactctgagctcgtcacttataaacccagtgaggtagatcccagtaaaatttactttgtacagatgacagagctgagactgagagccctaagaattgtcttgtctaggtaattactaagttacagagctgagatacaaacccggcctctgatctggagcccaggctcccagtcccacggcataacaggtggagtggatactcaccagcaccctctgcagtccctgatttgataaattctcatctgtgacttctctccttttttctgcaaaatgccccttggggaagacaaactaaatgagtccagtcagtgtccagaactgcctgtcacacaaggacaaatgctgagtccagatggcaccgaggttcacacaagcctggctggccaccaggaacactgaccacaggcagcaacgtgggacaggctccagcttctcttccaggcccccagtcctcccactcttcagattccagggctgagcctccaaagttgtccacctaggctgggtgaggtggctcacgcctgtaatcccagcactttgggaggccgaggcggacggatcacctgaggtcaggagtttaagactagcctggccagcgtggtgaaacctcgtctctactaaaaatacaaaaattagccgggtgtggtggcgcacgcctgtaatcccagctagttgggaggctgagtcaaggagaatcacttgaacctggaaggcagaggttgcagtgagccaagatcgcgccactgcactccagcctgggtgagagagcgagacctcattgatgggaactctgccctgccttggtggaaaggctggcttttctgctgctccgtgaatgaggacggcctaaacaaggggctttgtggacaggcgctgccacttactaaactgagactttgggcaagtttctccacctctgtgcctcagcgtattccttgataaaatggacagaggtggggatgacagtacctcccttatatgactgttgggtgggataaatgagctaaattgtgtaaagtgcctggggtgtcagtgccctaactatgtgctgggggttgggggactagagtactgggggtctggctgatggtcagagcctgtgcttagccttgtttgccagggtcggggggctgctgctgttgtccccagagacaccgatggccagaacctggagaaggttcgaggtgtcagactcacattgggctgacggggacaggagatctgcatccctcagtgctatcctggcagaggaagtctctgaaatgtgagatgtcacatttcccaagaaatactgaatgtgactgggtcccccgtgccagccttctaaataaggctggacaccagccacctgcttagagaaagacactatgtcaagtgcctcaagaaaagatgtatggttcatgaactcgctgcttctgcttctggtcccttgagtcttcaagatgaacttgtcttccttaatttctccaacacttacgtggattagcaaggaccctggtgatgtcaggttttatacaatgcaccgacagcttgtgtttggagtcggggagggaagctgcctcttttctctgcaagccatgacatattctggaagatgcccactttcccatcgctgtgggattactgaggctgagccctcaccctggaatatcctgatctcttacccccaaattccacccacaggaaggccacagaggcctcaaggccctgcagagctgcatgcgtatcttccttctccctgccctcctcaaattgaatccgtcattctttttggaagctcttcagacacgctccattttggcagtgctacttggtgtttaaaagtgtgggttttaggatcaggcgtaccctacccctgcctcgtactcactgtgtgaccttagaaaaattactttccgtcttggaacctgtgtccttatctataaaatagaaccaataactattaaatgatgatgcacataaagagctccacagagggcctggcacagaattggcattcaacacacattgatgctttctctgacgctgacttcccttctgttaggcagaatcgcctgtcttcctgctggattgtaaaagtctgtctcatgtatctcggtatcccccaaagctcctggcatacagtaggggaaccgggaattgtttaaatcaaaatcttcaacaagtcattttaaaagaaatgttcaggtccagtagctcatgcctggtaatcccagcactttgggaggctgaggcaggcagattgcttgagcccaggaaatcgagaccagcctgggcaacagagcgagaccctttctctacaaaagacgcaaaaaatagctggacatggtggtgtgtgcctgtagtcccagctcctcgggggccgaggtgggaggattgcttaagcctgggaggtcaagggtacagtaagccatgatcatgccactgcagcctggatgacagagtgagaccctgtcaaaaaaaaaaaaaaaaaagagagagagaagaaagggaagaggaggggaggggagggaagggaacatttacctgtcaccccctcacacttttgtcctgaaacacctctgggaagaaggaaggagggaaggaaggagggagggtagggagggaaacatttacctgtcaccctcacacttttgtcctgaaacacctctgggaacctcggtgccttgcccagaaagtggcccccagggactcagctttgtgggaacccgcatagtgcaggcacaggtggacttcacagtcagctggatttgattatgagtcgactgtgccacttaccggctgtgtggcccagggcaaattacttaccctgtccaagactccaagatggtggggcagatcattccttgaagggtggccgtgaggatcgggtgagtttaggaatgcacctgattcatgctgagtatcagctgctgctgatttcatgatagctgctgcggagactgctattcttgttaccattattcttcttaccctgccttgtgtattacttaacatcctttcttctttttcccatcagctctctccagctgggcagccctcctcccagctcccctgcctctatgcctcatttgcacattgctttttgtttttccctagtgcacagtctaaaagatccctggtgctctgttgaaacaggaacctgacaccctttgaccttggtccgtggggaggtagcctgaaactccctcccaggcaggacaggagcaggggctcagcaccttttttcctacccccactgcatgggactggaaattgtgacaaaagtgattgtgggctgaaacttggcagagagagccccactgaattcctcctttgtgatgtgaatgtggcacagcccggtggaaccggggatccctttcccaattatgcagcttggcaggaagaggtcggtgcagggagaatgctcaaggagcccctctgtcatgggggttggtagcaccgccagccgcctccgactggcaagacctcctcccactaaagccagctgggctgggcgcttctgcaactgcaccttccggggccacagcacagaactcagtggtcacgtgagggtctacatccgattcccagtttctaaactgtgtcctggagagtttctgcaattcagcgagaagaggcagcggaaggcccagccatcaatgcttgggccctttaccccgtttcagccggggcagcgctgctttccatcgtcccatcttatttcagtcgttgtcttcacgttcaagttcatggagactcaatccagatgtgcctggctgtgatggccccactcaggtctcagccactctgatgtctggagctgggtctacctccctggccccgactcctccacacccactgcacagcccctccctgccggctctggttggccaggggtgtgcacacgagtggaaagagcctctgcccagcgtggagcggtgaggctaaaggcttccatgttccctgctgacttccacctgcaaaggccaggcaaccgctgaaacctccagccccaccagggaatactgatacagtcactttctcaggtcacaacggaaatcacatttattctgcatattttcctcatgttgccggcaaattatttgcatacggatacaagatttgggtatctggatcttcctgcaagttagcttttattaatcctctccccttcaggcttggactgggaatttcccctcattgatatgagacattggttcaacttttaaacttgccaggtattcatttgtttgttctataaatatctactaagtacctgttaagttcctggcatgcggtgctggggcctggagcaggcagtggacaagacagacaagaaccgtgtttcagagagttcatactccagtgagggagacagggagccaacaagaaagcaaaatgagattactactgactgcaaagtgttatcatcacccatgggaaggaaaggcaaggaactcagcaggggacccaagtgtagctgtgtgagagaggaggcatttccactggatggtcagagaggtgctcactgaggaggtggcatttaagctgagagacagaggtctctactaaaaagtagtaagatagccaggcatggtggctcatgcctgcaatcccagcactttggtaaggccgaagcaggaggatcgcttgaggccaggagttcaagaccagcctgggcaacacagcaagattccatctctacaaaaagattaaaaattaaaacattagctgggtgtgatggtgtgcacctgtaatcccaggtacttgggaggctgaggcgggaggatcacttgagcccaggagttcgaggctgcagtgagctatgggtgacaaagaaatatgctgtctctaaaataattttttaaaaaattttaaatacagaaataaataaataagtagccagacaaaagagacaggtggaagggtgttttcaagcagtaggtatagcaagttccaaggccctgtggtaggaagtagttggtgccaatgaggagcagaaaggaaaccactgagggctggtgagcaggagatatgagctgtgacagcaagacaggagcctcgtccaggctggtggggcttgagggtcatggccaaggagtttggattttatgctaaaagtaataaaaacacattgatgggcttttggacattcttgttacaaactatttcagtcattcaaaagagtatatataagatatatgtgaattgtaatgaatagtataataaaacgctcatgtacccttcactgttcgcctccccagtactattcttcactcttcatttctccaggaggtagtgtgtgtgtgtgtttgtttgtttctatgtttgttgagacagggtctcattctgtcacccaggctatagtgcagtggcgtgctcaaggctcactacaggctttacctcctaggctcaagcagatcctcccacctcaacctcccaagtagctgggactacaggtgtgagccacacactgggctcattattattattattattattattattactattattattattgtagagacatggtctcactatagtgcccaggctagtctcgaactcctgagctcaagcgatcctcccaccttggcctcccaaagtgctggcattacaggtgtgagctactgtgcctggccagaaggtagcctgaatttgtcctgaattttagtttatagtctttgcgtttcttcctaatattacaaaaatagagcaacatattgtttggttttgaacttcatttaagtggatttctgcagtgtgtattcttctgcagtttgcttttctgttcaacattatgtttgtcaggatcatcctcactggtgcacacagctgcagtttactcaccttcactgctgcgtacgtaatactccacagagtgacacgttgtggtttatcctttctcctgggaccaatttctaatgttgaaccaaaccctgcattcttgggataaacccaacttgattatgatgtgttatctttttaaaaaatatggttgggctgggtgctcccttctgtaatcccagcactttgggaggccaaggcaagaggatctcctgaggtcaggagttcggaccagcatggccaacatggtgaaaccccgtctctactaaaaatacaaaaattagccaggtgtgggggtgtgcgcctgtagtcccagctacttgggaagctaaggcaggagaattgtatgaacccaggaggcggaggttgcagtgagctgagatcacaccactgcattccagcctgggcaaaaaagtaagactcaggaaggaaggaaggaagggaggaagggagggagacggggagggaaggagggaagcatggattccatttgccgatttttgtttaggctggtgggtcagactggcctgtcattttcctctcctgccttgttcttttctagttttggtgtcaaggtatatacattccttataagatgacctgagagtatttcctctgatattctctggagcacatgtctaagatggataataccatgaaagagtttgataaatgttagctaccatgttgtcatccttctgcaactcatatttttttgtacagaattctggcttcttctggtaccacttgtcttgcatagatacctaccctaacccttgcccttttccccctaaaaaacaaagaaaacacatggctccccaacatgtaactccaattgcaatgctcacagcttgcttagaaagctgcatctctgtggtttttttataggtggatctttaactcaagactagcatgaagagttgccttctggcctgccctgagtctcctcaaataacaacaggtagatacctctctaactggttaataatttttctttaaaaactcagatatagaatcattcatacctcccttagggcctcctcagacatgagcagtgatggggccaaccccagggtctagaggttgagtttggccaagccaggaccccagactgcccaccaagcctactgtgttttagggacatattggaagccgtgtggtccaaatcctctaagcataaaattagcttctttccatatttttaaaaggaaaagaacaccatgctaaatatagctcgggtgctgtccagggtcaacaagccaagaacaggacaaacagctgaccagatgccccgctgggagctgggtttctacagaccccatagacccatcaagatcacagtccccaaagagagggctgaacttgaagaacaaatctacgccaccgttgcacacataaccctgccatgaacccaaaaaaccaaaactattttatgaaagcaacacatagatatttctgttttctaattcttattctcccagtaagaaaaagaaaatgaaaatcatggtgaatcccatcacacacagaaaataactataaatatcataatatataatccgagtgttgtgaaacttagtatgatacattcaacagtgtttctcaaccttttccgccaccttgccctccctgagaagtctttttagacattctttttggaatacttgaaaatttaatgccaaggatgccctgtgtatctatttatattctgtggccctgtggagggccacaaaccattataatatccaagatttttttcaccctgtccccaagaaacaatttttgctccttgtgggtgatcttaccccattgagaatacaagctctaattaacattaaataacaattttttttgtctgtttaagaacttactgttgtgctggtcacatactgttcttggtgctttatgtatattatttatttatcataactcccctatgaggtaggtactagagagtttttgtctcccttttacagctgtggagactgaagcacagagaggttaagtaacttgcccgaggtcacacagctgtgaaggaatagagtgaggatgtgagcccaggaagcctgggtcccaagctcactcttaaccactcagctatgctaccttgcagcaatacaatcagattgtgaaaattcaaaagagagaaatagaaagtaaagggtacactttccgagtttccttcgtccccagaagcaatcatggtacaagtctgaaaggtgaccccccccccccccccgggatttttacatacgtgtgtatatataaaaatacactgtctctttcatttcaatgtaagtacaatcatccaggctttttcccatatattcatctgtgtatggagaattttttaaaaattagaatcacgctgaacacactgttgtttcaatcttgttgtttgatttaaaaatacattagctgctttgagaccataatttccttaagtgcgtgaaccataatttattaccctgatctggattattggctattgaagtaatttctagcttctcaccactataaagctgtgatgatatctctgtacataattcttagaagttggaattatagagccaaagggtataaacatttttgaaacttttgttctataaatgccaaaacttgccatctaaaaaaatgccatgaaattgccatcccaatacctttccccacactgagtattatcacctgtttttaatcattgacagtttatcagacaaaaagaatgtattaatcccgacattttaatctctgcccatgattcacatctggagcctgtctttctctcgtgcagcataaggcaaagctggaatggagaacgaatgagggcaggcagtgagggggttaaagcggctcaaatcactagtctgctaaccacactctcagcgtcccacgtacaaggcctgcctgtcaggcacttagcatgtgctcagaacgtggtattttcatcactcctgcttccagcacaaccccctggctgtgtacttctccaccctccgagtctgaccttgtcccagatccatttggtagaaccggtgcattcctaaggctgccagagcccccatccttccttttgccagccatgagtgatactgtaagaaataaatatccttgtgtacggtcccatctggtcctaccgcagctgtctgcagtgggatccctgttcagcgccctgcacgccacacacatgcccatcctacctgttcatattccatacatatgcatgcatatgtacataggtgctcgcacgcatgcacatgtgctcatgtgtgcataaacatatatgcacacgtgttcatgccccagtgtgccttggtgcttcttcttaactccttcaagagcagagccagtgcgttcacgcacgtgcacatacacagtgctgtgcattcagggttcaggcccaattaggccagtgggaatcctctcccacatagactttctgtatgtcccacagccctgagctaggacaccctgctgtctaatcccacagttcctgtacttccttcttactttattggtattccctatagatcattttcctgctggcctagaagctctgctaatccttaacttgctcactgctgtttctccagtgcctaactcgctacttaggaggtagtgagatgcacaagaaatatttgttgggtgaaaaaaagaaggaacagacttaaagctgataaaggatgttgttccaaatatttttagagtctcttttaacaaagtggccaatttcagataaactcatggtttcacaagaaaatatcttcgcagcatcagatttcaagcagcctggtcagtcatcctttcggagagactggaaaaaatgcagaattgaaaacaggtccttgcccagctaaacatcttgtaaattttactgttttgcaaaagttcctgtcacaggaataatgtatgggggagaggtttagcaaggggcattgcttgctcctcctcctcagtccttgagaatgttctaaactaaagccttgagtgactgcttctctggctcgctctcaaccaacaaatgctgtggaatcccaggaccgctggctgctccctttagcgcagggtctctgggctgctttgtggaaagaaggtttattttgtccagctgggcacaggagcggagaggaagaatgtgcaggcctgtgtcccttttaacaaagggagaactcgatgtggtttcagagaagcttgtcttgctgggtgacttcatgtggcctgcattcatttcatccaacattgactctgcaaacttttttttttcgagacagagtcttgctctgtcacccaggctggagtgcagtggcacaatctcggctcactgcaacctccatctcccaggttcaagcaattctcctgcctcagcctcccaaatagttgggattactggcacgtgccacagcacccagccttttttttttttttttttgtatttttagtagagacggggttttaccatgttggccaggatggtcttgatctcttgacctcgtgatccatccacctcggcctccccaagtgctgggattacaggcatgaactctgcaaacattttttgagtccctgctgtgtgccaggcttagagatgatgacaatgtggtcatgggaagagagagactcaccacggtggttgctggaggatttggggagcacatgaaaggggcatctgagctatgggtgaccagagaaatgttctggagggtggttgggggtgggtagtgcaaagaaaggcaggctgagacatgcagtaggagaggcaggagccaggctaaggccaccatgagcagcatcattctaagaagctggattttctcctgcaggaagtagggagccattgagggtggggaacagatgacagtaggctgtttggcctggtcataccattggctgaggccctgtcccccaggtgagtctgttacaaccatcgattgtggaccattcatcccatcgctcactctcccagcagcctccagcaagagctacgattttactgcacttcattaaattccacacaatgttttaatgacctgagctccgacctttctggcctccagcagggaaaggtctggcttttccttttcagggagtagcgggctgggcagaccggcctcccttctcgcagcctcgcacaaggagcctgagcacgtaagacatctggaatgcatcaaaggcgaggcccagccagagccggcgtgctcggtgctgctgcctaactccttcaagagcagagccgccacattcacaaagcgtctggaatcggaactgatcgtcctctctgctctttctgctttccttccaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacaggtgaggcctgactgtccccttccctccccggatcggggatgggcacgcacgcatgcacacacatgttcacacctttccgtggtgaaaagactgtcatctacaggctttattgtcccatgttcgcccatgacgcctctgtcaaaacggtttatcattttacaaataactttagacttttctaccagagcttcccaaatagcatggtacaaatggattacaggtaaaccaagattttttaaaaattttattacaatagatttttacaccatggaatactattcagccataaaaaggaacaaaatactgtcttttgggccaggtgcagtggctcactcctgtaattccagaactttgggaggccgaggcaggtggatcacttgaggtcaggagtttgagaccagcctggccaacatggtgaaaccctgtctctactaagaatacaaaaattagctgggcatggtggcacatgcctgtagtcccagctactggggaggctgaggcatgagaatcgcttgaacccaggggagtggagattgcagtgagtgagctgagataccgccactgcactccagcctgggtgacagagtgagactctgtctcaaaaaaaaaaatacaaaaacaaaaaactgtcttttgcagcaacttggatggagctggaggccattactcttaagtgaaccagcattttgacccgcccagggtcactgaacagggcctggggtggccagcatatttgcttgtcccttcaccccagcatgctgtgtgtatgctttaatttgaaatggctgggaagcaattttccatttgagcaaaaatgccaccaacaaatttaaaagataagtgatacattggggaagatatgataatagttgatatccctattataaaaagagctcttagaaatgaatatgtaagatgaatataccaataggaaacagacaaagattatgaatattccatagatgttcaaccaatagatgttcaacttcattagtcatgaaatgcaagcaaaaagatgtcttttcttttttttgcctatcatattgatcaagatagacagcccctactgttggagagttgtagggaagatggattgctgatgaaatgttgactgatagaaactttcttaagagtttcaccataaggggcagtactgaagatgtgcgtattgatcctatttataagagtttatccctgggagacagtcccacaggtgcaaaggagtttgtaccagtatatttatcagatcattgtttaggataacaaaaacttagaaacaacctaaaaaaccacctactgagttaaatgacgtacctattcaatggagttctatgcagcaactgttgatctatatttgttaatgtgggaccatatccacaacaatgagaaaagggggatataatacagcatctttggtcaggttatggtcccatcaaatgttgtggctgtgggattggagaggggtaggaaaggtatacaccagaatgttacagtggtttgtctccaggtagaaggattcgggatgtttttcttttcttcattagatgtttctgtgttgtttgaattttctacaagcatttcttatctttatagtgggaagggaattgttcttaatgtaatatggattaaagggaacccttggtacactaatggtgggaatgtaaattagtgcaaccactgtggagaagtttagagtttcttcaaaaaactcaaaattgagctgccaaatgattcagcaatgccacttgtgggtacacaccagaagaaaaaaaaatctcattatattgaagggatttctgccctccaatgttaccagttaccacccctttccatggtaatgacctggaagttaccatccctttcctagaatgttctaaatagcttgcccttcaatttacattaacccacttcttacttttgcacataattgaaagtgggtgtaagtgggtacaaatacaatttccaaattaaactcattttctgatagcaaagaataatatatgctgtattggtcagggttctccagagacacagaaccagggggatatatatttttttaaatggagatttattatgaggaattagttcctgggatcatggaagccaaaaagtcccacaatttgccatctgtaagctgcagacccaggaaagcaaggggtataattcattctgagtttgaaggcctgattgagaacgaggagaggtgagggtatagatcctagtctgagagcaggagaagatgaaatgagatgtcccagctcaagcagtgaggcagggagaaatgagtcaaattcctgcttgctctgactttgggtctatctagggcctccatgggttggatggtgccaccacactgaggaggggaatctgccttacagagcccaccgagctgaatgctagtatcttccagaaacaccctcactctcacagtgtttaatatgggcaaccatggccagtcaggttgacacctaaaattaaccatcacacatgcttattctagaaaacttgagaaatatagaaaagaacaaatatcaatcactcatcattccccaccctagctgtgagcacatttgagttcattcctaaaggagggtgggaggaaaaccaaggcagactttgaggtttctgatgttggccatgatcaccccacaggttcaagtatagagtcctggaaagtggctattggcgttaattctgacaaatgtgtagaaaatatcctgactttttggttttctctttcaacagtcaaatgagaataaggctgagaggacctgatctttttgagtcttgggataaacttggaagataaaattacagaataatttgagacacacataaatgttatatttcagatattctttctctactgaaagttggtagcaactttgtacatttctgtgttgcctttgaccaaaggacccagctgagcattggaatagctcacgcagcatgtcgctaagtgggaaaggcttaaaggcaaaggaggtttaacacccagataacatggtggagtagttgagagtacagtgttcacttcctgccctcccatttcctgaaggtctgaccaagtcatttaatcttgatgtatctcagtccatctataaattgggtattataataatagtgagatagaaaacaggcaggacttgttttctgatcataaccctgctgaccaaaacaggatgtggtccagatgagataaggtttaaaaaaacactagccaaagccagcaaacgggaacgagggtgatccctggctgccctcattgctcatcagcatgggacactctcaccagtgccatgacagtttacaattgccatgacaacgacctggcagttaccatccctttccatggtaacgacccagaagttacctttcctaggaagtcttaaatagcttgcccctcaatttgcattaacccaccccttaatttgcatgtgactaaaagtgggtataaatacaatttccaagagcccctatgtggccaactcagggtgtactgcctatgagttagccctgctccacaagaagcagtgcccttcaataaagaattgtggtctaacaccactggctcacccttgaattccttccttgatgaagccaagaaccctcccaggctaagccccaatttggggactcacctgtcctgtcctgcatgactagtacttaactcatagtgttgtcaggaatctgaaattggttcatatttgctaaaatacttagaagggagcccagctcatagtaaacacttgaagtattcacttttattgcctctaagacccatttgttatttacaaggctgctgtgtgtggactctttggagcccatccctttgggattttgaatgacttgagcacaggctaacactctccctgtctgtgtgtcttcttgcagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagc

SEQ ID NO: 38444 - DNA, 54456 bp, Homo sapiens
gcctagtagagatctggagccagaagcccagagacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcaggtaacggggcgtcccccccacgcgccccgggccgccaagtttggggaggttcggggccacggtctcgccctccacgctggggctgggcagtggcgcccgcccgcgatccgcgtcccggtcctttgtcccgagccggacacccccacttggtgcacgcgtcgggggcggcgatcgcggctctcccggggtggggcgggctgcgcgccccgcacccccgcggctcgagctgttcccgcccgggcccctctcgttggcaggaaggctgcgaggagcctgggcagcccgagtcgcccccttctgcccatcccccactgctgtcccccttctggggtcccggagccctccaaggccgggccagctcagacccgcgcgaacgtggatgggcacacagtctcgcccttccccactctgttttcccgaggcgccagtaatctgtctcttgccggtgacctcgggcgccccctttgccgccgcctgaggaaggctctgagacccgctttgtgaccgtgacccgccaagcgtcgacgcgccgcggtcgtttgtcctgttttgctttgtgtagagtctgatggagccaccagtgcccagcgcggccagaacccccccacccccctccccgacacaaacaggctcccagtggccggaaaaacaaatctctcacagcttgaattttcctccggcagaatgccctggagttctgagcttgggtgatgattctatttctgtgccttaactctcttgagccagaacaaagacaaatcccggatttctccatcagtctgtgaccctagagaagacccagagctggctccagggaagggctgcgtttggcctgggagagtaagtcccaatctaccaaagccacatcttgcaccttctctggttgtgttggttggttatggtgggagcagagaggtcgggaggccacccaggctcccttctgtctccagggtgtgtggcagggaccccatctgctgctgttttcttttacagggaacgaagtttgaggggacacttgctttttccccaagcttcacctgtagtggaagcctgtttaaaaagtgacagcaaaatccagactgtgtgtggacagcgagtctgcaaatggaggcttaaaagatgcggaagccccaagttagttctgggggtctagatcctggctctccggcagccccttaagttttccatgatgctaattgcccttctgagtatcgctggcccttttttttttgcctgattttacatctcctgtgcctaaatccatacttataaaaattgtcatgtaaacatcattttagataatgatggttttagctacatgaaaactaaggaggctttccaggatttatttctagactggagaagaactgtgtctgccttcccctctggatcccactgaacctccggaatttccatggttaacaagataaactgatccctgctaaccctggagctggctggagcatcagttgctgccatggcaacttgacgaaataaatacagggctttttaacgtcttcaggcagaatctgcccagagaccaggttcctatttttccttttttgtttacaattcacattccactcggtcaatgtattctccttgacacatttttgacactggttacatgcgcagtactgtgctagctgcaaggaacagaaacatgaagtaccacacatatgagaacagacgctaaggtttgttgagcacctactatgtgccagacgctgggtgcttggcatattttatcacagcaaatccttacaagtccatgacggaggccccattttacaggtcaggacactaaacgagattaaataatttgcccaagagcatgccatttgcaaggaggagaactggatttcacatctgggcctgagtatctgcaaagggttttccaccttattgcttcatcctgagaaagatacgatgtaaggtacaggacagatctatttcagaatgatttctctcttctcttccctctgggaagtgggcttactattgtgcctttctagtagattgctttctgctgttgattcatcccattatccccataaggatgggaactgttacttccctacctgcaatacttcgcagtgcttggctggagcaagtgctcagaccctgctcctggtgtgtcctgtggccaccaggtgtgtgtgacagtcactgtctctctgtgcagtctttccctcagcagggggcagtttgcagcgaaatgttggtgcatccatccacttgctcagcaaatgtctagtacctgccttgtgacaagctccgtatcaggcactgggacagggatcctgtgggacaaacttgaataggacgtagattttctttctgcatgtttataaaagcttcaagaaatgatgggcccggctaagacacagaggggaatggctaaagggctgggctgggttgaagaaggtgcccagcacgtagtaggtcctcaagtatttattagaggattggatgaggacaagatgtatgttcatgaaaagacattaacaggagaagatggtgaattcaaagtgtcaaatgccaatgccactgaacagctgtcatcatcaggactttgagaatgggggctgaagatggattagaactgtaggcatatatctcctggtgggcctgggagttaagactgttctaggtggagagatatcgagatagcgaagtccagaaaatattcacagagttcttcagaaagctagaggatggggtgcaggagggctgggagacagaggccagggccagattatagaaggtgctgattgctggggtgagaagtttgcatctaatcagtaaggcagtgggagccattgcaagttattgagcaggagaatggcatatagttgaagcagtcccttgggaaaacctcagcccctgtagaggatagaagctggagggattcctggggctgggcatgcatgcttgtgtgattaactaagtcagtgaaaccagatccacgtgactccaagcccacgtttcttcttccccatgttgttaaatgtgattcctgtttttggcttaagaagacccagaacacataagccattttagaaagattttccactcaaaagctaagcattaaatagatatcctctttgggtgtacagagtagacaccagttatctggcaaatcctcttagacagaggtgccctccctggtgcagtacacgtggctgtatgacagtgtaagagaggctgcaggcactgagagtgtgctcgtggaccccatcttacttctgagccctggaggctcccagttgccctctcccctaccctggaaacaccccagccccactccacacagtgcctgagtctctggtgactctggaggatgtgaacagtgaaaaaggccattcatttctcttaggccaggagtggccaagaggacagggccacctggatgtccagtgggctggggacaaggcgagaatcacagtcttttaggactgagtccaaaatccctgtttcattggcaggatcacgcatgttcaaagacagccgccatgcattccctgtctccctcctggacatgcttgctgcccaccacttcaagagctggaatctgattcttctccccttaaatctgggactgtccttggtgaagagaaagtctagtggctttcttggtgaagagaatgcagtattggtgacattctgtggccaagtcctaaaaagccttagcttccacttgggcccgttgggatgctcacttgctccaggggaagcccacatcatccaagaagtgcagtgacacagaggcacatgctgggggaagggagcgaacatttcaggaacgttctgcatgctaagccagcactcattatgggggaatgggatggacaacagagacaggagggctccttcacttgttcttatggcgtaactctcctgttaaagcatgcctcgggtctaaaagctcaaccttctttttgtcttgcactgtcccgtccctgcagtgagtggtttcaagccagtggttctcaaatgttgttgccattagaatcacctgggagctttcaagagtcctgctgcccaggtctcacctccgatactcccatcagattctaggggtgggagccaggcaccagcactttccttgcattccccagctgatcccagtggtcaatgaagggtgagactcagagtgtaagcccaccctataggatacatccaccctcccacttctccctccctggatgaaacagatccctggctctctggtcacccttaggccattaaaaactcatgtggtcactggaagtcacctaacacagtatcgattcagcaacttaaaatgtttgggcccagagtgacatagccttggaacttgctccaaaactgagcttctccctctctccaggccacacctgccagaggtgggaaacctgtagttgaggtgggtgcctttattattcccatcatcaagaaagggagatttggaatgaatagccagggaggctcagccggcaaacagagggccaggagcggagccacatccactgatgcaggaccatccttccatgtcaccgcagtacccctgcaagagctgggggggccagggaccctctgtggatcagcttcatcctctgatccatccaggcggttgtgtttgtgtacatttttattttattatcattattcttttttattttgagacacggtcttgttctgttgcccaggatggagtgcagtggtgcgatcatggttcactgcagccttaatctcccaggctgaagcaatctgcccacctcaactgcctgagtctctggggctacaggcacatgccaccatggctggctagtcttttaaaaattatctttagtagaaatgaggtctcattatattgcccaggcaggtctagagctcctgggctcaagcgatcctcctgccttggcctcctgaagtgctgggattacaggcatgagccattgtacccagctgtgtacatttttaaacaaattcttgaaccaatctctattagtttcctaaggctgtgataaattactacaaactgggtggtttaaaacaacagaaattcattctgtcatggttctggaggctggaagtccacaatccaggtgtcagcagggccaaagtagtctctctgaaggtgctgggggtgggggtggaatctgttccaggccactctcttggcatcacagtgttacctgcagtccttggcattccttggcttgtggacacattgctgtagtctctgcctgcatcgtcatgtggcattctcccagtgtgtctctctgagtctcttctcatcttatgaggacaccagccatattggcttagggcccaccctaatgacattatcttaacttgattacatctgcagagactctgtttctaaataaggacatattcagaggacccaggattagaacttcattctacctatcgaggggacacaattcaaaccacaacaggttctgaagacccgtaaaggataagcatcttggccctcatattagcagctgttgatcttggggcagcagtgaacagatcgcttatttaaacctcagtttcattatctgtgaaatggggacaaaactgtgtcctcacggaactgttcatttagtgtcttagaaaatgtttcctgtgtgccaggccctccctacatggaatgctttaggttaagggatgtgcctcagagccttccaagtgatagataacaagatgggggtaaacacaggggctccaggagcccagagatcaggcaagccttcaggggtttttgacttgaactgagtttgagagatgcatggcggttatgcagacataggagtgtgggtgttttgggcagagggaactgtgtgcacaaaggcaagaaggcttgaaacagtatctcctgttgggagtgtgagttgctagtggccattggagcagaggggtcaggtggtgagggggtgggtgtataagtccagggagcccgaaaccagccaggtgacctcatggagtggagttggatggagtgggggctgtgatgccctggagagcttggccagcctggcctggatggggctttggagctctagccccttgctcatgccatgcagaaacacaggcctggggccgcaggtgcttctgtgtttaaaagaaagctgaaactttgattttctcatgcactctggttgttttaatgttaacaattaaattaacaattaaatgttagaaatttttaccagacctaccaaccatggtgtggactgtttctgttacttactgcttatgacttcagttacttaatggcttaaagcaatcatttattgtgctgacgattttgtgggaccagaattgaggaagggcttggctagacagtttgtttttgcccgagtggcatcagctggaacagcagagactggagtctaggcttccagcgtgtagtttcctctgaacttgtctggtgcctctaggcaacttggccactctcctcttgggatttcatcctgcaagggcttcttcaggtgacttgggcttcctcccagtatggaggtcccaaggttgttgctcttcttgcatggtgctggctcccccaagaaagagtgttccagcagttccaggtagaagctgcaggcttcgtaggacctgcctagaagtcccagaatgtcattaacactacattcttttagtcaagaaagtctccaggccagcccagatttaaagggaggggagtcggattccagctcttgatgtagtgtgtgtgtctaggagcaagggacagaatggatggtcattgtccttggggactggctactacttgaaccaaacaaaacaggtgtgtgggctggattcatcccggggctgccagtgtattatctctagactaaacaagggtgtgtagagcttggcaaaaccttaaaatactgccaagcccagtagaaaagtcacttattactaaggaggtaggccatggctttattaggctgaaccatgtgaaattgctgacatttgaccatttttgacctatcaaatgaccattttatttggttcagctacatattggggagatccaagtaggtttcctgtgcttgaggagctgggaattcccccacctcgctctttcgcctgtctcttggaatctggcccttgccaggtgggaagattcagtctcacctacatattaacatcatattaacactgggcctgtccttctgggagatactacatgtgtatctaatcacagctgagatgctggcatatcccctgctaattccccttctaaagagaaggtcccccaggaccttgagagactcacagttaatttgcattttaatcatttttcacagaggggaaaaaagacacaaaagacatctcttcctattggagaggtgattttgttatctcttgaaactgtcttagctatggggaagggcctcattctgacagatatgcaagaaactagcagaagttgtcggtccccagaggaacatatcgctgcccagaaaaatagaattctagggagtctggcagtctgcttcttagagaatattttcttcagccaatgagtgcttctttttcttcaagcaagaattatcattaaaatacaaattgtctgttatcttagggcttgtctggttgtacttcaggtttccattgcaaagatttaaatattttatccttctaattagacctgcttcaggagagggtataaggccacattttatgcagaggtgtaatgagcagttcaagaagtaaacattccagtgatttttgtagaccaaatttctagtgttttaagatttcagacatatgacttgaaacaatggaatctcacaaagctaagagaactgggacatctgcaggtggatggccagtctccaatgaaatgcttgagtgtttagggagcacttgctgtgtgctctgtcctgctcaggtcctgcaccccagctctttctacactgaggtgatggagacccatctgtgttcactccctcctcactgtgtcccctcaagacatccctgtaccttcccatcacagctaccattcaacagatgcctttgaggtagcagacaaaccctgtgctgagcaacacacacaatctcactgaatccttgcaatggccccttggaataggcacattcagatccattttataggtgaggaaactgaggcttagagggcacacagctggggatcaaacacaggtctctgcatcacgtcagcctattatttttaagaacttttttaaagagatgttttaagttcacagaaaaatcgagaggagggcatagagatttctcagatgcccctctgcccctgttcatgcacagcctcttccaccatcagcatccccaccggagctgtgcatttgccacaactgactaacctacgtcgacacatcagaatcctccaaagtcgctgagcccggtggctcatgcctgtaatcccagaactttgggaggccgaggcaggtggatcacctgatgtcaggagtttgagaccagcctgaccaacatgatgaaaccctgtctctactaaaaatacaaaaattagctgggtgtggtggtgggcgcctgtaatcccagctactcaggaggctgaggcaggagaatcgcttgaacctgggaggcagaggttgcattgagctgagatcgagccattgcactccagcctgggtgacagagtgaaactccatctcaaaaaacaaaaacaaaacactccaaagtccatagtttacattagggttctctcttggtgttgtacattctgtgggcttggacaaaagtataatgacgtggatccacgttatagacagtattttcactggcctaaaagtcctctgggctgcatgtatttgcctctccctccccttaactcctagcaatcactgatctttctactatcttcacagttttaccttttccagggtatcatagttggaattattcagtatgtagcttttcagattggctgctttcacttagtaatatgcacctaaggcttgatagctttttctattttattttttatttttatttattttttatatttttgagatggagtttcactctgttgccctggctggagtgcagtggcgtgatctcagctcattgcaatctctgcccccccgggttcaagtgattcacctgcctcagcctcccgaatagacgggattacaggtgcatgccaccatacccagctaatttttgtgtttttagtggagatggggttttaccatgttggccaggctggtctctaactcctgacctcaggtggtctgcctgcctcggcctcccaaagtgctgggattacaggtgtgagccaccacgcccagcctgctttttccattttagtgctgaataatattccattgtctggatgtaccacagcttgtttgtccattcacctattgaagaacttcttgtttgcttccaagtttttgcttttctttttgagatggagtctcgctctgtcatccaggcttgagtgtagtggtatgatctcagctcactgcaacctccacctcctgggttcaagcaattctcctgcctcggcatcccgagtagctgggatttcaggtgcccaccactgtatccagctaattttttgtatttatagtagagacagggttttgccatgttgggccaggtgtggtggctcatgcctctaatcccagcactttgggaggccaaggcaggcagatcacctgaagttttggcaattattaataaagctgctataaacatctgtgttcaggtttttctgtggacataaatttttaagagcctattttaaaatccaatctaacaatctctgctttttaaatggagtgttgaagcttttattttattttatttatttatttttttgagacagagtctcgctctgtcgcccaggctggagtgcagtggcttgatctcggctcactgcaagctctgcctcctgagttcacaccattctcctgcctcagctatatatatatatgtgtatatatatgcatatatatacgtatatatacgtatatacgtatatatatacacatatatacatacgtatatatatacatatatacgtatatatacatatatacgtatatatatacatatatacgtatatatatacatatatacgtatatatatacatatatacgtatatatatatatagagagagagagagagagagttctgtcttctctctcctcttcttttgggactaatacacatatattaggtcacctgaagttgtcttagagctcactgatagtctcttcattttttttttttttggtctttgtttctgtttgtgttttatttggatagttattattgatatgtcttcaagttaacaaggttttcttctgcaatatctaatctgctattaataatagccccacccaatgtacttttgatactagatattatagttttcatctctagaagctaatttggatcttttatataaaaacatatctcttccattctcttcttaacatgttcattgttacctgtagctttttggacatatggaatacagttataacaactgttttaatgtcctcacttattaattctaaatatgtcaattctggattggttttgattgattgccttttctcctcatatggttcatattttcctgctgctttacatgcctgataattcttggttggatgccaaacattgtgaatttaactgtggtgtatgctagatatttttgtattcccataaatattcttgtgctttgttctgggatgcagttcagatgcttgagaacagtttgatttttgcaagtactgtttttaagatttgttaggcaggatcaagccaaatttaatctaagagtaattattccccatcacaaaggcaatgctgttctgagtattctacctgctcagtgtctcataaatgatgagattttcaagatgggtgatggaaacaggcactatttctggccctatatgggttccaggcactattttctataattttttgggtgattctttccctgcctcaggcagtttctgtacaaacatgcattcatctgtcctttgttgaatgtttgagtggtccctctctcaaaccccagggttctctctgtgggcggctgtcttctctccatactctgccatgtggtctccagctgcctcactctcctcagactctcacttccattcttcaactcagagagtccattgagccctgcctgagtttactgctccatggcctggaaactttccataggcagtaaaccggagcacctgtatggctcatcttgccaatttcccatctctcgagggtcactgtccttcattgtctgatgtccggtgtcttgaaaatcattttcatgtattttatctggtttttcagttgtttcagttgggagggtaaatctattccctattactccattttggctggatgtggaattttcataaggctgtgcttttaacagctatatttccaccgttcctccttttctcccgttgtgggaaaaggaatgttgacacttgaatctaaatctagaccattacccctacctcccagctatgggcccctgatccagccagcatttctctttctccctgtctcccaaatgccacaaaatgtgagtaacatacatacatactctacaggtcaagtgagcctggggaataacaagtgaggatgccaaatcatgcatggaccagcctaactcctttccagtctgccgttgccacttggagttcttccaggtatcctgtgacaggatgttccatgagacattgagggagccagtctttgattcaggtgtggggtctgcagaccaggacccagagttgggcagttcagtgagcagagatgggttctttaggcctccatcccaaatccctgggtcctaggaagccttgttccccagaaggatgaaagtgaggggaaatgccgggagcaggttgctccagcctgaggcccacgcagtttgccagccttccatttagccaagagctggaacactgctgatttcttccagccctcgtgaggacccctcatccatctcctcagcatgaagctctggaagctgattagaaatatattaagacttggtttccagcagctttgagggacacctgaggggggctgactaatgtgctctcccaggcaccctgaaaccgtctctctgcattgagtcttagcagcccttcctgcatctcctgccttctctctgacctcctgccaatccttcttctcttcctatggaggttccacccgggtcctgctgcgtatcccaataatcaaatcaattaggcagggccagccgtgcaggcaggctgtgttggggaatgtggaaagccagaaagaagtgattgccagccttcatcgtctttgtcatccttgccaacagcatgagagcacacattgcatacagaccatcattcctaggcacgaagacctgtgaggcaggagccccgccctctggtggaagaagaggatagctgtcgtaggtgaatcttgagcacctgctaagagttctgtgctgcgtgggcagcctatgaaggcaacacattcagcatgcccattttagagaagaggataccgaggctcagagagctttggggccttgcccaaagtcatccaggtgagaagaggctaagctggggtcaaggctagatctgagtcacagctgatggattgtagagtgttggggtgagatggaggcagatgtgagccccagagagtgtggttctatgtcacaactccttccagcctggccgtctctgcagcctgtctgggcagagtggattgtggctgaagccaggtgtcccacgactcagacaggctggtgccagaggtgggggtggggaccccacaggaggctgaaagaattgagaggggcgttggaggacaggaagcttgctccccccgggagaggctatacctctcctctgcccctgcagctccaagcagctcaccatcagggcatccctcccttccgaggttcccttgagggccaaggttctcatctcatttatgtcaggattgctgctgcccagcccagggctagaaccagtaaatatttcataaaccaatcaaggaagagcagggaattaataaaggcacaagaaagaaactggacagaaaattatggcttgcatcagcttgcggggcacctcctctttgagtctggattatgactttccccaaggccagtgatccggacagcaccaagtcccccacccttgccccacgtcctcaaactccccagtccccagcgcccctctcttgtccccctgcaaactgtctgctgcatgctgggcccagcagcacaggcattctgcgcagtaccctcttcttcctctgaacgattccatggtgtgaacctgggatgactcagttgactcaggaggagagtggaggccagacagggtaagacgccggctcaaggtctttcaatggggcttgtatttggagagggctgacccctttaaacctctggacttctctgtcaaaatggtgactcagaggtaaggtgaccaaccaccccggtttctgcagggctgaggggctttcaagacaggagacttccacttccagtgctgaaaccaggacagccccaggccaactgggatggctggtcaccctacccagaggccatttaaaagcccagaggctttttggatctcactgtatttgactaacattcttgctttttaaaaatgagtggggatggttgaaaccatgtccagaatccacacctttccccggcccatttaattctcaagtgttaacaggcactgaggatgagccagacaccgttctaggcactggggacgctggggaacaagcactaaattccctgctctcgctaagggcaccttgtcctgacagctgctcacctcttatgaaaggtgaccaaggagcgagggcaccacacagtccctgctgtctgctcacttctgtgtcccggcagccatgcagagaggtgcccagtacatgttgactttgatgaatccatcaggaaggcagcagaagataagcagagcctgggcagacccctggcccccagaatgggactctccctgggctggccagactcagcaaggagcaggcaggccccctcctcttctgtggtcctagaaatcccaggctgagccccaacagcagctggtggtcttgtaggaggagcagagccccacccccatgatggcctttgcctgttcagtctccaatggccacctgtcacccagaagcctcccagtgttacagaacactgttagccaggtcacacggctcaccctgtcagtctccagcagcccactgtgggaggaggtaccaaaaaaaggagggatgtggtcccacccacagtcatgaggccttggggagggagcactccagggagtcaagccatagcccccagcagaacactaaagcgtctgtcgcatctctctctttacccatctgtctgcctctcctctgcataggagaccctcagggctaatgcagtaagctgtgcctctctttacagctctctagggcctggctggtggaaggccttaataaatgcccgcagtgagcataatgacccctcagttggggagggtggtggaagttctgactcgtctgtttgcgctattctgggatgctgaccaaaccgcccatgtagaagcacagactgtaatgtgccagaatccctccccatcatcccttatgcagggtgagtcacccgttgtgtctgtatctttagcaacaggaggctcaccacctcaccaaacagagacttccatgggagtcaggtctccctgggctacagcatggccctgccactgcgctgccggggaaatcacgtcatggtccccagccacggcattctcatttgtgcagtgcactgatggtagttatgatacgttgccacaagccttgggattttgccgcttaaatatggtaatgtggcacctgagatggggaggcaggaggcttgagttcccggcctgcctccaccactcatgatttggggctgtttgacttggaacaagatgcttaatttcttggagcctcagtttccctttctgttaaatgggaacagtagtaatagctcatagtatgggtgggagaatcaaatgagatggtgaatgagaaagaacaaactgtgcagggcagcatggacaccaggaattattatgtttgaaccaaaactgtatatccccctccgcatcatccctttttttgggctaaatgtagccattttcctcaactgttttcccaaatgcacattctctctaaaaatcttcactaggtcaggctctggtctgttagtgttcttatagaacagttttttcagaacaggacataataattcaggaaaatctattacctccttggatctagccctaatgcattcactaatgtggccagtgagggccaaatcttgccttgtctaatgcaaaacctttgactcattctgagaggagatctctctttcctaaacactgctgttcagccacgtctctcctccaggatttttacaactgatttttttgaagcttagcacagatatgtcaagaactgtgaggggtttgcaattttactttgccttcaagttagtcttccaaaatttcaaagatgcagacagaagacatgagactcccggagtcaaagggcattattactcacaccgcagcaagcgacttgagcttcatgctcacatcagtgctccctgctctgcaggtcccatggggcaatgtggagcagcccgggtgggttccgcgcatgccatgggtttgtgtgacagctgaggaacccaagcttagaaaatcccactcttttcagggagactgctgacaaacctgcccagcctttgcctcagagtgagagatataattatcctggtcaggaaacagatgtgccctctgccccagaggggacactgtcttttttcaaggctgtttactttacccacatcttgaaaagatagtccagaacagagactatcaaatcctctattcaaaaggcacacagaacaggattctatggagaattgccttccaactatgcatttatacgtatccttcacaaatgccgctgcgtacatctgggcctgcatctcagcttggccactgctgagctgtatcaccttgggcaaactcctgaacctctctgatcctccgttttccgcagcctgtaagaggaggtataattcctatcttccagaagttctgtaagggactctctgaagtagtgttcatgaagcctcctcaccgtgcctggtacagaatagaccatggagaggaggcagcagggccaagatcactgtgatttagagcccatccttctgaccacttaaatctctttccttcactatccctccccgacttagtcctctggctcctgtttcttccctgccaagtggggcagaatcacctgggtagctggtgttgcaaggcttggagcagagatctcagagcccgggtcgcacctaggctctgggactgggtggtactttctaagcttagcctcagtgtcctttgttacaaggaacccaccccctgggatttaagaaataattaaaggagataaaaaacatgaaatgtttggaatgttcctgcaagggacaggtgctcagtaaagactttatgatgcaatttggatagcttgagcctctcagaatgcggtgtaggccattctagctgctccccagagggaacttattagaaaaagcaagacaatttgcaagcctcttgcagctcactcagcatgctggtggcatgcagcagcaattggctgtacattcagcattcacgtgacatggccctctgtgagcttctggcttggggaatacagaactgcccagggcggcctgcaagggggtcagggtggtcagctgggcctttttggccttgacaatactgctctcacattgtgcgaccttagggagaggagagtggtgaggaacctcctccttctcgctgggctccgctgaggaactcagcactgcatagtggtcaagggtttcagaggaaatcagactgacttaggtttgaatcccgagtttgaaaccagctgggtgacttgagcacatcacccatcttcctgagctcagtttcctctactgtaaagtggggataatgacctctcctggctcgtggaggtgtaaggattaggtaaggccatgtgtgtgcagaggctggccaggaaatggtgcctatgatgacgttgcactattttctgttttttttggtctgcaaaatgcaggttgagtgggtagaccctaagatctcttatttcatggggagatggaaaaactcctggagttgcagtcagaaaaccccggtccaaattctttatagcctcacacaatttatctgcacctcacctgtagatggtgccagctccccacgcctccttctgtgatgtatggcaaaaacactggtcaccatacctgacagaggactttggtaggtgctcaaggtccctctcaagctccagggttgtcaatgaccagggccgctggcctcaaagtatgctccatctaatcagggctatagccagtatgaaggtaactcaagcatcagacacttaatggggctcacaggcacacctacagggttttgctgtggtttgaatgtttgtctcctgcaaaactcatgttgaaacttaatccccaatgcaatggtattatcccagtcaggaaacaaatgggcttttaggaagtgattagaccgtgagggcttaaccccctcatgaatggattaatgccatctaaaaggccttgaggcggtgaatgcactccttctgtcccttgcactttgtgaggacacagccttcctcactccagagggtgcagcagcaaggcacaaaagcagagagcagagaagccttcagcagacaccagagctgcctgcaccttgatcttggacttcctaacctccagaactaggagaaataaaattctattgtgtataaattgcctagtctgtgggattttgttatagcagcacaaacaagctaaacgaagaccggttccaatggctggagctgcctgtcactctgttctgatgctgaggattagacctcagggcatctactggaatggttcaggctgaaggagctcattgaaccccagtggcacacagggtgaaccggcccagcagcagactcctttttgccaaacaatgcaggagtgatgtcttctgcaaaagtggaatctgtttggcctcctgctgatgaatgatgtctattggtccttggaagtagagtccattttttatacttttggtcaggaaaatcacgtggtgctagtagacatcctgggagagaatcctgcaggcctcctgcattgtacctggaaggaagctcaactccacccctggatcctttgtggagaaccatgtggaggcactgaaattccttcacgtctcttggttcctgtcgcggaggttggagaagttaaccttaggtgccattggtcccttgagtcaccataaccataactgaccatactgaccatgctaacgcctgccttgctgtgtgctgggctctccgttgaacgtgttacacagagcagcacagctaagcctcaccaccatgctctgaagtcgagattacaattaagcccaattttcaggtgaagcaactgaggctcagatttgaaccagccacctggctcccacgtgctgtgtctcatggctcacttcctcagctcagggtctccactctcctccctgcccgcacttcgtgaggcacatcctcctcactcggtcactgtacacctctgtctgtgtccaacttactcacaaacacaacttgtggctcctggaagtaactgccttctgtgacctgatgctattttattccattggaataaagatccttaatgatgccatttctacctcccctcttccctaactcccacctcaactcacctcccccttcttttaagaatcttgtgaacattggcttatttatacttatgcaccatctcaggcctcccggggaaggttttaatcatctaccttcttgctggagacatcttgaaagactccaatccttcacccatgctgagaacatctcaagcaaagcaagaggcatgagaacagtttttaattgaagttaacattgtggcttttcccacacagccagacactcaggcatgttgggaagattaaaagtgatgttggaaaatgcatccacgagtctgtgccctcaagcagaaagcagcagccacctgggctcatggatcagacaggatgcatctcaaacagagaatgggaaggatccatagatttccctgcctggcccagctctcccaggtgcctcctacagcattgcagcagtagggctgccactggcagggctgggaacagctcgggggctatctcctgtgcagggtagccacaggttgcccaaggggctttgattccccagtcttggctctgccagagcctggttgcatatcccgagaaagtcatgactgagcctgtttgcatatttgaagaggggctcaagattaccttccccaggctgggcgcagtggctcatgcctataatcccagcactttaggaggctgaggcgggcagattgcttgagctcaggagttcaagaccagcctgtgcaacatagtgagactctgtctctacaaaaactacaaaaaagttagccaagtgtggtgttaaaaaattagcctagccaggtgcacatctgtagtcccagctactcaggaggctgaggtggaaggattgcttgagcccaggaggtcgaagctgcagggagccatgattgcagcactgccctccagcctaggcgacagaatgagacactgtcaaaaaaacaaaacaaaatgaaaaacctgccccatgggtttattttgaacactggatgtggtaatttgtgcaaacagctttgcaaatataacagatagtaatgacacagcttgacatgtattgagcactcatgaagggccaggcactgctctcagcacttctcatcattcccattctacagatgaggaaactgaagccccagggttatgtcaccaagccacacagggagcaagtggcagagggggatttgcaggtcatgtttgggcatccttgctgtcagccactgtgctgtgctcacttgtcacatggcagcatagctcataggatattctttaacctggcagtagtgtctgctgggggggccctagctgggttgggtatttcttgacccagtaacatccatccaaactcccatgccactgcttcagcccttggtcccgcctttcctcctccctggacgactgcaggtgcttctcacctggggggtgtctccagttgcttcctgatctgtttcctttcttcactcttgccagagggagctttctcctgctgagggtcttctgtggcttcctccatccatgggatacagtgccaggtccttgggccaactgttgttcccatgagcagaccccatctctaggcctgggcccgaaatgcatcttcttggtgcccacaccagtcaggctgagacacatgcagctccccatagtggtgccccaaattttcagtgccttgtccctgggatgcccccctcccctccttcagtgctggattcagaatccccttcccacaaagccaggtgcctggatcccacatgctaagacactgtcctttcttctgagtggccagtgcccttttgtagcattcctgaggacttctccctccctatcggctagattgtcatttgtggagctgatcggctggttcttgtgtggctccccagcacaggacacagggctggtatgaagttgattctgcacagaaaatgaaggaggtgggattggtgtcacaggcccaggtctctgctggcccccacactggctgtgtgatctttgcaaaggtgaccccctacagctaccatctctgcaacagtaaaaatggaatgacagctgttctattggcacggtgaccactgaccagccaagtgagctgcgatgtgctttatgatgtgtagagttccagtgccgtgcatgttcattgcttgagtggctaaacagaatattgagtttattcagcagattttttatcctctgcaccctcattctcgtgctaccatctggggactcagggctcagctccctgacagagtagtgtccttccccactctgtctttctcctttgcctcacccattcacttgatttcctcctcagccacccccaattcccatgctgcatgcctgaaagaggcaggaacttcacctctatgctttggccagaggcctcttctctcccacccgtgcccagtgccagggactcagcccagcatcagcaaatccagcaaacacatctgtctaaagaggaataaatcccacatctcccgtgccaaacatccaaggagctgagatgggaagggtctgggtaaagggttccctgagccctgagacacatccctgcccatttccatagcccattgtgtatttgccatagacctttgaataggaaggaaaacagtaagctcataattctcaagtttgaaaaagtccttcccagaacatgcaccatctttaaatagtaaaaacaaagacaatgccacgaccatcacctactactaatgctactaaaactaaacacaatggcagcttattaaattaccatttccctggtgctgggctctgtgcctaaaaccatgcactgggcctcattctcagggcttttcttctgtcagctcaagaagtcctcacagcacctcagggagggaaatattttcattacccacatttagagataagaacgataaggcccagagagggtgagggattagttcacagtcacacagctccttagtagccaagtcagacatggggtgcagatggcccagctctttgttcctgcaccttctccctgttggagtagctggggttggtgttatctactgccattgggcatgtattcgcaccccttattttagttcataggttcatttaaggagctaactgtgtgtgtgacaaacagcaaacgtggctgcctggagagcccaccaccagagctagagctgtgtgtgatgaacgtctgcagtggcagatatgattcactggggttctgattctctgtgggtttaacttattgtattttcttttaagtagcactaatttgccatcatgtgcctttgggtgggcaatatttaaagaaataaacatctcaggacaggtgcagtggctcacacctgtaatctcagcactttgggaggctgaggcagaaggatggcttgaggccaggagctggagaccagacagggcgggtctctacaaaaaataaaaagttagctgggtgtggtggtgcatgcctgtagcttcagctacttgagaggctgaggcaggaggattgcttgagcccaagagtttgaggctacagtgagccaagatcacacaactgcattcagcctgggtggcagagtaagaccctctctctaaaaataaataaatagataaataaataaataaacaaacatctcaacataattccacagctttcttacaaatgctcaacagaacaattattctaatattttgtcttctatctcagtcaccacattcccccttaacgaggagttagtcaaactttctgaggataaaccctctatccagctggtccggtcctttggctcatgttgaagtcaaaagcccttgcaggcagcttttcttgtctgctcatggcttttctccagcaagtcgctccatggatcgagtccctgccatgtgcatatgtcttctctgaaccttccacagtctgcccactagggtgttgaaccacaggtcaggtaaagaaaatgggcttggagtgaaggactggatgtgtggctatgctaccagagagagagcctgactgcaccctggcctgaacccctagtcctctttcaccctcaaccatgagatgagcatcaccagctccaaatgctccccattaatcaagaaagaaaacaaaaaggaccaatggatcttcgtgttttcctttcgtcaatctactttctctctcccctgccttttgcaaaagctgacatggagattgcagccctccacatgtgtctttatggtaataatttgaaacaccagcactgcctgtttcaattggaaaggaggcatttcctgcctcttaggaaaaagtcctcctgcccagctccctgctcacggctgctaaggttcacatcctcgcaattccaccactctgagctgcatccgtgtcagaaccgctagggagtggtccagatccctttgccaaacatttcagcaactggaacccaggtttctcaacagaggattaaagcgctgtcttcactcctgggctgccaggtacattcttccttggccttcggagtgcccttacatactctcaggatgaatccagtcttgtttctgagatgattttctttccaacaaacaggttacttatggagcataatatagacttgattttgcccaaacaagccactgagcatttattgagtgcctgctatgtgcaaaacactgaggatcaaagacacaccacagaccctctctgcccagagtcacaaaaagagtggatgtcagtacttttatcacagaaaaaaattttttcatctgatgcttttaaagagtttggaaggtggatgaggcagggatcgtcatatctgtttgatagctgggtaagcagaggccagggagctgtgaagcagccgttgacttgcagctggggcgggtctcaggcctccttgctcttgtccaagctgccatcccctcaggaacagagggtgaataggatggaggttccgtataagaactgacctcttgaaaagtactgtccacccaaggaacaggactgtggtatccttttgtttgtttgtttgttttttgagacagagtctcgctctgtcacccaggctggagtgtagtggtacaatcttggctcactgtaacgtctgtctcctggtttcaagtgattctcctgcctcagcctccccagtagttgagactacaggcaaacgccaccacgtcgggctaatttttgtatttttagtagagacggggtttcaccatgttggccaggctggtctcaaactcctgacctcaggtgatccacctgcctcagcctcccaaaatgctgggattgcaggggtgagccaccacacccagccatgtggcatccttttgaggaacaacaaaagttacgtccctacattggcttaggcaaggatttggtgaccaagaacccaaaagcaaatgcaataaaaacaaagataaatagctgggacctaattattctaaagagcttttgcacggcaaaaggaacagtcagcagagtaaacagacaacccacagagtgggagaaaatcttcactatctatacatctgacaaaggactaatatccagaatctacaacaaaatcaaacaaatcagtaataaaaaaaataaacaatcccatcaaaaagtgagctaaggacatgaatagacaattttcaaaagaagatatgcaaatggccaacaaacatatgaaaaaatgctcaacatcactaatcatcagggaaatgcaaatcgaaaccacaatgcgataccaccttattcctgcaagaatggccataatcaaaaaacagtagatgttggcagggatgtggtgagcaggaaacacttctacacagctggtgggaatgtaaactagtacagccactatggaaaacagtgtggagattccttaaagaaataaaagtagaactaccatttgatccagcaatcccagtactgtgtatctacccagaggaaaagaagtcattatgtgaaaaagatatttgcacaggcatgtttatagcagcacaatccacaactgcaaaatcgtggaactgacccaaatgcccatcaatcatcgagtggataaagaaactagggtgcatatatacacacacacacacacacacacacacacacatatacatatatgtatatatatacacatatatacacatatatatgtgtatatatatgtgtatatgtatgtatatatatatatgatggactactaggcagccataaaaaggaatgaattaatagcatttgcagtgacctggatgagattggagactcttattctaagtgaagtgactcaggaatggaaacccaaacatcatatgttctcactggtatgtgggagctaagctgtggggatgcaaaggcacaagaatgatacaatggactttgagaacttgggggaagagtggaagagggggcataaaagactacaaatacggtgcagtgtctactgctcgggtgatgagtgcaccaaaatctcacaaatcaccactaaagaacttactcatgcaaccacaaaccacctgtaccccaataactcatggaaaaataaaattaaaaaaattaaaaaataaaaaagtcacgtcctcatcttaatttgctctcctggcattttgcattttccatgctgggattccgctctggccagctctgttgaacaggctttgctggttggcagggattgtgcacacacatggtgccacctcccttagcttctctggccctgttttcttcctaacccagtgtgctgtcttcctcccatacataggtagggggttttgacgtgacttcctggacatcatgtgtagcggtcgggggagttttctctggcttctgacccagctgggtgtactgaaataactgtgaggctgcagggttctgagccggattgtgttggcacaggatggccacctctgtgccttcctcttctgctcatacaggtgcccctggggaggagggtgcagtgtgttcccctgagagctacattggttggaggagactatagcattttagaacgtcctcctggagattccgatgtgcatctccagtggagaatctggccttttgttgctgttgtttcatgccatgattactactgaagacaattttgccatatagaggagaggatgtttaaaaataaaccaaaaggatccacttagggaggtaaacatcctgggcttgccgttgccccggccgccgcttcactccagtatgcgtgtgctcgctgatggagaatgatgctcagtttcacttttattccttttgtcctctcctcttagccttcatcaccccccaccactttccccttctctctctcttcctccaaaatagggattacatagtttttttcttggtacctctggcttctagcctgaccccctccacccccagcatgtagtaggtgctcagtaaaaggtctgttcagccaatgaacgagataacaattgaacaaacacattccccacccatcctcctaaggccctgagactttattctgctcagtggcaaggaatttaatctgattaggaggctgctgacccacacaggggacgcccatttggttccaatgacactgctgaatcacttcaaagatgctatcgagttaattggggtagaataaatactaatttatggcaacctttgccagctcttccccaagggaaaatttttaaactccccatcctcttgctttgcttgaccgctgagatccagtgaaagtggcctgaacttcccatagctgagccaacagaggcacagcctcctcccccttatccccacctcaggaagccacagccacgtggaggagctcctcaggtacagccagggaggtggggcatctcaaacaggccttggctgtttcttcttaaggttcttagccagcctcctctgaatgcaagctgtggctctggggcttgtcccagtcccctgaattctcaccatggaccatgggatgcgcgtggaggacaaggtccccagggccctggaccacaccatctgagcctttctgtccccgcagggcaagtgcttcttccattattgctaatctaagatgctgtgctctgatgagacagcgttttctccccctgcgttgtgctgagttactatggcaacactttcagaagcggtgaatttgctttttcctcttaattctgaaatgctctcaggctttccaaaaatatccttatttccctgggtccaactgtgggttgaggcatgtcggacacacagaaaatagagccagctcctccaccatgtatatattacatcaagtagctcagtgcacagcaattgtttgggtaaacttttttttttaataaaaaatatttttagcatctgctctatgtcagtagatgtgctaggcaccgggattcaaagagaagttagactcaacccgtatcctacaagtgctcacagtccctaagaaaaatagacaagtacacagttaactataatgtaatgtgagtacacatctaactataagataatgtaacataacataatatattgtaatgtaatataatagaatgtactataatacatgtaatgtagtaaatataatgtaatgtaataaatattttgtcagttctaggaataaattagtgtaagaccccaatagagaaagctgttaattcaacctggagtgaggagggttaggagttggtagatctagagtttgatttctgatcaattacgtatgggctgtgccagctcagggaaatgaacatccctctctgagctccaaacctctatctcatgctgagctgttgtgaaaatgaggggacaccatgaagttacagcagccagtctcagagcagctgttactcaaaagatactgctcttccttgcccaggtgctggggtgcccagaaggggctcaggagaggaagtgagcatagatagagggacctgcaggcagcagcgtgccagcacttctgtcaaaggcagtcgcgccagcagcaaggtggccgcgtgagcacacctggcacatcagttcacagggagataggaaagccagtgtggccactgcaggggactggacctgaacccattgccatccttgggctctgggtgggaccccttttgaaagcttccactgaaccagaaagatagcacagtggtaaactgcttacaagggaggcactgcaacaaacatgaacattgctctaaaaattagtgtgcactctgggaggccaaggggagcagatcacctcaggtcgggagtttgagaccagcctgaccaacatggagaaaccccatctctaccaaaaatacaaaattagctgggcgtggtggtgggcacctataatcccagctactcgggaggctgaggcaggagaatcgcttgaacccaggaggcagaggttgctgtgagcggagatcaggccattgcactccagtctgggcagcaagagtgaaactccgcctaaaaaaaaaaaaaaaattagcatgcactcagtgtaggtcccagtgtcattgtgcctggtcacacttggagtgctgtaggcgtgccctctaccttccaccagcttaggtgctctttgagggaagaaagcagccctctttgtcctgctcaatgttagcatatgcaggtggccacttataggggttccagagagagttatgtcttctttactatgtgtgcctgtgtcctcgcctgtcaaacaagggtgacgatagtacccacctcatagggttgcgataataaaacccaatcatgcctgtaacgtgctcagcccatatctggcatatagcgggctctcaataaatattagctttcatttttatttcatccacctcattgtaaattgaagactctccagcatggaaacattagtcaaggagagtggcaagtactgatacccagtagcaaatctttcccttaactgcaccctgcgtgggcgaacagcacagaaaggctcggtagctccctgtgtgttggaaagcttaatgaaagagcagattatgttttttcagcaaaacggccagatttggaggccagttctctgcaggatgtcacctcaacgtgttgcagggctgggcaagttaatgagaaagcctttggggtttggggattggagaaggcctggatgccattcccaggtgtgtgatgtgagtgatcttaggcggggtgctccgtgcccgtccagcgggcactcactgcagattcgtgggcgctgattccagccttcagcctccctgtctgtagaaagaggcagaccccacccactgataccctctacagggagtagaaaaggatttctcacttccagatgagaccaaagctgggactctttggagctctctatttctgcctccctcaggatgagcacacggaccatgtagggagcagcagccgcttactacccctgggaggaaagcttggccacattcatcagcaaaagccgatgcacctggcttctgtgcaaagttccgcccattagctcttgtcacctttagcatgtgctgtgctccaggggctgtgctgagcaccagaggaccgtgatggttcatttaaagtgtcgacttggctgcaccctgggatgcccagattgggtgtgtccatgacagtgtttctggatgaggttagcatttcaatctatggacccagtaaagcagatgatcctctccaatgtgagtggcatcaaccagtccactgagggagaaggaaaaaggaattctccacttttatctcctgcctgcctgcttcagctgagacattggtcttctgctctcggattgggttttaccccctcagctcctctggttctcaggcctttggacttaggactgaattatgccaccagcttccctgagtctccagcttgccggtgacagatggtggggtttctcagcctccataattgtgtaagccacttcctcataataaatctcttcatatatatatgtatatatatatatatgtatatatgttattggttctgtttatgttcacatatatatgttattggttctgtttatgttcatatatatatatatatatatatatatatatatatatatatatatatatatgttattggttctgtttctctggagaacccggactaacacagatttggtagagactattgatttctataatcctggaatattgcaaagtataccgtgatactcaggcaatttgaatttagtttctggttctttggaaatatttaaactatcaaagcctcagttataatacctgtgtggtgggaagacaccacctccacctccctgtgaggcacaccatgattagccagggcaggcatgggatgtgcatgaagctggacaactggcagcccagtttggagctggcgcagtcagcctgggcaggcaggaggcttttgaaggcttcagcctcctgcactggcttcaaaggcccaggactcagaggctgacatctgaccagggacctccatgagttacttatgtaatggagttgagggccttgatgatgtggaaatgcatgccacaaaatcctgcttttttgttaagttttaaaggacctcaacatgtattattttggagaggatggctttctactttgagatcccttcttcccagcaaacaccaaccaacctttatttttacagcctggaagtttattttgatgctcttggcacagacatctccctaaggagaagtcttcaaacctgtgctcattagcatttcttccagggccttccaagaccccgtggaggaaattcacagagcatgctgttgtcctgcttccacttaatattccacatcggagagccctgccccaggaagaggggccgacttttgtactaagccaggtagatttactgaaatgcatccccagacctcacctccacttgtagccaaggctaaaccaagagcctatgaagtaggagccttgtggacaaatgagggttttccgctgtggagggcactcaggttgtgccccttggaattgtccctttttcttggtaattaaatctaggtgcctagagtcctacgttctttacctcgttgtttactttttaaataattgattgcccacctcagtgtctcatgagccaggtagccatccttcccttggatcactggagctgacctcagcccagccttccctttctggagacggttacctatcaccgcctcattcttctccttctgcaccgtctaaagttctctccttgaggaagcccatggcagataaaactggagccaggtttgtagaaatgcaagtccttagggaggaggagacacttgaagcatgtcccaggaaacccagattctgatttgaactggattgcaaaggttcatttgccagggtagatgaagtctctctctctctctcacacacacacacacacacacacacacacacacacactgcactgaccccttctactccttgctagctgagggactaaccttaggcaaatcgcttaaccctttctagaggcagtttctgcatccccttttgttaaaggcacggatagaaattaccccaccagagtcattggcagttctgaagattccaatggaaggtgtgcaggggagtagctgcatgccctgtgtcctcatggggtgcacctgcatcaccttagtttctccatccctagggtagtagggtctctgaaaggcagctaaaccactgtgagttaatgactgccacactgtaaaggtcatcgatcattgtatgcagtttgcagagaccgctgagctcactctgagcctttggtgatgtgctgagaaggggaagcaacatccaatgaggtttgtattagtccattatcatgatgctaataaggacatacctgagactgggtaatttataaaggaaagagatttaattgacttacagttccacatggctggggaggcctcaggaaacttacaatcatggcgaaaggggaagcaaacacgtttttcttcacatgatggcaggaaggagacgtgctgagcaaaagaggggaaagctcctttataaagccatgagattgtgtgagaactcactcactatcacgagaacagcagcatgggggtaactgcccccgtgatccaattaccccccaccaggtccctcccacaacacatggggatttggggagctacaattcaagatgagatttgggtggggacacagccaaaccatttcactcttcctctgttgcccatgtctcccttcaagccttcatcaccaggagtctttctcctatagtgaaatgcaagcaagccagtctcttctccactttccctggatttggtggcataaactcaagtgttctgattgccatcattgctactactgtcaccccaattaagccgtgaacacacactgccccctggggatccccagtctttggccagcttgccacagtcccagccctctctcctgaaggggttcagatggcagcctgtggacctagcctgttgccaccctgagggatggtgccactcaacctcgggaagctgggcccccttctgtggtgagtgaaagccccagatgtctcagcagaagaccagccccagggggagtgtagacagctgcagggaggtggggcacacagggtgccctgccagggctggtggacatcgccttgtgcctgtccagccctgggccttcgtcacaaaggacttttgctgaaatcaatcagcttgagcttcagcacagttctggggcatgcctgggagagccatgtgaatgtggcctcacagagaggtgaagggagacctggtgtgaagggagaagctctttttggagttgcctcttactcagactccacaatggtcatgcagggctcaagagatcctccaagtcggaatggccatcagggttaaggtgggggatatgaatggaaaggcctgggactcagggagccgtgcccacgctgttggagaatccttccgagcacttcctcaggagagttgtcgcatgttctgcaggcctgtcgaaacaccacagtgatctctgctatgggctgaggtccactgagtctcgatttgccaagcacctttgtcatatatgcagtaaaatcttggcgctgtagaaagagcttgggacgtggaggcagatgtggtttggggtccagcctgaccctgggtgcttgggcctcagctgagtctgtgcagtgggaaggccaccaccacctcccaggggccctgaggactgcatggaatggtgaacgccgggcttgccacagtgcctggctcagagcaaatgctgcagtctccttcccaggtgtgcttttgatttacttgctaatatgcataccagaaaattgttttggtggaggggatgatacggttctctaacttgtaacaaatgcacagaaccctgtgaccatgaccacaataaaaatttagaactttccatcactccaaaatatctcctcttgctgcctcttgcggtcaaccacccactacctgacacatccctgtctctgctgttgtccaccccattgttttttgcatcatccagaataccatctaaatggccttttccacatagcttcattcagtgtaacctaatgcatttgagattcacccgtgtcattgcggacatcaataacctgttcatttttatcgccaagtgggattatattgggtgaatgtagacagtttgcccatttaccagttgaaagtcattcgcgttgtttccagtgtagggcagctatgaataaagctattgtaaacatttgcacacaggtttttggtgaacaccagtttttattcctcttgggtaaatacgtaggagtgggatttctgggtcatatgataaacatatgtttaactttgtaagaactggctaaactgctttctttaaatggctgcataattgcttcccacagcaaggtacaagagttctggttgctccaatttctcatcagaaattaggaacatcaggttttttttttaagtttagccattgtgatagatgtgtagtgttatctcatagtagttttaatttacatttccctaattaatgatgatgaacaccttttcaagtgtttatttgccctctgtatatatatctcttgttcagtgacatatctcctatttagctgttcagatcttttacctatttttaaaactgggttgttttccagcctcattaaaaagtgggcaaaggacatgaacagacacttctcaaaagaagacattcatgtggccaagaaacctatgaaaaaaagttcaacctcactgatcattagagaatgcaaatcaaaaccacagtgagataccatctcacgccagtcagaatggtgattattaaaaagtcaagaaacaacagatgctggaaagtttgtaaagaaaaagaatgcttttatactgttggtgggagtgtaaattagctcaaccgttttggaagactgtgtggcagttcctcaaagatctagaagcagaaataccatttgacccagcaatcccattattggggctatacccaaaggaatatataataaattattctattaaaaagatacatgcatgtgtatgttcattgcagcactattcacaagagcaaagacatgcaatcaacccaaatgcccatcgatgatagactggataaaaaaatgtggtacatatatgccatggaatactacacagccataaaaaggaatgagatcatgtcctttgcagggacatggatggagctggaagctgttatcctcagcaaactaacacagaaacagaaaaccaagcactgaatgttatcacttacaagtgggagctgaactatgaaaacacgtggacacatgggggacactggggcctgttgggaagggtgggaagagggagagcatcagaaagaatagctaatggaggccgggcttaatacctaggtgatgggttgatctgtgcagcacaccacatggcacttgttaacctacgtaacaacaaacctgcaccttctgcacatggaccccagaacttgaaatagaagttgaaggaaaaaacaaagtgggttgttttcttattgttgagttttcagtgttctttatatattctacttataagttctttgtcagatagatgatttgtaaatagtttctttcagcctgtggcttgtcttttcattctcttaatggtgtttttcatggagaaaatgtttttaattttaataaaatccagtttgcagtgttttcttgtatggattatgcttttgatgttggatctaataactctgcctaccataagattacagacatttttctcttaacatatttttctaaacgtgttatagttttatgatttcatttaggtctaagatccattttgagttttttgtataaggcatgagttttttttttttttgctgcagctgttttgtaatttttgtgtaagagattgggttccaagttcacatattctgtctctctatatattgttgcatattgacgtccacttgttccagcatcatttgttgaaaagactatcctttttccattgaattgcctttgcaattttttcaaaaattaattggccatattatgtgcatctcatttctggaccctctatttaatgtatgcatccatccttttgctaacactacactgtcttgataactgtagctttatcgtaagtcttgaaatacagtagcatgagttcaccaaatttgttttctttttcaaaattgttttgattatgcttagtcctttgcctttgcaaataaatgtttgaatcagcttgttggcattgacaaacattcctgctgggatcttcattgggatggcattgaggttttacatcaatctggggagaattcacatcttaacaatattgagtctttgatttcatgaccatagtatttctctccatttatttagatcttctttgctatttcatcagtatgttgttttcagcattcagatcctgcacgtattttgttagatctaggctaagtattttattttttggtgttgttgtaaatggtgctttttggctaaagttcatattgtttgttgcttgagtgtggaaacacaattgatcttttaatattgaccttgtgttctatgacctttcaaaattcagttattagttatatgatgttttggaaattccttgagattttctgtatagacaatcatttcttctgcaattagagatagttttatgtcttctttatatataaggcatctctatatatatatgacttttatttctttttcttgctttattgtactggcaaaaactttcagtgtgattttgaatgggagtggtgaggttagacatcctctcgtattcctagatcgtagagggaagcattcactctttcaccattaggtataatgttagctataggttgtttggttttgttttctagatgttctttatcagatccaggaagttcccttctatttctagtttactaagagttttaaatcatgagtggatgtttacttttgtcaaatgctttttctgcatctactgatatgattgttttgtttcttcatagttctgtcagtgtggcatgaattgtaaggattgattttttttggatgttgaatatttgaatgctttgcattatcttctctatatattgctggatttaatttaccaatatctcgttgactactttttgtcttgttcaattgagatattgatccacagttttctgctcttgtaatgtctttgattttgttagcagagtaatgctgcctcattaagatgatttgggaagtgttccataaaatgagttggaaaatgttctctcctcttattttttggaacagaatgtctacaacttgtatttttcttctttatatttttggtaaattcttcaataaaatcatttggtgattttttcccagaagatttttaaccaaaaatttaacttatttaatagctataaggactgtgtggtttatctttttttcttgagtaagttttggtagtttgtgttttttaaggtattgattcatttcacctacattgtcaaacctatgggtatgcagttgtttttaattatctcagtaattccttattgtctgcccttttgctgtcagtaatatctgtggcaatatcccttttccatttctgatattggtaatttgtgttttctcccttcttgctcagcctggcgagaggtttatcattgttattgatcttttaaaagaaccagtttgtagagtcactgatttttctctattgtttctgttttcaattttattgagttttgttcttatctctattatttccttccttctgtatgctttgggtttaatttaatcttcccctcttcctaatttcttaaggtatagtttagatcaggggtgtccaacatttttgcttccctgggccacattggaagaagaagaattgccttggtccacacatgaaatacactaacactaatgatagctgatgagaaaaaaaaaatgcaggaaaatctagtaatgttttaagaaagcttatggatttgtgttgggccacattctgtcctgggatgcatgcagcccgtgggttgtgggttggacaaggttggtttagattattaaattgagacctttcttcttttctcatataaacaattagtactataaatttttctctaagcactgctttagttgcatcaatgcgtgctgataacttgtattttcacttttactcagttcagaatatttgctagtttcccttgagacttccctcttgatccatggattatttaggagtgtgtgatttagcttccaagttttgggagatttccccaatgtctttctgttattgactcctagtttaattccattatgatcagaagacatatttcataggattttgattcctttaagcttgtgaaggtttgctttatgacccaggatatggtctgtcctggtgactatttcacgtgcccatgagaagaacgtgcattctgttgtcaggtggaaggttcagtacacgtcagttagatcttgttggttgatggtgacattcaggtcttctgtgtccttgttgatttcctatttctttctataccaagagagaagtgctgaggtgtgataattttggactggattctgggtgttttgaatattatgttgtgagatgctgggggctatgggctgagttgttgccccctccctcaaccccaccattcctatgttgaaaccctaactcccaataccttagacatgagtgtatttggagatagggtctttaaagggggtgattaagttaaaatgaggtcactaggatatgccctagttcagtatgattggcatccttataagaataggaaattaggacacggacatgcacagagggaagaccatgtgaagacacagggagaaggtggccacctgcaagccaacgagagaggcctcagaagaaaacagccttaccgacaccttgatcttggacgtccaccctccaggactgtgaggatgtaaatctctgctgtttaagccacccagtctggggtactttgtatggcagccagagctaactagtacactgtgtcttgttaaaacttttagagcatcgctttgttttggcagtttgggtctggtctgaaaattctctgtcaccttctataagcagtggttgcatgtcgtttgggtgtgtcttgcaggtgcacccctcaggggttagtctcgacatggcaggggtttgcaccatagttcagttatcagagcctttactgtgctcctttgaatctcttttgtgcatgcagtttggggtgagcccaaaatatgtacaggttcacaccacaaacttagggggttcccttctccagcttcctccctctgggttcccctgacactgtctagctcccatgggcctttctgtgtaaccctctggctgcaaagcctgcgtttctgcccgctgcatcctcatgtgctgctgcagaggtctgcactgccagggcaccctgcaggcaaagcagtgagagaaaatggaagagatcaagggagcccccacactcttcagaccatggggcccttccctggcttcctctggccagcggaactgtcactgctgccatcgcaaccgtggcaacacagctcagcaactgacactgctttgagaggcaggaccaggagagaaaaaagagaaaacaagtaaaaatcggggattcccctcaaactgccagctcacaggagcctggcttctcagtcttctgtctagagagagggggtttcttctagagcttttgtgctcagtcctgggagataaaaaaggcaaaaaccccagtaagctcatgatgcctgtctttctccaggtttatcttccttccccgagccagctgttgccgccttcttgccaggggcctcggccattgcttgttggagcttgcctgggcttactctatctgtgccggcaccgcaagcattttttcatactctcctagtttcataatggtcctgtgggtcccaggcaggagttctcatgttgagacagggaacagatccagcaaaagaagtggcccagtccagcaggcagactgggctggcaccaagatcttacatctccctttgggaccccttcaggtaccacccatcccttcaggaggacctgcctgcctgttcacggtcctgcagtcctgcccgccccagctcaggaggccgctgtgccattaagagcccagcctcccagcagttcctgctgatttgtaagagtccacaaatgggaaatgaaaactcaggtgctttccaccctttgctgaccctcctgctctgtggggcttcagccctccccgtcagaggacatttatgaggggatcagcgtgtacctagccatgcaccttccatttcctttcttacgttcccagtgtaatccacataaaataaaccagacccaaaagtggaaaatggagaaaatcaaaagagaccccactctggagacaccttgagacagcaggtccagctctctgccttgggagtcatggggccaggcagcaaggatgaaacttacaatgacagttcacgagcatggaacacgtacagccgagtgctgtgagtttctgtcacgccatagcaccttaggaggtggttcctgctcttatcttcattttacagataaggaagctgaggcattggatggttagtcacttgccctcatcatacagctaaaaaggaaccacgcaggagctcagtctcatgcctgattctgcagctcttataatgaatcccaacctgtgttgcctctttctagccgaaatgtcttcaccccgtcgaaatcccatcacctttttcctctctctgtgaaagtgcacatgacaccattttatgactgtgtgtgtttcagtctatattctttttaaatgttgagcccttccgaagtcatgagtaacccttggtgtgcctaatgtctgtctatcacttcctggtcttcctggtgcaagtgggcctttggtatttgttgaatgaataatgaaaggatggatggatggtattcaaatctgtccagcctttatgtttagaccacagagaccctgcgagaatttagtgatgagagaaattatctttagaatgtttgtacactaagtggagtcttctctggaattttctgatgtgctaggtcccccagagagcctgggccacagatggtgtgttctgaagagacaaaactgaaggcgtggtcccttgtacaaattctgaaattgctgctagtttttagattagccacatattgagttgtcagatgtagcaaataaaagatgcacagttaaatttcattgtcagataaacaacaaataattatttaggataagtataggctgtgtgatatgtgggatatacttatgctaatatgtgggatatacttatgctaaaaattgtgttgtttatttgaaattcgaatttaagtaggcatcttaaattttgtttgagaattttattgaagggtttatatggcaatatttgccacacagactctcactttaggcccgtctataactgacttcagccttcttagtattgggcagggacttctgaccttagatgtcaccccatccaagccactccctagtgtgtaaggatccaagacagggcagggctggagcagggccagatctcaggtctccaggcccagagcagtgtgggagcagcacagcccactggggacatggttgtctttacccccacacaaatttaactttaaaattcatagcccaggagcatcagattctaactgttcgaggccaggttgctgcagaacgggctcagccaagacaggcactgagactgcatctaatggaggagggtctggtggcccccgtatcacaagccatcacaatcacccttctattgttttgtgtttacccatcctctgaaaggcctgctggggtcacctctgataaccacgctttgaagatttccttctgaaaccgttttccgttcctttctctgtagaggtggagcttaggggagatttatataacggtcacctccttagtaggaacaggtggaggcctaaaggccaccccactccttggagcagcatggagactgttgggaaggcagggccctctgaggcccctggaggatgctgtcccattttccacaatggcccggaccacctggaacaccccacatcgcactcagccaccccatgctacatggtgccccgacactgcggggcagggaccccaagcctggggcacccttctgaattcagagagcacttaatcccacggccacaactgattataaccatcacgcgtttggtgcactccaatgctcaaagcactgctcttaattttaggaagttcaaaaataccaaaaaataacagacactcgtatacccactgaccagaataggccatttataatatttcatcatgtttgccttgtctttccttataagaaacgactgcagatgaaatcagtctgctttgtcccatctccccctttcccagaggcagccacgatcatgaatctggcttcacaatccaagttggtacttttactaacatttgtataaatccatgcatagtacatggtcatattatgcatgcatgtttttgatttcaagaatgctatcggagtttattttgtgacttgccttttcccctagaaagcatttttcatccagtgttaagaacctcccagcagcccccttctatacggctgtctttattatttcctctgtttttaactgagaaacctctgcctcagagagattaagaagtgggcctagatcacaccacgaggcaatgttggccctggggctaaatctcatcacgccctcaggattcttgactgatggtcctaggattcattcatttaccaaatattttttgagtgtctgctctggtctaggcattggggatactgtgatactgtggaagagccctgccttcggaaaagcgtaggcagaaaatacagccttctgtcttcaacaagccaacaagtgtttttgttttctttttttgagacagggtctcgctggcacgcagactggaaagcagtggtgccatcagacctcactgcagccatgatttcctgggctcaggcgatcctcccacatcaacctccctagtagctgggaccacaagtgtgcaccaccacactccgctaattttttttatattttgtagagatggagtctcactatgttacccggactgatcttgaactcgtagcctcaagcaatcctcccatcttggcctcccaaagtgctgggattacaggcatgagtcaccgcacccggccaacaaatgtttttttgttgttgttgtttctttttttaatcttgatgtgaatatctcctccgatagggaaacaagcccccctcgccccccaggtcaccctgtgttgtcctggttgccagtgtctaactcagcaagaagagactagttttcttgttctgccctcttaagccactctgtcttctgcacagtagcttttctagggtttaaggttaggctcacgcccccaaatctgctctgagtcaaaacctcatccaagaatcccattctctgaaggccagtggccacccttgcccactggcgtgagaaaaccctgttgctcatttccagcagtggcgtgccaccagaagggcatctttaaaagtggctaaaagtagactggagctggtcgggtgggctttgagagtgacattctctcatcacctgcttccaggatgacctcagccaacacccctcattctgaccacaagccagctcctgatcaaatttttgtaacttccaaatgatggaattgagactgactttttgtttttgagtcatggaattctgctgttggaagttattgttatgtctaactcagcactttccatttagaacctattttacaaagaaaaaaaatatcaaaacaaaataaaaccaacaaacctgagacagatggatggagcaacagggctgaccagctttggagcacctctcagccgcctgtctcagcatacactagggggcacgggtggccatctgctgacaactgaaaatgagtacctggttatcgatcacacaaaaagcacatgaccagaaatgccgtgttcctgatttcctcactttagcttaagcagctggataagagatgcatgtgatactgtcctacaaggacgacagagggaaggaatattggtaatcattgcgtaactgtcttgggccatgctttcttatacatgatcttattcactgcttgcaacaatctcgctggttggactgcattctcttcattacttatagaagggaaattgaggcaagtgggtaagtaactcacccaagctccaccatatgtggcaaagcaggattcagccccaagcctttctgacaccagaacccaccctcatttcccacgctctgagacagcagaatccgtcccacactgaccatcctctttggcagttctgagctcccactacaggtgcagggcaaaggggactccccatgaggcctgtcccacggctgggagctccaggattggggtttatgaagtaccgcctgtggggagcccttctgctgatttcaagttcattaattctgcatgcttttacttgtcactttttttgtatgttaaggatggggctgagggggtttgtgatgagtagaccatatccttgccttcaagagttctctgtctaatgggaggtggacatccagttatgcacaccatcctgactcctttctggaacggaagtctggggtatggtcagcagagtgatgcccccaccaaggatgtccacgtcctaacccctagaacctgtggatggattaccgttcatggccaaaaggactttgcaggtgtgattaagttaaggattttgagatggtaggagtagcctggattagccaggggagctcaatgtcatcacaagggcccttataagagcgaggctggaagatgagagagagagattggaagatattacactactggctttgaagatggaggaaggggccatgagcccagccatgagcccaggaatgtgagcggcctctagaagctgggaaaggcgagaaaacagattgtcccctagagcctccagaaggagtgcagctctgccaacacttcgattttagtctagtgagacctctgaaactgtatgatacattagtgttgttttcagctactgtgcttgtgggaattagtcacagcagcgacaggaaactgacctgcaaagctattaaataaatacctgccgggaggcagagaagggaggggtgcagaggctggagggcatcaccctgacccgtttggcaggaatgttaggaatacaggtgccgagtgcctcctggcaggaacccatcagaagcaggtgctcaagggccacctgatggcctggttggcgggagccctacaaaaggctctgtccaggttcccttcctctttccccagtgatttggatgaaaatactcatctcattcacatttgccctaaagagaagagagagacaggacatatgcccagagagctccatagggtgggagagtggctcagatcccattcgtggagtccagggagacatctgtctgagcagccagcagcatgggcctggtgagagagaagagacaagaagcaatgagtgggaagggacaggaacgctggttaattcctgggaatctggcaggggtcgcggggggatgtgggggcagaacaatcccctgcagcccccgtcatgcccaagaggaaaaaagcacagcttctcacactgagcctgctttccaagaggccaccagcaaatgttggtggctttaccttagcctggaggccttctgttgtggacaggttgggcaaaggcaccgatgatgtcgcctggggaaggggaagcctcccattaggctggcatgtgtctgatgcacccacaccccatctgacctgcaattcttttatttacacttataattgtatttttagcataaaaaactgttgtaatattcttgtttgcattggtcattatatttaattgaaatatagtaatagaatatgttatacatataagaagtactcatataaaaatgtaccccacgaggggtgaacacagcatggtaacctgcagcccccactcagaaattgcacctggcctgccctgagccccatagcagtcctttccagtcactgcactctctaggtcaataactgccctattccatcccctcaaggacagcaccatgttaggaatataggtgccgagtgcctcctggcaggagtccatcagaagcagatgctcaagggccacctggtgacctggtaatggtcatcctttaagaggaggccactgagactcaaggcaggccagagagcttctgagcagcagctgcccaggcacgtgtgtgcctctcatgttccaggagcctgaccctgaagcccatggggctgcatgcagagccgggagtgcctgggctcacagtcagacactcgtggcactcaaccctgacaccaccacagattagtgctatggccttgacctctgcttatccacctgtaaaatggggttgcagtattagcctccaccaggattgttgagtgattgagagtattttaatgtctctagcacagcccctgaccatagcaggagctccacacagaatactgtctcatgcggtgctcggtaactgtgcatccgatgcaggcctcactgtgtcatgttcattcattcaggttcccttcaaaagaaacattgattatgggccaaataggtgtcagtgccagcccaggaatgcacatgcatattctgcctctggagagggcctgggaagcctggacatgggcctcctgggctggggcaggaaggggcctcctcttcactgctgtgtccgggatcaccccctcccttggagcaccccacctcccacctgaagtctgagcagcagagaacctttaaaaacagaaataggaagttctgattcatgaatgcaaacattctggcatcccgtgtgcagtgatgtgcggcgtgggcggtgggaattagggaacctcttctagcgtatttgttcctatccaccggaaggtatacagtgttcatactcattgactcagaaattgtgtgtcggggagtctgccctaatagataacaatgtgtgtaccatgatgcatgtacatgctaatggatgtacaaggatgttgatcagtgcatcatttatcataggaaaagtggaaattgctaaatctccaacactaggggagtggttaaactgtggcttatgttcatgatagaataatacacaattgttaaaatggaattttgatggccattttgaaacagggattaaaaaacacgtttaaatgtgttttctctctgtctctgtctctctctctcactctgtctctctctctctctgtcacacacacacacacacacacacacagaggaaaaaaagattggaaagaaaaaccatcaaaatgttagcactgattatgtggtgggatcatgattctcattttttatcctgttttatattttcttagggttctatgctaagcatatattatttttaaaattagaagaggaatgaaggcattttacaacccatatcgttatggaggagcctggcatggggggaggggaatggctggaggggttgctgtgagtcctggtgagtcaccagctagctgttgggtgagttccttgatgctttcatagtagcgtgggcatgagaatgtctgcctcaaaaggctgctgtgaacactgatttttataaattaccatcaatgataaaaccacaaaagcaaagccccattttgcaggtgcagtagagatcgtagcttcatgtggggttgtttgaccagaccacttcccttttgcagggtacatctgcccaagcccccatggccctggataattctctctctccttctttgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatggggtgaggcttggcacgtagctctgacttgctgtcggcctttggcttctcctgtgttctagaaccaggagttttgaccaggggcggcggccgtccttctggaatttctccccagcagccctgatttcaaatatcccatgttgtggtcaagctgagtcagaagacatggaagtatgggcctcctgcccctagaggcatgacggggcaaggccttcagagggcagattggggatccttgaaactacattccaggaacatgggaccagatgagacagctagttaagtttaaaacatagacatgatttgatgatcgcttgctggtggtaaataatcactcgtgtgtcttgtttttatgcaaacttatcgaacctagggcgtggggtgctggggcaagagcagccctcagaacttcagtgttcctgacccaattctggtttcacattcagtcccttggccatctagtagggccattggatgttcctagtttgactttgaaatggcacctttgccaccagacacctggtcccttccaagacccaagtgcattgggagacccagggatggggggttactggtaataggtggggtttctgggggtgttgttggtggtttttatctcctggtcggactttctcttctttttaagaagaggagaggatgtctttaagagctagatgtgccaggcagtggactcttcaggccacccacgtgagaatgctgtttcttctctgaggaatcgtggaattttaaagatgaacaagattcacatccactgaattattcaacggatgggtcagaaaggggggtgatttgcctgtggtcaccaggcaggtttgtggaggagtcggaacagaaagatgtgtcctcactctcagctcactgagctctctgccccaactaagcacttccctgaggaggttgctgagaagctgccctcaggagaatgtccaggcatcttgaaggtgggtgcgagattggcaggctgctcagatacccgtcctttacattcagtgtggataccgtgcattctcctgaagctgtgaaagtgcttctgcccaagccacttccttaaattctgaaatatcagcatctggggtcctggcaagcaaggaagcttccaagtaaaaaccagagagaagggcacacttttctttcttcattaggaaatcttattgcacaggaaccacccccacccccaccccccacaccttcccaaggcagcatcccagtgcagatagagtgggaaaggtcccagaagggggctcactcacctctaggcccagagaggctttctcctcactttatacactgcaaaaacagaagaattgtgtcaataacaccctctgtagtggagaaacttaaaaagctggttaggaagctctcgtgtatatttagagacaattacaagaaagctggacttgccgctgtggtctcaggagaaatgagtgttcttgatgacaggcaaagggacatcttagttgtccagaagcggcactcttccctggaagccgccatgttaataggattactagcctggctccagacagtgcctgctcatggctgccagttcttaccgatcacatctgtcactgccaccgtatatcatctgccagtgcatcagcttaaggggaggtcacgagtgcaaaagaacctgacccttgacaatgagggagaagggacatggaccacctgtctggaattcctggaatcactggcagggtggaggctgggctggggagttagccgcggtgtgcgtgaatggctctgtctccagcaagtctctctccatcaaaccccaggtctgccccataagcaagatctttaacagatggatgtctccatgagaaaacccaaggcgagaagcccagagccatggcggggttgcttgacgtcctcatggagtcactctgccccacatgctcaaatcttccctctggccccacatccctaggagggcctgacccctgtaaagatacaggaggcagctccctggcctccaaatggcccatggagatggcagtcgggagacagggttctgtgtttgctgcggtgaagggaggagaaggcaggaggaaaaaggatggcttctagccctgaagaggactccagcatcccaggcaccgggtgcttctggctgcagttttccctatggaggcccctcagcctccagccctaacataaatgtcggttaaattcagttttcaagcctctctcccttttcagtgtcagagcagtagatggtccagggcattggaggcctcgaccactctgcattgcagattacagtgacttcctcggggttgccccatcttggtctcctgtggtttcttcatcagctttttttttaccagcatctctcaaataacaatgaagatagatatgcccattagtgtctgattaaggagcaaaggctggatttctggccacagcgagctgcactctccctcctgcctcagccggggtccgtcttagcagtttggaaaggggaaaaagatgccggtcctcactgcttaagttttgtgtccaggtgccactagacttgcatgcacactaactccttacaatcaccacacagcatcatcgccccagtgcacagatgaggaaccagaggctcagaggagtgaagttgccttcctgaggtcacacagcatgaaagtgatgagctaggatttgaatctgggaagttgggctctagagccagactgtactgccttctgccacactgtactgccttctgtgactgggtggcacctccagggcacatttacacaaggccctgaatctgcagaggctgtttctcaagatgcccgtcatggtgtggcctgggccagctctggcttccacaggtccctgactgtcctcagagtggaacatgctcaacctcccgcccactgctctctctctgcccagatttcaggggtgccggtccccaaggcctgcccccttctttaagactgaactcaagtctccttggaaggccccggtgaagctcccagagactggttttcttgggatgcaggcagaaggggaccctccctggccaacacccaggagcccagcagaagcacccacacgtagaaagaggctcactacagccagaagtgcagagtcagagtcctgggaccatcttgttctgcaaggtgaccccaggctccccaggacaggggagagggatcgtcctcattcagactctagctggggcctctgtactggcttctccctgggtggggttgcctgttacatagctgtgcctcagagaaagggtcctgcattttctggaatgttctctgtgcttacccctctgtgtgcccctccattgctcctctacaagcaattaggtgattcaaaagagcaacttaggctgggtgcagtgactcacacccgtaatcccggcactttgggaggccgaggcgggcagggacaggagttcaagaccagcctggccaacatggtgaaaccctgtctctacaaaaaatacaaaaattaaccagacattgtggcatgtgcctgtaatcccagctactcaggaggctgacacaggagaattgcttgaaccaggaggcggaggctgcagtgagctgagattgtgccactgcactccagcctgggcaacagaacgagactctgtctcaaaaaaaaaaaaaaagaaaagaaaaaaaaaaagagcaacttactgctttgtgaggttgtgagtggccaccactgaaggtctttgagaagaggccagacgccgctgtagccaggcctgtcttaagaggacttgtgcttccagggacccaggcaggatgatggcgcagctcttcctactccaagccaatgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggctggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaattactgtcgcatttttctgtggagaaaactgaggccagggctgaacgctcacagctaaggagctgtgattcagacccagttctgtcagctctagaggcaccctgcatcatgcccaccagggtgatccccctgggatggaccatctcgggatatgaggcctcggaggctggggttgagatttggtcctgaagagcttatagccagattgccacattcaagtgtaagtccaggaaaggggcaggcggcagtgcacagggatttatcagttccagaacctcacagtgataagaggctttagagagcatctaatcgagacctttaatttttcggggagagcagctgaggccgtgtggaaaattagtggagagctgacaagtgtctgggctcctggcccaggggtccgtggtccagcacgttgtgcgttcagtgggaagcaaagggcttgcccgggattacctgccccagccccgaggtgggttgtgctccctgcagctgccatcggcccgctttgcttcgtcctggcagatgcccagtgattgtccccgagcaagtgccagggttgggctgagctgctatgacagggaggcccagggagttctgctcagggagccaaagggaacagccagatcctgaatgttctatgttcacctgccccagccccacccaccctggcccactccacaggcccctgaccatggtcactcacggagagggatggaggagaaggtggttgaactgagtactgagaacccagaggacagagcccacagcttccaagcaggaaaagggacctctctgaaaaatctggataaccagaattatcacagcaccttctcattcccagcgcgtccttctgagctcagaccttgagcatttactgggtttctttttgaggaagagggaaagtgacaaaggacaaaacaatgcaaatcttcatgactgaagacgatcaaagactccctggagcgagaaaacagttactgccagaagcagaatggaagagccaaaaagtacacaaaatggacgccataaattctgaaataaaagtgtatgatgtgttctgagtcactgtagaagtcatgcatttattatcaagatagaaaagagcagagaatgacgtggacattggtcctcggagaggctgcgtaggtggtgcggtccccgggggattctggatgctggtcttttgaccgtggcggcagcctcgcgcctgcccggatggctccatccagacatttggcaaggctgtcatctgctcttgggtcctttttcaagctgatttcctgcctccccaagaggaggtttgagccccattctgccttggaaataaatcctgacagatgtgcacagcatatttgcagggaatttgcaggcctcgattattgggggaatcagagcccattccacaccgagccccatccacgtggctgagcaacacccctgtgtcccctgtatctgtctcactggctgtctttctcccagtttcttaaagaaccacaccattactgcgtttgccgttcgaagcgttgtcccaacaatgcagatggttctgacaagggctctatatgctggcagaagggagcttccaaccttttaacttgaggaaaatgaatctctgagaggcttgagagtgttgccaggtggagcttttcaggagacaggggtcttgagcccaggacacctaactatcgagttttcactaggagacttagtggtggctttcatgaggccagtcgttctcaaggaagggctgggggccatcagcaatgtctggagacatttttgattctcacagcttggtggggactgctattggtatctcatgggtggaggccagggatgccaccgaacatcctacaatgcacagggcagccccccacaaataagaattatccagccccaaaatgccaatagtgccgaggtcaggggaccctgtgctggccatcctatctctgattctgaaactatgcatgctttccacttttccccatttgtgagtcattgagtaaattaaagctcttctgagcagcagcagtgatcatggtcactgccctgcgttcaaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgggcatgggagtgctgggtagcagcctttgagcaaatctgcatcttctcttatttctgacctttttccacgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgt

SEQ ID NO: 38445 - DNA, 27242 bp, Homo sapiens
ggcctttcctcccctgtaaggcgactgaggtgactcaggtcaccctgctccttcctcgtctcatctcgtccctcctttcctgcttagactgtgccagatgacccttcttgcaaaggggtgggcgggaaggccccccatgcagccaggcagtgcctggatttgtaactggccatcccagcagcagtgccctggatggaaagccacgtccctgtcaccctctcacatccagggcagtgcctggcagagcggggtctgataaacgccagggaacctccgattaagtgaggaggaagtgaccgtccacgctgtacccaccatgccaggcagtgggacaaaaggacctgactcaggtccaagagtcactgggcccctccggcctaactgatgggtggccagggtgcggggtccctggggatcaaaagcagctgctaagggacctcgggggacctgcttggggccagcctgaggcctgaccgggcggaactgcgtcgggtgggcttgggcctacgtcggcccaggccccactggaggccaggcccgtccgggaggcgctgcctggcgggccacgtcgccccgcgtgttgggcagggccgctaggcccaggggcggcgccgctggaggccgggcgcgcgggccctactcggcagggcctgctcggggccggcttcgggcctgcccggccgggcctgcccgcacccttccgcccggcctggccggcgccccctcgcgccccgggcgggccctgcacgtctcgcgagcagcccggagcggcgggggaggcggggcccgcgggctgccgggcagggccggggcggtgccgaggccgggccggagcggggcgaagggggccgagcggcgggccgggccgggccgggcagggccggggcgtgggccggcaggaagatggcgaacgtggggctgcagttccaggcgagcgcgggggacctcggacccacagagccggcccctgctgctgctcgggcagctgcaccacctgcaccgcgtgccctggagccacgtccgcgggaagctgcagccccgggtcaccgaggaggtgagcgggccgccggccgccatgcgacccgcgccgcggaagcccaggcccgggcggcccgcggaggccccgcctcgcccgccgcacccccgccgccgccgggccgggcccaacgaggccgggccgcctccctgaagggctcagccgccaggccagtcctcgcccgcggaggcccagccccaggccccgtcgccggtgcggcgcggtggtcctcctgtcagcccagccctgcgccccgcgaggccgcgacacctgcggacggcggggggggagacgtggccgctcccagggccgcgcgtcggccccgcctggcgacaggccctggcttccagaagttcccatggcagtgtccccagctgcctttccttggggacacctggcccctgccccctctctggtggaagccgcctaagccctatccgagtgttggaagcaaagcagcccccagcctggcccttccaggcttggtggcttcatcccaccagggggatgcgagccagcctagagacagttagctctgcagagaggcgacacatctccctaaggatgggaaaacggtggccgggagctgcgcagtgcccttccaggactgcaggagtggttgtggccgtggctgcagggcagggcctcctggcacgtggccgctgtttgaagcctctgtgtcttgtctctcccttctgatctagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtggtgagtgcttcgagaggaggcagccacggtgctcctagtcgggcagcggtgagctcgggcctggggagctcacagccctgctcagactgcagcgcacgcccagagggctgtggacgttatcatccctgctctgtagacagggaaacaggtccagagagacgcggggatttgccccagatcagttttggtggcaaatcagagactcaaacctagatttcctgaggcccactttgtgtctgtccctctgtccctcattttcatggctggtcaggctgttgacatctggtggccaatgtgttatttctcttggagcatgaccaatggtggtcccatggttccggggatgacctgagggatggggtggcggctgctgtgggacatctctgtctagatgtcacctgccagggagctgatgttccggaggcgttcaaagagcagctccctgcactccctggtggcggcccttgcacccctcacgccgtctccctatgtgccacagatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcaggtgggtgtctggaagggcagacactgcccctgggcccgggcaagatcgggcaggtgggagggaggtcgggagagggaaaagcttgttgcgggggcaggagggggttcctgcccttcccaggagctttggttcctgggaagcggcagaggcttttccaaacccaggccccctgcctctgcctcagcgtggtctgtgacttcaggattctgttgtatacaggcagtgtttgttgagcacgtaatcagtgccaggaacgtccatgctgttttccaaataaccctgcccgtttatgtgagctccgtgtgcacgtgtgtgatgtatgcacgtgtgtgtgtatgtgcgtgcacatgtgtgttgctgtgcgtgtatgagtgtatgtgcatgtgttgtatgtgtggggggtgtgtgtgtgcatgtgtgatgtgtgtgtgtgtgtggtatgtgttgctgtgtatgtttgctggtgtgtgcatgagtggtgtgtgtggtgtacgtgtggtatgtgttgctgtgtgtgtgtgtttgctggtgtgtgcatgagtggtgtgtgtgtgtggtgtgcatgtgtggtgtgtgcatgtgtggtgtgtgttgttgtgtgtgagtactggtgtgtgcatgagcagcatgtgttgctgtgtgtatgagtgctggtgtgtgcatgagtggtgtgtgtgtgtgttgtgtgtgttgctgtgtgtgtatgagtgctagtgtgtgcatgagtggtgtgtgtgtggtgtgtgtgcatgtgtgttgctgcaccctttacagggagcacttctacatgtgttatttcactcaatgctgagaatgatccttttgaggctgcaaggccggaagtgatttcccagctccagatccttggatgggcctgacatcaggctcctgtccccacggcagcggtcccagcctctgcgcctgccacctccagtccccgagcccacagcgccacccaggttgtcttttctcatgtgtcagcgctcattcttcacttctggctctggaaggctgtcgccttcacccaggcaagctctcccacatcagcacttgggccacacctcatttctttcactgtgtgctctctgaggcctgtaaccactgcccctcaacccaaattcttccatcttcaccagcatgagatagctccccttttttcccttcgtctctgagcttttaaaaaagtctaactggtttgccttgcttaatcctcttttccctcttaacccatggagacagagtttttgcccccatcctgacattgttttctaaggactgctggatggggtgttgccgtccctccttgaagtgcatctgccccatccagaggtctccctccctcccgctgctccccagactgctgccacctctcggcatccccttcatggcctctccagcgttccgacctgctcagccctctccgggtcagacaccagcatctgcctcttctctctgtctttagggattttcttctgacttccaggcctgccatccaggtgggcacgggtgcccgcagagcccaccgggggctcaagcatcacccttatttccgaggacagcagggcaccctgacctctgctgccctcagtcccttcccctcctgtggacttcctgctgtcccttagactggccacgcccactcctgctcttgctcctctgcaggggtccttccctctccagcccagcatggtctccatccagcctctgcccacattccctccccagggaggcctggccctcttggctagcaccaccctcccatttgtcagctaaaccatcactactagacatgtcacatctttgttgatctcctgtgctcctcactgggttgggagtccccagagggcagggacctggtcttgtgcacagtgatcccagcacccgaccccacacatgaaaaaggcccagtaaacatctggtgatggaaccagtgggggcagtcagtccccatggcccccgaccccattggtcccaactagctagtgtgtcctgtttcttgtctttgctctgcccagtgccgtgccttgaggtgctctcctgggctgtggcagcagtctcctggtcaccctgccacagatggcctccttccagctcctgcgtcactcgccttccaaaggcacatctgggtgtgtgcaaggtggcatcttctgagtgctgtcagctgtcaggccctgcgctgaggcaggagtgtgcacacagcacgtgctggtgcactgaattctcactacagccctgtgagatacatcctgttgtccccacgacattgagtggctcaccggggccacggcagcaaggggcagagccaggtgttaagctgcagctgccaccactcagccctcttgggtcctgagcacaccatcatctgacacccacgtggcctgtactcagcttctcccttttcttccctgcgggaaccttccagtccccacccaggaccctgtcccctctgcatcctgtggcctcatcctcttctgtagcagggactgggactgtgtactgtgagtctctgctgagcttgactcccttggacgtctctgaattctcagagtcttgcacgatgcctggcacatgtggacagaatgagtggtcctcctctcatggtaagggacacccttccccagtgcagcatggctgtgtgttggtggagggcacccgcagccctgccctccctcccacaggagcgctcttgcgtcagagccccgagctcgccgtggtctggggtcttccaggtgacacctggcctccttggaggcaagtcacacagcattgacgcacttctcagacagtccttgtcgagtccccacatgccctcacagacagagaacccgctgacaggcggcagggacggctcaggcacattcatatcagagctgtcaaggtccaggtttctacctttgaggctttggggtttaattacctcggcagggcgggggaggtggccaggctgcagtatcgacccggcgcctgctgccctgacattatgagactagaggcagggatgataaacttgctgctgtcctgcacccccgcaaaacagcgctgctcttctcttaatattgtctttctggtgagcaagggaggccgtgcaagcagccagctgtctgaagcttctgtgcctggggatgcacagtggggaacagggtggggaaggggtgcccgcagattcagctgagagagagtgaagctcccagggcagatgtgagacacacatgagaaggcaaagaatggcccaagccagggctgaaggacacatttttgggacccacgtgatgtgtgctttggtgcatgtgcccctctctgccctgccttcgagtgtgggctctgaagccctgccaggccagcagggcccatgttttcagttcctgggtggacacgtcagttccatgaggcgagacctccctctgtgtccttcccctccgtgcccagaaccgtgctgtgtcaagtgacagcactagggcagccagacccccatctgtcttgcagggtttatgagggacttgcgtgggactcatgaggaaagcaacggcccagagggaaggcgtctgggagggccagcaggttcaagcactcaggatgtagagtgcttctgcttggtggggaggatctggaaaagctactggtagatacggcctatgagaagtgcctcgaaggatgactgggatcttggtgggagggaaaggactgtgggatctgcagaggtgaggcgtgggaagctcagggcatactcaggggctggcatgagggccacctaccttcagttgtagctggaatcaggggagaaacaggacacagggcttggaaaagatccagatacagaagggcaggaccccaggctggggactcctgtatatttgtggaggcgcagggtggtggctgtgctgaaggttctttctacaggtggccggtggccctgggttgctgggggtggggcaggcagcgagagccatggtccccctctcccctctctttgctgccctgtcagtagccctgtgggtgatgtttgcctctgctgccttttgttcctgggggatggacaaggggagaacatctgcctcccacctggtccccagtgatggcctttttctccctagtgcttagcgaatgccacagacggcgtgcggctagcagcccgcatcgtggacacaccctgcaatgagatgaacaccgacaccttcctcgaggtttgtggcgtcatcaggccgggggtgggaccaggctggggtgggtgtcatagactcccaggagagccagaggaaacctggggctgtccacaccctgacgtggccagggaacctcagggctgccctcggcggagcgctgctgtctgccgggctccaggaagcctcaggaaagggtgtgtggggaggacagagcctcctcttcaaggccccttggcaggaccacagccagagctacaggaaatgagagtgtgtggagggtgagccccctcttctgggtttcatcacacgcgaagctggctcccaagcccggctccccgacgcggcacaggcagcggttcatccctggccccagcctcggcctctcctgtttccagccatcttcatgtgttgttgtgctgttgttttttccatgaacatgtccaggagattaacaaagttggaaaggagctggggatcatcccaaccatcatccgggatgaggaactgaagacgagaggatttggaggtgggtgggggctgcatccctgcagctcttggcctcgggcagtggccaggggcacttgggtggcagggggtcggcgggccacatggcacattgtcccaaacttcatcctgcttgtgacctgaaaggaatcagcctgtgtccaagcccagtgccggaccctgggaagcagccgtccctgggggagaaggggaggcaatccagattctgatttggattctggaagctgctagatccaagtccttccctgcctgcagcctctccagcgtcctcgcgtgctgcacacccttactcctgggactggctcagcagggcctttctgttccttgaatacacaagttcccatcacggcaggcagggcctgtgtgcggatggctctccctatctggaatactttcccccaagatatatttttggtggaggccatctcaaccaatgccccctcctcagagaggccttccccaagtccccagacccacctttccccactgcccaggaaccagaggggcagataagtatgactcagctgccccgtggtgcttgtagactggcaagaggaaggcggctgtctgtgttatgtgtggctacaaaacaaatcactcggaagatagcagctgaatgcagcaacacttatcccctccccgtgctgtgggttggggatcttcccctggtgcagcgtctctgcctgctgttgtcaggttgttggctggggctgcagtcatctgagggcttgcctggggctggcgatgtgcttccgggcaggctcacaacaggctgctggcaggtctcagggcctcacaggccattagctggaggcagcaggtccttgctgtttgagccaccctccgagcaaggtctctgagcgagagatagggataaagagcgagcaaacaagatggaaactcccatctttttctgtgacctaatcccaggagtgatatctcatcacttctacctttttcttttggttagaggtgagacatcaggacctgctcacatgagggggagggactgcacaaggacatgaatacccagacgtgggggccacaggggccatcctggtggtgtctacctagacaggagccatttacaagtggagggagaggccgcttgtgtcaggaaaagcttcacagaggaggtggcatttgctgtggatcttacaggatgagttggagtttgtcaggcagccatgattagctctcgtcattgttgctatgattgtttgactcaattattgcaggactttgagccatagactctgcacacgcacaggccacagctttcttgagaagatgtgtcatgtaaaccaaagaggcagtggtgcagggactgtgggagcgagtgtgaaagggcggtgcagtccctgagtgctcaaaggattcaggaagtggggacgagcatgggctggggcagccttgaggtgttatccaaacatcgtttcattctgcaatcctgttcttttctttctggaaaggatacaatatttttttcccttagtgggttttcttgcttaacaaacaacactttgcatagaatttgtttgcaatctcagacattggagctaatttgcattccccaatcccacactggccaggggcaggagaaggggcagggagcaccaggctcaggcaggcggctctccaggagaaacaccagccggccagagtttccaggggcctctgggagttccccgctcagctcagcccgagcctaacccagttctccccacgctttccataggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaaggtgaggtgcgggctggctctcagggtgccctgggggaggggaggggaaggtgaggtgcagggcccggctctcccgggtgccctgggggtggggtggggtggggtggggaggggaaggtgaggtgtgggcccggctctccagggtgccctggggttggggtggggtggggtggggaggggaaggtgaggtgccggcaggctctccagggtgccctgggggggggggaggggcccagtttgggtccagccagccctctgagaggtgtcatggggtggggggcggcgaggtttctgggggttctgggttggggtgggttcggggagagtgcgcagggcgggttcccatgtgctgaggcgacagcttcacgtggctccctgggtttcatgcccacccttcagaagggtctggaaacaaaagcctggccagggcccaagagcagccccggaaatgacggaagaaatggcaagcagggccagggaggcagggcttgctgcttgggggctttgtcccgagaagagaagggcaaggggacgcctgtgtctctgagtctgcccatggtccccactgagaaaacgctcagagtggccacacaagaccctccaaaggcacgtgacccccaagagcgaggggaatctgggcacggcacagaagcgagtcacccgggaacatcccggtgcggtggccctagaagcctgtcccgtggtacggctttctgtcctgccatcccaggaggacaggtgcttgtggagcccccgtcgtggccgagtctgcccgccccagcaagccctgccctcctccgcaccatctccatccattcatcctacacaccgtgtgagcagcctctgtgctcaggcctgggctgggaaggacagggagggagcagactgggaagtacatacctcaggaggtctggaaggagcagggagtgcatccgcagcagacactgcaaactagcagcctgcaaggctcacggaggcctggcatttttaaaatttgaattagctaccaatatttgaaaccaggaaggattctcatcaaagcctggatttccggccttttgtgcactcagaaggtctgccagtgctggcgttctgttcccgcctggcagcattcccctgcagccagtgggcctgcccctggtgtcacccattctccagtttggtttgcggtaggccccaccacttgctgctgccttcctgacactgagccctagtgtcagctgctgttcagggtggcgctggtgcagctcgccgcgctctctagcacgcctagtttatttcatacctggagaggatgagcagttcccatccctcctctaaaccacaaaactgtttagaactaagcagaaaatgacactaatcataaaaagggttttttgtttttttttaatagaaaaaacatgcctccctatgggtctcttggggtaatagatggtggaatgaatgtttgtttctggctttgggtcttagcatctacacgtttgacaatggtttcatttaaattgatcttctttactaatgtatgttcagtaggcagagttgccagctgtcttcactcatagttggtccaagaatactatctgttaactttgattttgaagagctccaatctcgtgaggcaacagatacacagatacttaggaaaagtctttaatacggtatcatttggcagagattcttaaaaatcccatttcacagtaaattccagcaatcacaacacccactgtgtgttcagttcttcagggtggattcttgtggctttcagatgtctgcagaacaaaagcattttggacacagtaactccaagtgttcacatggaatgagggaagtgaaggaacgcaggttccgcgtcttcgttttgaccatcccgcactctcgtgttttattttgggtcctctgtttcgacaccgggaggtaggaaatcatgggccctggaggccccgactgtgcccagagccagcccacaggatctgactgtcagagcgattctcagaaggaatgtgggtagtagattttgtgtcgggtcattgctaacgtccatgtaatgttactttcaggataagtaacaacgatatgcgaatttgaagcttttgtttgtgtgattaaaacgcaaccgtagccacagcaattttttaaacttcaatcaacaacagattttcggaggaggaatatgttattgctgactttgttcagagataccggcacacggtggtaataagcaaactgacttctagtcggttatgattcctaaattcgccacagatagtgcaccccctactgcctgcacctggtactggctgctcccaccctcgcacgcaccctcaatacccacggtcaccctggaagccgctacattctggctggtagagtcgtggaccctcttctccttggatcagatgcttgtttttgatgtcggcttgttgtggaccaatgtgagaagatgagcttcctgggaattcattcgtttgcttgtggcactaactctagtcacttagggaaaatatcgttgcacctgacttcatctcatgtggctgtgggtagacctgtgcagttagtcagctcccggcctggaaattaacacaaaggaaaaacctgaccacacaggccttccctagaggccacagctgcacagccttcagggaagctgtggtctgagggtggctggtagaactgccagagagtagggcattttccatggctccagatcaccttctgaaaatgcgactatagcccctgcctattcccggggtccacctggtctgcagaccccataataccaggaagagctgggtgttctggcaccagtgaaacaatacctggttttttattttaaaccagcccatcttccccgctgcagttggaaccgttctacgtggatttgggatcaaccagcaggcctttcctgagctgttactgtgtggagtgggcgctgaggctccagccattgatgcaaagaccccaatcctgacctgaaggcgctcacaatctctccccaacggcctggtgtgaaacgcagacgcaacgcagcaggcattctccccagtggctgcctgtagagcaaatggtgcagaaatggtcactcctcaaaaagcaagccggctggagccagcccagctcccagttttgcaagaaaaaaaaaatcacagctccattttcaaagatttcaagggcagctcaagaccagcctggactagcaggcctcaaatgcattactggagacccctttacgctcttaacaagtaccgaccccaaagaggctttttgtataacaatgtctattgatatttactctactggaaattaaaagtgagaaatttataacatgtataattcattaaaaataacatataaatccattgcatgttatcataaataattttatgaagataagcatcttccaaaatgaaaaaataatttactgagagagtagcattgttgtacattttcacaaatcctgtcagtgtctggcttaatagaagacagctagggaccttgcgtctgcttccgatgtagtctatggaaatgtgttgtttcagttgaactgtatcaagaaaatctggcctcacgcattttatagttgaaacagggaaaaggattttagtacctttttcagctaactaactatgaacattctttgctactacaccaaaactcaacaagtggtagcttcttaaaggctggttataacatggaatctgaagcctcatgaatagacttttgggctctgtggcagttaaatccgctgttctctctcactttgaacatgtggtttttcatggaaaaatgaatgttcacttgaaaaatgttggttcacagagttctgcagaaattcaaatttttgacacattacattatatagtatcaaaaaatcacttaatatcaccatccatctcatcagaaaactcattatgaggaagttgtcatggtgataggagaaagtttttcaaaattctgatttttgcttaaaagctcaaatgtataccattggcaataaataatgtcagctgtttctggaagtaagaggctcagtttgttccttttctgggaaatatctgccagatacctaaatccaattaaatgccatttgtctgtcagtttttctttcaagtaaagatggtgtcgtggccagagtggctcatggagctcagaactcccccagcaatcacagctgagcttctgctctgaccgaccactgcccgtcagcaacagcaggagtacattatgagtcacacggaatatggaaaatgtattgtacccaagggttgagagttttaaaaattaattttactgcttcagcaaggaaattctaacgtgaaattggcattggttcattttcccagagggcacggaaacgaatacagtggctcccggacctctttgggactgtggcctgatactccagcacagggggtgtaagtgtcagccccgtgaaaaaggcagagaccgtcttaaatcactgcgaaaatggtttcttctataaaaacagaaacaacatatgggggctggtgaaactttgcacaatcaatcagttgagctgtatttgcaagcccagtcctggctccacctgcaattgggaaggagctggcagctgtgacgggggagacatggtgtacagtgagcagccgtttccaggcattgctgtgtgacccattttgcacatggtttgattccagatcggaggccctgtttttccatttaaacaatcctgtgctttctcaaacagattagctcagaagagatggcttattttcagtagtacaagatgggtcattttcactcaattataaaagcagctcaatttacatctaaaaatactttgcactaaaattcaaagcttgtgtaataagataagggttcaaaaatgattcagtaaatttcatacccaaacctttacctctgaggacctgctgttaatttaaaatatgaacttgtgaatttgatttgggaacctgtaaaatgtaaaaatgtgtaacactgtcaaccagcgtataggaaacagtgtggacactgcaggagaagggtggcccctctttagacccaggttaaccaggaggtgtgaactattaaccaggaggtgtgaactagcaggagggcagaggtggccccttcttctggcgatagacctggcagtgacatgaaggagcgacaggtgtcctcactgctggtggtgtcagtgggggtggatgtgactgattttggcgaagagttcacatcaaccctcaccatcattcaaggttgtgatgaggggcagagaatgctgagcctaagtctcgttaggtggtaaagccctctaagtgccagggagaggaagctaggccctgttctggggggcgacaggtggccagggcaggtttgcattgcggcagcagcccctcaggcttcctccctgccataagcacactaggaatctgcaatgggtgcaggaagcacgcaagcccacccaggtccctgaggtgctggccagggacctccagcaagccccagaggctccctggacctcagcttccttctcacgctgtgcggaggagtggagagagtggccctgcagacagacccccaggcggcgtggcagcccgggactgaggtcagggtgcccggcgtcaaagcacggggtccctgtttcaatgtcagagcccggccacagcgaattctgcagctccgggcatctcctcgggttccccctccgtgcagttactgtttgataaccccaaagttctgtcaaaacaaaagggagcctcaccatctatggccatgactccctgttgcttctggagaacaccccacttggccaatatgaggttcatgagttctgtgggtgcccaggaggcctggtgtgggggctgcccaggcctgagagctggggaaggtggggctagcgtggggccgggtgggggtggggggcttccgctgccaggcctggacctcacagctcacctttgtcctggtccctttgtaccacccgcagactaccatgccggggatgaagcgagactgcgggggtgctgcggccgtcctgggggccttcagagccgcaatcaagcaggtgagtgggccctgcccgccctctgcaggggcatcctgggtgtgcctcgtgggtgctcccctctcccctgtccgtcccgccacaggccccaccagggtcctacccgagtctccccagcggatgcttgtcccccctctgcccccaggctcttctggggcccccagagcttcccgccttcatcagagctgctctgggaggccccgagggcaaggtgcagccatgttctctgctcagggcctgccttggctccagagccccatgagcggttggctcaatgaggaagcctggcctagaccctcatggcatgtggcaggcagaagctcatggcaggggcacacgttgttctgcgtacccctcccgcaacccttctttgcagcagagctgcctctggtgactggtctcaccaagtcaccacctccaacccccaggcctggccaggcccccttcctctcttgcgtgggcaggtgccccaatgcttagcccttgctcagtggcagtagtcactcggggggcgtggggggggtggggggtgaccttgagtgaccttcccatggagcccagatgtccctggggccataaaaagtgcttattaaacaaatgaagaggccagctcatgctggtaatcccagaactttgggaggcggaggcaggaggatggcttgaaagccagaaattcaagactacccatagcaaccttgcaagaccccgtttctataaaaaaaaatttaaaaactagccaggcgtggtggcgcgcacctgtagtctcagctacttgggaggctgaggtggcggaggatcgattgagcccgggaggttgaggctgcagtgagctaagatcccactgctgcactgcagcctgggagatagagcgagaccctgtctaaagaaacaggccaatgaggagtgtgcattgactcatcagccgaggttttaccttcctagcctacctttctcaggccagcaacccagttccttggggtaaacttgaaatggaaaaacaaaaaggccttggcaagtagtttccaatctggagggtcctgctcctggccgtgagggaggaggaggaatcccaggaggaaggagctccttctgccggggcttcccagctggccgtgcacattccagactgtgtgacgggcttctgctaccaggcccagccggtggggacacggaggtgcggggctgaggcggcctgggcaggaggggctggcaggccctcacctgtgctctgcacgggtttggaaacggcctcttagggctcacggctgtttctctcgtgctgagcacacagctggggctgtacgcagcctgcaagccccatgcctccatgagcacctgccgtggcccgtccactgcagagcctgtcggaagaggctggaggaggagcatgtgtcctctgtgcgctactccttcactggttataaactaccaagggacacggctggcactcaaggagggtcttgactgccccagcatcataggccacggggcagggtggctctgggctcccactacctggccctcctccttgcctctgcccaggccccgtggctttggcagatgggctcaccagaagaatgctgaggcggacgggcccagctgtgcggtgctcgctgggcagctctctctgaagggagcagttgctgctctggggtggcacgggggcaggggtgggcaagtggttctggaggagccgtgtggccagccctctgtggccgtctttgccgttcacccctggttactcctccaacagagggtctgtcctgcctctgggacaggctggctgggaatgccccagcaggaagactcttctgagcttgaattccctgttcacaggaagccacttgacaaatgatcacagattcatcaggcagcagccgtgagtgttctcagcactcctccacctctagaggtgctgcggcctctagaggtggaggagcacctctagatttgaggggtgctgaggacaccccacccccactctggacaaagatccccctcccacaagagctccagcctggaggctccactgtgaacgcgaatgtcctgcttggccttcacatatccttgttggcctcttagaaaggaatacgcctctgtctgagccacagaatcaatcctcagggtaatgcatttacccagagaataaaatcagcatccacgtgtccacactggtaggaatagatcactgaaggaataaatgaatgggggagaaccgtttctcacactgaatcccagtttcaggctgcagaggtagtgatggaaacaggaagtcgtcaccccacagccaggcttcattccaggtgagagtggcccacagtgctggaactggagcatgagagtgggatgggaagaggacagtcaaatgctctcagagtgcctctcgcagctttatagtggtgacactcacaacccagcctaaccaggtgtcccagggcatgtcaccagggcagggacagagccacctgacatgcctccagaggcagtgtacagggaaggacagagcatttctgcaggattcccaccaaaaatgcatggcctgcctgtagtcacaaggacacgtcagacaaacccagcactgaaagtgccaaggccacaaaagacaaagccagactatgcagtcgcccagattaaggagggcaagcaggccaggcttgatgtgtggtctgatctgatctggacgtctgaggagcacatggaatctggatggtcccgagaggtgatggtcctgtgttggtgattactaccccctgctgcccattgtcccatggctggacaagatgctgacattggcagaatctgggtgaagggtgttgaggaattgtttgtggcttttttttttttttttttttccccgagatggtgtcttgctctgttgcccaggctggtgtgcagtggtgcgatctcggctcactgcaacgcctcccaggtttaagtgattctcctgcctcagcctccagagtagctgagattacaggcatgtgccaccacccttggctaatttttgtatttttagtagagacagggtttcaccttgttggccaggctggtcttgaactcctgacctcaagtgatccgcccacctcagcctcccaaagtgctgggattctggcatgggccactgctcctggctgtttgtgactatttctgcaatttttttgtaagtttgaaattatttcacagtgaaatgttttgaactttttagaaagaggatgtaccattcaaagatggaagggtacgccaggagctcggtggccctgggctctgggggtgttagcgaccctccaagcctggcaccaaaaaaaaaagcccctgacccacttaccaacccaaaacccttggccgccctgggggaccaggcccaagccctggcgtagcactggagacccttcccacgctgtcgctgaagcactcacagtccagccccatctttggccaccctcttctgttagaccagcaagtcccaactgtgccaggtaacacccaggaagtgtgtgaacattgacagctccagggctcacctccagctctgctgagtcttggattttttcagccgctcctggtgattggagaacacctccagactggccgtgagggccgcaagggcagggccgtgcctgtgctgtctctgtctcacgtcttccagccgtgcagacctcagcactgtttgccccaggactgcagctcgctcgtcttctaagccagcacttctcaagtggggtccccatgttgttagtaatatgggttctcagctctgccccagacctgctggatcagaaattaggggcagggcccagccttcagcgggtagcagccctccctgggaggctgaaagcatccatttgggaatcctcctcctccccgctcctccctcctccccccccgcctcctctcctcctcctcctccccccctcctccccctctcctcctcctccccacgccccagcaggctacagatccagaactctgctttctaggaggacttcagggctcccctcctttgttggtggagctcatctctgtggcgtccatggcctggagccccatggcctcatcctgtgacctcagggtcatgctgtcatttattcgttgttcctaaacacccacttctccctggaatgaccacaggaggcctcagcacagggacaggccgtggtcactgtacacacagatggaatgtcagtgctggggtatctggggaggagctctgagaggaggaggctgagggtcctgaagcccctgccccgtgtccctgacacaggctgggctgcgagagtgggagcgggggacttggggcccttgtggagctgacaggtggctccgatatcatcaccctgaggctggtggggttctttcccctgtgctgcgtgggggtgcggggccatctgtgaggctcaaggactgagcggggacccagggaggtctcagggactcgcagctgccatgcccagcaccactgctgcagctcctgccactggccactccttgccctgctggctgcccctgccccaccatcccaagtgtttgcctttggtgagggctctgcacccgtggtggaagagtcggctgttccaggagatgagaaagacgctggatcctatagagctgtgtgtccgcgctctcgaggcatgctccatgctaggaggatgtattctggttaaagattcgtctgcgggagcagaggaagggcagggacaggggtctgggagctctactccatttgacattgctgcccgggtgtggcccgcttcggggtcagggggcacccttagaacctgtgcagggcaggaactgccaccatctgttggccacacatttctcagtgaacaaatgacttttggcatcagaaagccataacttcacacctaaacttccacgaggctgagctcttcctgcccctctgtgtgtgtacgtgtgtgtgtgtgtgtattgaggggacgcggctgctggccaccttctgtcggcacaggttggcgaggcttcatgactgcccagcccatgcagtccaagagtcccacagcccagcccatgcccaggctcatccactgcggcgggtggcctctgccaggggaggctaggaaaccccagtggtgagccttggccttgggatctgccaggactgtacccgggatggcagggagggcgagctttggtccctgcaacttggagccatctctctctctcctgctgtctgtgggtctgagaacccccagctcgtcctcccccctccccaaacctatgacctacaactggagcctctgcccacttctccctccagggtttcaaagacaacctccacgctgtgttctgcttggctgagaactcggtggggcccaatgcgacaaggccagatgacatccacctgctgtactcagggaagtacgtctggccctcccactccttcctgcccactgttggaactcgcgacccttcccggcctgcaatgccagctcactccaggcatatcgggagggcactcagcgttggggtcccctgggcagcaggctccttgcttcccggagggctggggagctttggtagcaggcgcacctcacgttgaggggcccatggcacctggatgaggtgctaggctcccgtgcagtgcctggcccaggagctcgtggtctaccctgcattaccaggacaggtctttccaaaatttaggcctgaaatctttgggtgtgtgaagctctgacccccagattccctgctcggggacacctcctgcatctcccccttgagattgaccctggaaagtcaaagctgagctggcagctgaggagcaagtggctccagaattcaaaagagaagagccctctccccagccccatgagctggtgcctgagtgggcgcctccccgcatctcctgctcttcctccccatctgccgggtgccaggcacagtgtgctgaaggccagcccagccggttcatgccacccactttacagaagaagaaactgaggcatgggagagccaaatggctggtctctggctctccagagcagcggggcagggatgtcacctggaagccctttgctccaggcactgcattgctgtagggactgggggcatcccggccttcccattcagggaacgtgttggggttcggggagccacagggatgggcagctccaaatggggtctccccagtttcaaaggggctcatgccagtgtcccaggaaatcccgtccctgagcggggatctctaccatgccccaggacggtggaaatcaacaacacggatgccgagggcaggctggtgctggcagatggcgtgtcctatgcttgcaaggacctgggggccgacatcatcctggacatggccaccctgaccggggctcaggtgagtgctccctggatccaccccttagctgtagtcccagggaaccccaccccactcttgacctcaaggtggggaaggcagcgcgtgggggctgccgtcaggaagttttcataactgggcacgaggaggcaggaggagctgcccgtcaagcttggtgtgggcagtaccgaggcccaggctggatgcagagccgggaaccgcctcctgtgtgcttcatggccatggtcctttctgcctgtgttttttctttttttctcaaccgtctcttttctggctcccttatttctctgtctgcctcccggtccctcttttgccttgggtgtttctctcctgccgtcccgtccacacgcttcccgggttcctgcccgcccagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggtaggtttggagcctcgaacctggagcctgccacatgggtggagccgggcaggcggagccctgccttcagggtgctggtgcacccagggagctggggccccccagaagcagccacagtgcagacgagggcttgagaggcaggcgtcagggcacaggagtcatcccagacagcgtgggccactcactggcttccctgccacacagccaagggtttctcccccagtcttgggtctggctcagttgccccatcaggccctttgctggcttcccccttggcctatggtgggggcagactccttagctcatggtcaaggccctcccagcccagcttctgctgcctccccacacgctccctcccagccaccccgagctccttgcagacagcaatagtgacaggcgatggggcagggtggagagggcccggccggagcaacccacaggcactgtgtcctcctggcctccctaggaccgagacaacagccccagctcctgtgctggcctcttcatcgcctcacacatcggcttcgactggcccggagtctgggtccacctggacattgctgcaccggtgcatgctgtgagtgtctcccctccccactggccctggctgctcccgcccgcttgtccaaacagcgcccctctggctctggagctgctggcagagctcatcagaaacttctgtctgtgacccagcttccagcccgctgtccccaccacccccaggtctcatcctccctgggaacagagtggctgctgtgtgcgacccttccccagccagcctgtcctccataggggatcctgggccctgtctcacccatccccaccctgaggagctcccggggtgaaggcagagcacacagggccttgccccctgcctacgcctggcctgccagccctgaacgtgtccagccagcagcatggaaggctctgggctccggctggtgctcaggatctccttcctgagaaggggactgtggggcacgtggaggggacccaggaggtgaggggtccccaggaacccctcctgtgctgcagccccacgcccagagtctgtgtcctgccctttgcttgcagggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcctgtgcagggcacctgcgtggctgacagccaggctcttactccagccggggctgccagcgcatccagccagcccagccctgtgaaagatggagctgacttgctgcaggggacctgatttatagggcaagagaagtcacactccggcctctcagaattcacttgaggttcaattaaatacagtcacaccgccccctcacctggcctcgttcttctttctccccctccattttagaaacgggtcctggagcccatctagggaatgtagtgcagggctgcctcctgcttctcccagaccggctctggctttgagccccagctggtcaacccagtgttgatgacaggagcccaggacctggggaggacagggggccgctgggcctaggcctggccttcctgaccattttgattttctgggtgcacacagcacagactccaggtggaagtgctgtgggctcctgaactctctacagcccggcagcctgcacggaggccgttctgtctctcgagggtcctggagcctgcgctgtgtgaggtcgactgtgcttccgtgcccctgggcactgtcctaggtgataaagggcagggccccgaagccaattcggatctcccgggagccccgccaggattcagggaacccctgaacctgggctccaggaaaagcaggtgaggcgggtccaaggcacccaggagccaggctcccactggcttgggtgacagtacaggccaggaccttgtccctgccatacatcccctttgctgtcagtcgcagcagggctgcctggggccccccaggaagggattgggtctgaggccccacagggaaggggacagtgcccacctctcttcagctagggccgagggtgaggacctggctgcagatctgtgggacacgtggccctaggctgtgtcctgagcccctggccaccccaccccaagggtccccagaatccatgtgcccccacagccctggaaatcaaggtgactttctgggcctgatcgcaagcaaatatttattaactgcctgctgtgtacacagccccggctgggcctgaaaaggcaagaactggctccaaggtcctggccctgtctgaggaaactgtcacccaacacaatgacagcaattgtgggcagcagccggggagacggagccggagctcctgagcaggggcggctgcagccggggttaggagccttcacgggtcattagcttgcttaatggtgctgcagtaggccccgcttgccggcctcccctgagacacccagaagaggcagaggtcccgaggtggctggctccttctccagggcagctggcaccgtctgctcctgctaccaggggtgcgcccgcatggacacaggatgcagggtcagggagcaggggaggaactgagtctcccttgtgcaggcacaaaggcggcctcaggaccagggacccagctgggcaccagctgctggctggcctggcctgcctgccggcgtcggggggcccacgggggtgagccagaggcctggctttccctggggccaaagggctctaggaggcaacggctgcttccccaggccccaccagagccctggcaacagggtcatggggcggctggcggtgctggggggcaggtgggtgctctgggtccacttgatcatggtttccggggagcagtgcaggaagacgagcttggtgcagagcccccacaggcaggctagcgcacagccccaaggaagtgctcccagatgaacttggccgagagcatcaccatggccacgccaagtaggcggggctaggaccccacccacaccccctccctggaatcccagggcccacctgggtgatgttatcccagagacagggacaagagatgagaggatggaaatgtctctgggaaaaaggctgcaggagctggaggtgatgagcagagcaggcgaaggaaagggaggcccctcctccctccatgttagagaagggagccctagatctggccaccagcggcctgtgcacacctggggctgagggcacacagggctgcacatacacactcaaggccactgtgagaacaggtgagcagggccagagggctatggaaagcccggctgaaggctgcacctccaggctgaagagagctttaccggcatccgccaggaagcctgggctctggggctgtgtcattgtagatgaccatttccaggtcgtggccacagccccggttctggtcacagctgggccaccaatcctcctgcgccacccaccacttagccatcgggccgtcttcagggcatcggccggcctcagctgctgcagccagaccctggcgttgcggaaggctggccagtccacatcctgcagcctacgagggtgcgctgtgtgaggggtacaggccccggcctgggagaggacccagatgcaggcccccagaactgatggaaaatctctccccagaggtcaggtctttgtcagcaaaggtgggaaaccaggggagcggcggcaccaggctccagagacatttgaaatgacttcagaagacccagggccactcagggtgaccacatcggacagctgcctcccacaggctgtgacggatgtttaagcaagggatcgatggtcacctgactctcaggagtgcaggagaggccactgagacccattcagaaggtactgggtgttggtccctgtggactcggcctctggctggtggtgaggaggaggatttctcaccacccatcctctggcccctgctgcccaagggagcagactcctgtgagctgggttccgggaagtccatctccagcaggaactccaggccaagcgcgcatctctgtgatcgtgtgtcaccatggcggtgcgtgcgtgagtgcatgcgtgtgcactggtctgtggcctgtggtgcgtgagttccactaggacccatgtgaggtggagggtcttccacctcccctcccattcgggccctccctgtgccacacagacacccatctgtgccttccccttctgtgccaccaaaaatggaagagatagacacttaaaagaagcaactcaaatggaatgaaatcgtttctgttggggaatgctcaagacgttcaatcatcttagaaaatcccaccccacctcccgctgcagattaattactgtaagtgcaactccaatcgggctggtgaccccccaggaaacctctgaagctgtcccaggctgttcccaacatgggacctccactctggcacaccaggacccgaggcccctgacaggctcctcgttcctgcctcgctcaaggctcaggtcccccacctgaaatactccctcccaccagcatctcctgcctcgctcctgctgccaggtccccaaaagctcttgttcatgagctcgcctgccatccacagcccccaccagaacccaagtggctgtggaattcgctgccctgattctctgcccagagcctcggtccagactgtgttccctggcgaattagtgttcagcatttttgtttatttgtttgttctttaacaaaagttgttttggtttgagattcagcaaaaatacacactgcattcagcttcctctccattcaggattcagtaaattggttgttttcctgtctgcttcg

SEQ ID NO: 38446 - DNA, 21395 bp, Homo sapiens
cgccaacctcggcttctcgccgctaacggcatcgagtctggacgccccgtgacccgcctgggccggagcgggggcggacggcgccttcttggccctttctgcctctagcagcggcgccggggtagccggagccagcgactgggaaacggctgcattccactgcgtctccttggcctggctgggcggtcggaggctgatctgccaagtaagtcccggctgggcaggcggagcgtcaggcccgggggagggtcctagggccttttgctgcagattcagggacacgtgtgagcaccggggcctgggttggggaggagggtgttgggaaagcgccaggcctcctgcaggccagccgcggagggggcagctaggatctgtgagcttggtcatcttcctgggaacgtgacctcgctcccttgtcaccttgcaggattactgtttggagaccgctgcagcccacgtccacctgatagactatttactacacatagtaggttcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagatttttgtgagggaagagaatgttaaagctgccctcattgaggttggtgaaggtgtgaatctgagcaccatcccccgtgaattcccaggaaggggtggtgtctggagagtggtctgtagagaccctacccaggatgccgagtttttaaaaaatctgaatgaattcctggatgccgaggggcgcacctgggaggatgtggtccgcctgctccagctcaaccaccccaccctgtcccagaaccagcatcagcccccagagaactgggcagaagctctgggggtgcttctgggagcagtggtgcagatcatcttctgcatggatgccgagatccgcagccgggaggaagccagggcccaggaggccgctgaattcgaggagatggcagcctgggctttagcagcagggaggaaggtgaagaaagaaccggggcttgcagcagaggtgggttctgccttaaaggcagagacccccaacaactggaatgccacggaagaccagcatgagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaaggtgagcttgggccctgtctcctacgtcttggttgactcagaagatggcaggaagaagccggtgatgccaaagaaagggccaggctcaagaagggaggcatcagatcagaaggcccctcggggccagcagcctgccgaggcaacagcctcaacctctaggggtccgaaggccaagccagaaggctctcctcggcgtgccaccaatggtgagaatgatagcagaagtgactgggctcgtgccagcaagtggatgaggcaggaggagcaggagtggcaggtggggcagaggagcccgaggaggtggtgggtcaagcgggtgatgaggaggaccctggtgcatggcaggaggtggatgacacaccagttgaggagggtaagagcccagaccgcccttccaggagcccctgaaggccgatgctggagacatctggtgggcaggaggtggcagaggaaacccacaatgagtgtcactgtggtcatttgccactccatctgacccatcttccttgatgagaatttaatggtttgggcccaggcttggtggctcatgcctgtaatcccagcactttgggaagccaaggtgggcagatcgcctgaggtcaggagttcaagaccagcctggccaacatggtgaaaccccgtctctactaaaaatacaaaaaattagccgggtgtggtgccacatacctgtaatcccagctactcgggaggctgaggcaggagaatctcttgaacccgggaggtggaggttgcagtgagcctagattgtgccactgccctccagcctgggtgacgagagtgagactcttgtctccaaaaaaaaaaaaaagaatttaatgatttgggaggccaaggcagacagatcacctgaggtcaggagttcgagaccagcctggccaacatggtgaaaccccatctctactaaaaatacaaaaattagctgggcatggtggtttgtgcctgtaatcccagctactggggaggccaaggcctgggattggcctccagacatctgcccaccagatgtctccagcatcggccttcaggggctcctggaagggcggtctgggctcttaccctccctgaacctgggaggtggaggttgcagggagccaagatcacactgctgcactccagcctgggcgatagagtgaaaccctgttcccccctccccccaaaaaaaatattaatactttggagttatggtgtttgcagggtatgtggctttaagggtgaagttttctagagacctggctggggaatagaaatgttcagggacccagaaatttcttggaagtaatgcatttcctaatgacacctctctgcttcccttcttgatctgttctctcatttatttgcagaatccagaaaggtttgatctgggggaccacccatactgaggagttgaaagaacaaggaagaagtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctctcgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgattatagggaaggacgcaggcattcctaggtccccagctctaattccatccatctacccaactgtcaccatctttgcaccaaactgtcaccatctttgcagcagaaggtcactactcacattatagtaagaggggaaaaaaatcttttaaaacttggctgttggccgggcacggtggctcacgcctgtaatcccagcactttgggaggctgaggcaggtcgatcacgaggtcaggcgtttaagaccagcttgaccaacatggtgaaaccccatctctacaaaaattagctgggcgtggtggcgcgcgcctgtaatcccagctactcaggaggctgaggcagatgaattgcttgaatccaggaggcagaggttgcaatgagccgagattgtgccacggcactccagcctgggcagcagagtgagactctctctcaaaaaaacaaaacttggctgttaatgtctgccctctgaattcagacacactatattagaccagaccaccatgtgtcattgtgtgtgtgtgtgtgtgtgtttgcgtgcgcatgtgtagaggagagagcagggtccctgagataatggtttccaaactgtatcgtagccgtccacaaagatgtaatccaaatctatttttctcacgtgtttaaaaaactgaaaagtgactactcagatatgttggaagtcacatcgaagactatcagaatattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttcctttcgtcattcacatgctcttgttctgccgtgactgttcaggtgtatggtagtaagtaaatgtattaacatggtgaacagtagtaatattctatcatagagtattagcccttgcaagttttcagggcgtcttttccgacttcagtttttgtgataaagaatgtgaacagttgttagatgttctcagtgattcaactttaaaacaaatttctcgtgatgattcatttcaaaatcctgagtgagtctgactgaaaaatacgagagaaaagagagtggtttccgtttgcagctacacagctgtgtgcatcgacgttctcctggggtgtgtgccaagcgaaacccaggggtgaattggattcttgaagagaccaaagcctgtaactgtccagcttctaatttcaaaacgggtccattagggcttcgttgtgttaacaagttgacaccatgactagtaaatgtaaacgtgtatgtataaaataaagtttagcaaattaagtgtcctgttaagtctcttgtaggtgaggattgcatggactattaaatttgaggaaagggttcccctttcctcaaacagtgcccccagccagatgtgactggttatcagatacgggttcaagctttgagaattgttaatgatccatgagagaagaagccgtttgtcctctttgcgaatggctttccactgatgtggaaggatgtcccacagatcttggggtttctagaataggtatctggtgacgcaaattacctcaaagtaccagtttatttttttataaacagctggaaaatgaaaacctttccctcccttcctattccctcacacagaagccaaggtctttttttttttttttttttgagatggagtttcgctctgtcacccaggtgggagtgcagtggcacagtctcagcccactgcagcctctacctcctgggctcaagtgatctgcccacctcggcctcccaaagcgttgggattacaggtgtaagccaccatgccaagccagaagctgaggtcttttagctaaaaatatagttttcttctggccctcccctgcccctccccaggaactcctgaaccagggtggccactacatcagtcacttggaatctgttcaaggtaccatttcgtggctctacctgctgattcaggatctcttcggggttgtacatagttatctgcgtcttaaacagtttctcctgagaattttttttttttttttttgagacggagtctcgctctgtctcctaggctggagtgcagtatcatgatctcagctcactgcaacctctgcctcccgggttcaagcgattctcctgcctcagcctcccaagtagctgggactacaggggtgcgccaccacgcccagctaatatttttgtattttttttagtagagatggagtttcaccatgttggccaggatggcctcgatctctgatctcttgacctcgtgatccgcccacctcagcctcccaaagtgctgggatgacaggcgtgagccaccacgcccagccaagaattctattaataatacaggttggagagcttcaggtggaataattcagacttggggaaacggaagtgtccttaggggtccaggttgaggttttgtgaaagtgaatggagattatgaggaaagatgcgaaagagaccaaaagggaagctgggatttgaggacgcggagctcgttaggaactgccgtgtactcatagaagcatctggatgaagctctatttattgggtgcccccacacccccacaatgggaaaagccctatttgaccaagatgtttaagtacctcccacaataatagtcactcctactggttacacccaggctgtcagtaaagtatgaaaggcctacgtgccctaaaaatggggggaatccaaggttggggcacatgaaagctctcttcaaagaaacctcatcgccccgggtggaggtgttctgttcaggggtgcgtctggggaggcgctggcccggagtgtttgcaggaagatggagagctgtggatgccaccagcagggctcgagggcaaagtgtcctggttgcccatgctgccattcaagcaaggttcgttgagaatctgctgtacgacagccaggagcaagacagagtcctggcttcctggagcctgacgtttgagtgaggacagaccttatatagacacaggtggaggggtggggagctctgccgtgaaaaatataacaggaagataggcaggcaaggtgagtgtgcagaaacggctggctgtcgcttacaatggttgggggagcctctctgggaactggatgtctgaacagacctgaagggggtgaggggtgagacaagcagttggccaagaacggcctcctgggcagagggaacagtcatcgtggagggaggctctaatctgtttcagaaagtgagtaaggctgggcgcagtggctcacacctgtaatcccagcactttgggaggccaaggcgggcagatcacctgaggtcaggagttcaagaccagcctggccaacatggtgaaaccccatctctactaaaaatacaaaaaaattagccaggtgtgatggcgcgtgcctgtggtcccagctacttgggaggctgaggcaggagaattgcttgaacccaggaggttgagactgcagtgagctgagatcgcaccactgcactccagcctgggcgacagagcaagactctgtctcaaaaaaataaaaataaaaaagcaaggaggaggtgaggagcaagagggcagggggctttggaggctggtgtgcaaagccccacaggtgcggccaggatggattccagctttaatctgagagatgggagccatgggagggtgctgaacacagcgtcaggatcctacataggttgtttccaggctccccctggaagcctggtggggaacagactgcagagggtgaggtggcagctgggagcctagtggggaggtgacagtagctggacccaggaggcccaagaaaaagctgcccatttggggatctggttagcagagctgccaaggagaaagaagtgggttgtgttgatttacttattcatttattccttttttttacattttcattttttagttaaaataaaacatttatatacagtgaaatggacagatcttaagtgaacggtctgataaggataagtttggacataggcaggcacctgtgtaacccacccctgcgacaagttacagaacaatatcatcatcctagaaagcctccctgtgccccttcccagtcggtccccgccgcagctctcagaggtgagcactgtaatgatttttccagccaaagctcagtgtgtctgtcccaggagtgctgtaagtggagtcatacagcatatggtttttttggtgtctggcttcttttcctcagcatagtgtttttgtttgttttgtttttgtttttgttttttagggagtttcactctttttgcccaggctggagtgcaatggcgccatctcggctcactgcaacctccgcctcccgggttcaagtgattctcctgcctcagcctcccgagtagctgggattacaggtgcccaccaccacgcctggctaattttgtagttttagtagagacagagtttctccatgttggccaggctggtctcaaactcctgacctcaggtgacccgcccacctcagcctcccaaagtgctgggattacaggcgtgagccaccacgccccggcctttttttttttttttttttttgagacagcatctcactctgttgctcaggctggagtgcagtggcacagtcttggctcactgcaacctccgcctgccaggttcaagcgattctcctgcctcagcctcccaagtagctgggactacaggtgtgcaccaccacgcccggctaatttttgtatctttcatagagacggggtttcatcatgttgcccaggctgttctcgaactcctggcctcacgtgatccacccgcctcagcctcccaaagtgctgtgattacaggtgtgagccaccgtgcccggccagcatcgtgtttttgagattcatgtgtgtttgagtagtattttcaattatttaaaaacaaaatttttttaagagtcaggctcttgctccatcatgtaggctggagtgcaattgtgtggtcacagctcactgcagcctcaaactcctgggcttaaatgatcttcctgagtagctaggactgcagatgcgcaccaccatgcccagctaactttttttttttggtagagatgaggtctcactatgttgcccaggctggtcttgaatgcctggcctcaaacaatcctcctgcctcagtcttttgaagtgctgggattacaggcatgagacactgtgccccaccacgacctacatatttttaaattactttttttgtttgtttgttttttgagatggagtctcgctctgttgcccaggctggactgcagtggtgcgatctcagctcactgcaagctctgcctcctgggttcacaccattctcctgtctcagcctcccgagtagctgggactacaggcacccgtcaccatgcccggctaattttttttttttttttgtatttttagtagagatggggtttcactgtgttagccaggatggtcttgatctcctgacctcgtgatctgcccgcctcagcctcccaaagtgctaagattacaggcatgagccaccgcacccggccaatttactttttaatattttccccacattaaaaaataaaacatcacagactttttaaattttatttatttaatttttttttgagacagggtcttgctcttcacccaggctcaagtgcagtggcgtgatcttggctcatggcagccttgactttccaggctcaagccatcctcttatatcagcccctctgcaagtagctgggactacaggtgcaaaccaccatgcccagctatttttgtattttttggtagaaacagggttttgccatgttgcccaggctgactgcagacttttaaaagcacccaaatgcattattcaagcaacattagccactgtggtcagattaacgataatgcaataatttttttctgttcatctctgttttagatttgcactttttgtaatggtatgaacaattaagaggattagggaactgtgctggtctgtgctaaagttcatcacaggcagggcacatccaagcctttaaacttgctcccaggtgtcctggttctaaatagcacatctgtcccacttaattaaactcaggcatgactcttgcaaaccccttgggtcctggctcttgttcaggcctgaatggccacataatagcaagagaatgcgtggcaggtctcagcttggcaacatgacatgaggcatcatcccagtgcccagggtaagatttggtgtttcttctgtgactctccttttttttttttttttttttttgagactgtgtctcgctctgttgtccaggctggagtacagtggtgcaatttcagctcactacaacctctgcctcctgggctcaagccatcctcctgcctcagcctcctgagtagctgggattacagacatgcaaagtgctgggattacaggcgtgagccactacgcccggccaattttaatttttaaaagacaggatttcactctgttgcccaggcttgagtacagtggcatgatcacggctcactgcagcctccacctcctgggtttaagcaatcctcctgcctcagcctcctgagtagctgtgaccccaagagcacaccaccttgcccagctaattgttttactttttttttttttaatagagacagctccctatgttgcccaggcttgtcctggcctcaagctgtcctgctgcctcagccttccaaagtgctgagataacaggcatgcaccaccacacccagcagagtcccacttttcatcttgtgtctttgaatatttcaaccacaaacaataaatacttatattcatttattttaaagtaaccagagatagtacaaccactttggagaactgtttggaaatttattaaaaagttagacataccctggctgggctcagtggctcacacctgtaatcccagcactttgggaggctgaggcgggaggatcacttgaggacaggagttcgagagcagcctggccaacatggtgaaaccccgtctctactaaaaatacgaaaattagctgggcatggtggcgggctcctgtaatccccgttacttggcaggctgaggctggagaatcgctggaacctgggaggtggaggttgtggtgagctgcgatcacgccactgcacttgagcctgagtgacaaagcgagactctgtctcaaaaaaaaaaaaagttagacatacccttatgatatgacccagacattccactcctaagtatttacctaagataaatgaaaatatatatccaccaaagatgtgtacacaaatgtgcataatagcatacttattcataatagcctaaatctggaaacagcccaaatgttgtaccacattttatttatccattcattggttgatggacgtttgggttgcctccactttttgactattttgaataataccaccatgaacattggtgtaccagtttttgtgtgggcatagatttctcttgtatatagctaggagtggtactgcggtaggaggtggagctcaactctagaggtagggcttagacactggaccaaattgagacctagctaaaacaggtctggggtggaagcagctttctagaagacatggccaccactgtaccatgccagtttaccgttgccatggtaacacctggaagttactgcccctttccatggcaatgcccttgacaaccctgaagttgccagctttttcctggaaatttctgcataaaccaccccttaatttgcatataattaaaagtgggtataaatatgacagcagcactgcttctgagctgctcctctaggcacactgcctatggggtagccccgctttgcaaggagcagtctctctgctgcggctgtgcactgcggcctcaagaaaagttgctatcaccaccagcttgaccttgaattatttcaagggtgaagccaagaaccctcctagactaagcctcaatttgggggcttgcctatcctgcatcagtacaacccttcagtggaaccttacccaacaataaacaggactgcaggactgatagaataatatcgatggggctgcgcaccgtggctcatgcctgtaatcccagcactttgggaggtcaaggtgggtggatcatctgaggtcaggagtttgagaccagcctggccaacatggtgaaaccccatctctacaaaaaatacaaaaattatccgggcatgatggtgggtgcatgtaatcccagctactggggaggctgaggcaggagaatcgcttgaacccaggaggcggaggttgcagtgagctgggatcgcgccattgtactgggtgatagagggagactccatctcaaaaaaacgtaggcagcaaaagagttccagactaatagagtccagtccaaatatacaactctagattccttacataagctccagacagaagctaattctctggttttagcagtgctcaccaccacataattctagatgtactaaccatacaacaaggaggcctctgtgtgcaattaacacctcttgtttaatctaggtaagtttaccaagccaaataggacagagcctacactatataaaggcataattcagagaccacatgaaatagccaccactgaatctgtatactaatataatgatatacaaacattattgatcattgggattaggaatatatgccacaaattaagctccaaaaaaaaaaaatatcgatggatctcaaaggctttatgctaaggggaagccagaagtaaaagatgcccacgtactatatgatttcatttttaagaagttctagaataggaaaaactaatctatgatggcaaaaattacaacagtgggtgtctcagtaaggagaaggactttgagaaggaactttttggagtggtggaaggttctgtgtctgggttggtggttgcacaggtgttaaaatgaatttctgtcaaaaatcatcaaattgtacatatactttaaatgtgtgcatttcaccacatgcaaattatacttgaatggaaactatttttaaaaagtaactgggccaggtgtagtggttcatgcctgtaatcccagcacttatggaggtctaggtgggaggatcgcttgagcccaggagttcaggaccagcctggtcaacacggcgagacccccatctctatttaaaaaaaaataataaaatggccggacatggtggctcacgcctgtagtcccagcactttgggagaccaaggcgggcagatcacctgaggtcaggagttcaagaccagcctggccaacatggtgaaaccctgtctctactaaaaatagaaaattagccaggcgtggtggcacacacctgtaatgctagctactcaggaggctgaggcaggaaaattgtttaaacctgggaggcggaggttgcagtgagccgagatagcgccattgcactccagcctgggtgccaagagtgaaactccgtctcaaaataattaattagttaaaaataataataaataaaaagcaatggagtggctattttattttcatctttacaatcctgtgcactgaataaacagccaaagctatagcaatgctgcacaccaaagccagccactgatgggcccagtttaacgcatcttgtgtgtgattatagatcttgtaataaacttgcccctgccctccctgtgtgtctcattcacatttctgatcagcatgctgtggtttaagactgtttgcagcctaacatggctccgtgtttaaaattcaggccctacacattcgttctcataaaattgaacctttgattcatgtctctagcatgaatctagatattacactgagctcaaggtctgggactgacctttaggggctgcgtggtccggagggagggcgcaacaagccaccccagaggagtcattggagaaggttttcctgttgcttcccgtgaccctgacatttatgaggggaaagcgttcagctcttagggaatgttagtgatgccgggtgacccaagtttttcatccttgacttacaagcatctgggttggtttcaccaaaccacgtcctgacattataaagcaaattactgcatttaaaatcatggtggcatgcacctgtaatcccagctactagggagtctaagttgggaggctcccttgaggccaggagttcaaggttacagtcagctatgatcctgccacgacactctaggcgacagaatgagaccctgtctcaaacaaacaaacaaacaaaataaaaaataaaaaccgactaccctctgttaatggccagaatatcccggaaaatgaaaattcatgtcgtcggattagtcccactgatatatcaaggaatggattgtgaggatacgatgtcactgtagtttacttgtgttgaggaactaggccaacaaaatggtgggacagaatcatgaacccagaaatagagcttcatacatctgagaacttagactatgaccagccatggtgctatttattctaaatcggcaggagagaaaagagattttctaaacttagctaatgctctgaaaactggctagctatttggacaaaacaaaaagaataaagttggtttccctagctccttctttgagtcctcagataccttccagatgaatcaaagatgtaaatgtgaaaaatgaaattaataaacatttaggtaaaaataggaatgagtttacttataattttggaagcagaagaatttttgtattttggagacggggtcttgctgtgttgcccaggctggagtgcagtggcgtgatcgtggctcactgcagcctctacctcctggactcaagtgatcctcctacctcagcctccctagtagctgggagtacaggcacacacaaccatactgagttaactttttttttttgttggagtgggggatggagtttcactcttgttgcccaggctggagtgcaatggcccgatctcggctcactacaacctctgtctcctgggttcaagcaattctcctgcctcagcctcccaagtagctgggattacaggcatgtaccaccatgcccagctaatttttgtatttttagtacagacggggtttctccatgttgatcaggctggtctcaaattcccgacctcaggtgatctgcccgcctcggcctcccaaagtgctgggattacaggcgtgagccactgtgcccggctgactttttgatcttgtgtagagatggggtctccctatgttgtccaggctggtctcgaactcctgggctcaagcgattctcccacgtcagctttccaagtagctgggactacaggcatgtgccaccacgcatggctgttttgtgtcttttatagagacgagggcttgccgtgttgcccaggctgatctcgaactgctgggctcaggcagtccgcccacctcagcctcctaaagcgcttggattacaggcgtgagccactgcacccagccaagcccagaagtcataaaggaaaagattaatcaacctgactatataaacatttaaatcctcagacagaaaaaaaaaatccacaagtcaaaagacaaacaacaaacccggggacacatttaccacaaggatggactcaagataatttccttgaatcacaaagagcttgcacgtatcaaaaaaagaaatacagaataacctggcaatgaatctcaatagggaatccacaggaaaaaaaaaagataaaaaactgaaaaattgcttacttatttaatctcacaaaggtttatataatacagtgtgccaagcacttttctttccttttcttttttttttttttttttttgagatggagtctcgctctgtcgcccaggctggagtgcagtggtgcgatcttagctcactgccagccccgcctcccgggttcacgccattctcctgcctcagcctcccgagtagctgggactacaggtgcccaccaccatgccaggctaattttttgtatttttagtagagatggggtttcaccatgttagccaggatggtctcaatatgctgacctcgtgatcctcccgcctcagcctcccaaggtgctgggattacaggcatgagccaccgcgcctggcctggaacgggattttagacaaagcttagagcttttgccagccatgcggaaaatagtatcacatgatggttttctagactgtcaactctattgcattcatctatatgtacatccttatttcatgcttggtggggtgtttggttggttttcgttttgtttgagagacagggtctcactctgtcacccacacctgtaattccagctctttgggacgctgaggcaggtggatcacttgagcccaggcgctcaagaccagcctgagcaacatactgagatcctgtctctacaaaaaataaaaattagctgggtgtggtggtgcacacctgtagtcccagctactcgggaggctgaggtgggaggattgcttgagcccagggaggttgaggctgtagtgagccatgttcacaccactgccttgggaacagaatgagactctgtcaaaaaaaaaaaaaaaaaaaaaaaaaaaggaaagaaacaaggaaggaaggagggaggcggggaggaagggaagggaggacagagagagaaagagagagggaagaggccgggcacggtggctcatgcctgtaatcccagcactttgggaggccgaggcgggtggatcacgaggtcaggagatcaagaccatcctggctaacacggtgaaatcccgtctccactaaaaatacaaaaaaaattagccgggcgtggtggcaggcgcctgtagtcccagctactcgggaggctgaggcaggagaatggtgtgaacccgggaggcggagcttacagtgagccgagatagcgccactacagtccagcctgggcaaaagagcaagactccgtctcaaaaaaaaaaaaaaaggcaagaaagagagagggaagaataaaagaagaaagaaggagaaacagagaaagggagaaagaaaaaaagggccgggcgcggtggttcacgcctgtaatcccagcactttgggaggccgaggcgggtggatcacgaggtgaggagatcgagaccatcctggctaacacggtgaaaccctgtctgtactaaaatacaaaaaactagctgggcgcggtggcgggcgcctgtagtcccagctactcgggaggctgaggcaggagaatggcgtgaacccgggaggcggagcttgcagtgagccgagatcgcgccactgcactccagcctgggcgacacagcaacactccgtctcaaaaaagaaaaaaaaaaaaaaaagaaagaaaggaaggaaagaaggggaaggggaagggatagggatttaggccaagcacatacctgtatttccagctgcttagggggctgaaatgggagaattgcttgagcccaggagtttgaagctgcagtaagatatgatcagtccactgccctccagacagggtaacagagggagaccgtgtcgagagagggagagggagagggagagggagagggattttatgaagtgataagtaacaagcacatatgatgacccttttataaatgaaaaacattatattattatatatggtagtatatgtatcaatctttttccttttttctggaaggaaaaacaacaaatggaaaacgggttgcttctgaggtggggaactgaggggaatggagggaaggacttcattatgtccccatctgtaactctcacgcttggtaacacattatattttagaatgctgatgtggacaggacagatagtgggtcatttattttctttatacttccttacattaaaacaacattatacttaaacaaaaaatttaaaaagttacattaccccaaactacattcacctatattgctaaattaactggatttttctgcagttcttagaagcatttcttgccatttctggacaaatatttgcacgttatacaaagcatccttgttttggaaggtgggtcgctgcctgtcctggttcgtttgaaattttttctggcatgggcatgcctgccactgaaaaactctaccttcgatgtctgcaaagtgcatgccttgtcatgctcaagtccaatgacaagtaaacctcaggcatggctgctttggaaaagctccaatccctgcataatagttctagaaaaacaagtgaatgtggccgggcacagtggctcacacctataatcccagcacttttggaggctgaagcgggtggaccacctgaggtcaggagttggagaccagcctggccaacatggtgaaaccccatctctacaaaaaatacaaaaattagctgggtgtggtggcgtgtgcctgtaatcccagctactcgggaggctgaggcaggagaatcacttgaacccaggaggcggaggttgcagtgagcagagacacaccactgcattccagcctgggtgacagaatgagacccagtctcaaaaaaaccaaacaaacaaacaaaaaaacacaacaaaaaataagcgaatgtgtaagaagtaaggctgtggtcttgtgctatggcggatgagtgctgggtgaatgtgaacaattattgatagtgttagttattttattttattttattattttttgagacagagtctcactgtcacttaggctagagtgcagaggcacgatctcggctcactgcaacctccgcctcctgggttcaagtgattctcgtgcctcagcctcccgagtagctgggattacaggcatgtgctaccatgcccagctaatttttttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggcctcgatctcccgacctcgtgatccgcccgcctcggcctcccaaagtgctgggattacaggcgtgagccaccgcgccttttttgtatttttagtggagacggggtttctgtgttgtccaggttggtctcgaactcctgacctcaggtgatctgccctcctcggcctcccaaagtgctgggattacaggtgtgagccgccgcacctagcccagtcatttaactgtaaaagtaaagcatcccgcctcgtctttgtccagcttctggagtttaacatataaatgcaagatgagctgctgaaaaattgttaccatatgaaagcaacccagaaactctgaaatgcacagtggggcaggagtatgccctatcaggcgctaaaatgcattatgaatctataatatttctgacagtttggcgtccctaaatgtgagattttcagttttgatgaaggcagcattacaggccagcagatgagacaaggatcaagtggccaaacatttctttggagcgtgatggactattccaatgttactttcactgagaaaaattccagctggatgaaagatgtaaatgcaaagcatgaagacatcaaatgcctccctgcaaatggtgaagtaatctatactcttagaagcagggagagtacttttctaagcagaaagacatatctcagaagctatgaaggacgagtttcatgcatttgaagtttgtttgtttgttttgtttttgagacaaggtctcacattgtaacccaggttggagtgctgtggcatgatctcggctcactgcaacctccacctcccaggctcaagcaatcttcccacctcagcctcccaagtaactgggaccacaagcgtgtgacaccatgcccagccaatttttttttttgggggggattttttcagtagagacaggggtctcaccattttgcccagcctggtctgaaactcctgagctcaggcaatccactcatctcagccttctaaagtgttaggattacaggcgtgagctactttgtccagtctcaattattgtatttcttttttggatttggtaggttgttcaatcagttagtctccctttctttccagcagtgtcatagcttgagggacctagtaatggcggttagacagctgcctgttctaatcctggttacatagatccagaaggattcaaagtgtcctggtggaggaatttttttatatttctgagcggaattgcacaactcttatttcttatcacaattaagaaaatcacatgggaaataccctgaacgtagcactgtgaagccacctagaacagcaaacccttgtgttcaaattcattagacaatcacttgttgttataaagctctcaggtcaccatggccggatgaacccttggcagatgctcctgtcatttcttgaagcctgaggaatgggaaccgtggcagctgctggcttggacaatctgacataccaggacatgcccaggcctggatcggcagggctatgaatggcttattcagcgacagattggcaagagtaaatcaggttaaatgaaagctttataccagacccagagaaaaagaaaaataaagaaaaaaaagaatgactgtgactgtaacctataacgtggtcttggctcctaaagcattttatttttaggtggcagtggttttgtttttattgaataaagagccatataaagatgaaaacaagaactgacctatcatcctgttgctaaaacagcccacatagacattttaaaataagatatgcagagtgttagacattccagctgtacaaaattagaaacggagagtgccccgtctgcttctccccaacctcccacaaaagccatagcaggttctcgttttccttcaaaagagaaaaaatgtttttgtatattccagcatagagctctctatacggacatatacatgcgtgtatatatgtatatgtgtgtctatgggtgtgggcatgaatttgtgtgtatgtctataattctgtgtctaagtgtatgtttgtgtatatatgtgtgtaaatttatgtatatgtttgcttttctgtgtctatgtatatttatgtacatatgtatatgtgcatatataagtgcatttatgtgtatatatgggtggatatatacatatgtatatgagtatgttgtatgtatttgtgcatgtgtgatatatgaatgtatatatgtttgtgtatatgtgtgtatatatgtatgagtgtatgtatacacatatatataagtttaaacaaaagcaattataactattaagactttgggccaggcacggtggctaatgcctataatcccagcactttgggaggccaaggcaggtggatcacttaaggtcaggagttcaagaccagcctggtcaacatggtgaaaccccatctctactaaaaatacaaaaaattagttgggtgtggtggcaggtgcctgtaatctcagctacttgggagactgaggcaggagaatcgcttgaactgggaggcagaggttgcagtgagccgagattgtgccactgtacatcagcctgggcgacagagtgagactcagtctcaaaaaaaaaaaaaaaaaagaccttgatgtgcttcacatttgcttttcttggagagaagaaggtcttgtaagacgagtaccaaaactagaacagaaaagaaaatatagctacatatgacttcataagaattaataccttttgtatggcaaaaaataaccacaaaaaactaaaaggacacatttctttttcttttcttttttttttttcagacagagtctcgctctgtt

SEQ ID NO: 38447 - DNA, 13703 bp, Homo sapiens
gttcttggagtcagggagcagcagcctcccacaggatgtgagagaggaactggggtctccagtcacgggagccaggagccggccagggccgcaggcaggaagggagcgaggctgaagggaacgtgagccgaccagggcccgactgagggaggaggggctgggggcctggaaccctgggtctgagggaggagtggctgggggtctcgacactgggtctgagggaggaggggtgggggcctggattcctgggtctgagagaggagggactgggggtctggacgctgggtctgagggaggagggaggaggggccgggggggcctggactcctgggtccgagggaggaggggttgggggcccggactcctgggtccgagggtagagcggttgggggcccggactcctgggtccgagggtagagcggttgggggcccggactcctgggtccgagggaagagcggttgggggcctggactccggggtctgagggaggaggggctggggcctgaggggggcggaaggggcgtggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcaggtgagggccgctccgggccagggccctgctgcaggcgggcggcgggaggcggccccaggcaggcaggggcgaagccagcgggacccgagttccccgcgagcccctggcgctgccttctccgctcaattaactttctcaacgtctcctgctgggcctgaggctgggaaccacctgtcgcctcttgtgtctgtttccctctctctctctgggtctctgtccccctctctttctgggtctcttgtctctctctctctgggtctctgtccccccccccccgggtttctgtcccctctctctgaatctgtccccctccctccataatagattcttctccctccctgggtatctgtcccactgcagtctagttccccgcccgtgtgctcccttcagctctgtttctgtctgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtgagattccggtctggaggggcaaggggccgggtccatgctccggggccccgcttacctgtgtttgggcgccccaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaagggtgagccggatctgcagccgcaggctgttctgtcctctctcccgtcatgcccacctgcctcagttcccctgccaggaccctccatcagcctcccactgcagcccacgctctgcccccccattcctcaggggtccttctacactcagccctcccatggctccccagcgccccccaggacaaactcctggcttccttccttgccttctttttttttttttttttgtgagacggagtttcgctcttgttgcccaggctggagtgtaatggcgcgatctcggctcaccacaacctccgcctcccgggttcaagtgatctcctgcctcagcctcccgagtggctgggattacaggcatgcaccaccatgcccggctaattttgtatttttagtagagacggggtttcttcatgttggtcaggctggtctcaaacccctgacctcaggtgatccgcccacctcagcctcccaaagtgctgggattacaggcatgagctactgctcctggctccccccttttttttttttttgagacagattctcgctctgtcaccccaggctggaatgtggtggcaccatctcggctcactgcagcctgaacctcccaggctcaagcagtcctcccacctcagccaaccaagtagctgggaccacagcccagcatcatcacacctggctaactttatattttgtagacacggtgtctcactatgttgcccaggctggtcttgaactcctaggctccagcgattctcctgctttggtctcctgagtagctgagattacaggtgcataccaccataactggctaatttttttttttccgcacaatctctgttgcccaggctagtgtgaagcagggtgatctcagctcgctgcaacctccgcctcctgggtttaagggattccgctgcttcagcctcatgagtagctggcactataggcacatccaccatgtctggctaatttttatacttttagtagagatggggtttcgtcatggtagctaggctggtctcaaactcttgacctcaagtgatccacccacctccgcctcccaaagtgctgggattacaggagtgagctaccgcgtctggccatacctggctaatttttaaaatttgttgtagaggtggcatctcactatgctgcccaggccagactcaaactcctggcctcaagtgattctctcactttggcctcccagggtgctgggatgacaggtgtgagccactgtgcttggccttccttgccttaatgtcctcatcagacccacgcagcagcacttgtctctacgcagccatcagagtctacgctccagccacccaacataagcaatctcctccctctgggcatttgctcatccagtttcccctggcacctctctgttccacccttccccctctctgcatatactccagccctccttattcttcaaggtcagggctggatatcacttcctctgagaagcctttcctcagctctgtagggcagagttcactgtttcctccccggaggcccccagatccccactcattcaactgttggccaagagcatttgcactgccaggcgctgctctgggccttgagcaaagagggaagtgacacacattcaccctctgtggctcccaggctgctggacaaagatagataccagctggggatgtgcacagatattcattccaagtgccacaaaggagaagttgagactcaaccaggtagtttttctttaattgtcttctttctttcctaagtagggaaaatttctttctttttttgagacagagtttcgctcttgtcgcccaggctggagtgcaatggcgcgatctcggctcactgcaacctccgcctcccaggttcaagtgattctcctgcctcagcctcccgagtagctgggactacaggcgtgcaccaccacgcctggctaatttttgtttgtttttttttttttagtaaagacagggttttaccatgttggccgggatggtctcgatcttttgacctcgtgatctgcctgcctcggcctcccaaagtgctggaattacagacgtgagccactgctcctggcctttgttgttgttgttgttgtttttgagacagactcttgcactgtcgcccagactgcagtactgtggcgcaatcttggctcactgcaacctccgcctcccaggttcaagcaattctcctacctcagcctcccgagtagctgggattacaggcacacaccaccatgcctggctaatttttgtatttttagtagagacgggggcttcaccatgctggccaggctggtctcgaactcctgatctcgtgatctgcctaccttggcctcccaaagtgctgggattacaggcatgagccaccactcctggcttaaggagggaaagtttcaaaccacacttaagtagaaacaatagtataaaacggaccagacacggtggctcacgcctataatcccagaactttgggaggccgaggcaggtggattgcttgatcccaggagttcaagaccagcctgggcaacatagtaagaccgcatctctactaaaaactcaaaaaattagcctggcatggtggtatgtgcctctagtcccagccactggggaggctatggcaggaggatcgcttgagctcaggagtttgaggctgtagtgaactgattgcaactctgcactccagcccagatgacagagccagaccctgtctcaaaaagaaaaaaaatatggtggccaggtgcagtggctcacgcctgtaattccaacactttgggaggccgaggtgggcagatcacttaaggtcaggagtttgagataagcctggccaacagagtgaaaccccatctctactaaacatacaaaaattagccgggtgcggtggtgggtgcttgtaattccagctattcgggaggctgaggcaggagaatcacttgatcccgggaagcagaggttgcagtgagccgagatcaagccactgcactccagcctgggcaacaaagcaagactctgtctcaaagaaagaaggaaagaaagagagaggagagggagagagaaagaggaaggaaaggaaggaaggaaggaaggaagcgagcatcccatcactgagacttaataattatcaacccatggttttttgaatttcacgcacatcctcactcacttccccaccccacttcacatcaagctttggtaaatctcagacatcacagtgtttttttctttgtttgtttgtattttgagatggagtctcactctgtcatgcgggagtgtagtggctcagtctcggctcactgcaagcttcgcctcccaggttcaaacaattctcctgcctcagcctcctgagtagctgggattacaggtgcccgccacctcgcccagccaatttttgtatttttagtagagatgaggtttcaccatattggccaggctggtcttgaactcctgacctcgtgatccacccaccttggcctcccaaagtgctgggattacaggcataagccaccgcgcctggccaatttttgtatttttagtagagacgggatttcactatgttggccaggctggtctcgaaccctccacctcaagtgatctgccctcctcagcctcccaaagtgcgggagtcaccgtgcccagccagactgttttgttgataagtcctttagtatgtaactctactaggtaagggcatttaaaaaaaattaataccaaaaccatcatcacacctacaaccaattaactctttaatggcatcagatgtccagtttttgttcccatattcctgactgtaaatgttttttaaagtttgaatcagcatccagcaaggtccacacattttgttgtcttttcagtgtctttttctgattgttgaatttttctttctttctttttttttttttttttcctttttgagacagggtcttgctctgtcaccagactggagtccagtggtgcaatcatagctcactgcagtctgaacttcctgggctcaagtaattctcccacttcagcctccccagtaggtaggaccacaggtgcacgccatcaggcctagctatttttgtttgtttgttttttgagacaaagtcttactctgtcgcccagactggagtgcagaggcacgaactcggctcactgcaacttctgcctcccgggttcaagcaattctcctgcctcagcgtcccaagtagctgggattacaggcgcaagccaccacgccctgctaattttttgtatctttagtagagacagagtttcaccatgttggccaggctggtttcgaactcccgaccccaggtgatccacccacctcggcctcccaaagtgctgggattacaggcgtgagccaccgcgctcggccgtatttttgtttttttcttttttttggagacggagtctcgctctgtcacccaggctggggtgcagtggcgcgatctcagctcattgcaacctccacctcccaagttgcaccaattctcctgcctcagcctcccgagtggctgggactacaggcgcccaccaccacgcccggctaattttttgtatttttagtagagacagagtttcactgtgttaggcaggatggtctcgatctcctgacctcctgatccgcctgcctcagcctcccaaagtactgggattacaggcttgagccaccgcgcccggccggattccaattttttaccagataggtgttttgcaaatatttcttccactctctaggttgtcttttcattgttttaactgtgcctttcacaaagcaaaagtttttaactttgatgaaatccagtttattcttttttttttttctatcgtggattatgcttttggtgtttaatctcagaagtaatcaccaaacccaaagtcagctagatcttctcctgtgtattttaagagttttaaagttttgcattttacagttaggtctgtgattcattttcaggtaatttgagttacttgtgatcttgagtgtcttttgatttacaggtttcccattttctttttgttttttttccccctgtaattgtggtttgaagaaagtcagtttatgtcctattgagtttctcctagactggattttgccctttgcatcctgtgatgttgctggaaatagtcctccttctcttctttaaaggagcagctccatctagaagcttggtcagattctggttcaatttttatggcaagaaaactttctgggtagttggtgcgtatgtctgtgtgcataggctgcaaacatctgcttgcttctgtgctgttctgtggaccactggattcgggtgttgttatgaagttctttgtcaggttttctcctgatggttttagcggatagcaatggccattgccttaatcttttttttttttttttttttttgagatggagtcttgctctgtcgcccaggctggagtgcagtgttgcgatcttggctcactgcaacctccgcctcccaggttcaagcgattctgctgcctcagcctcctgagtagctgggattacaggtgcgtgccaccatgcctggctaatttttgtattttttttggagagatggggtttcactatgttgggcaggctggtcttgaactcctgaccttgtgatccacttgcctcggcctcccaaagtgctgggattacaggcgtgagccaccgcgcccgggcttttttttttttttttttgagagggcgtctccctctgtcaccaggctggagtgcagtagcacgatctcggctcactgcaacctccacctcccaggttcaagtgatcctcctgcctcagcctccttagtagctggaattacaggcacacaccaccacacccagctaatttttgtatttttagtacagacagggtttcaccatgttggccaggatggattttttttttttttttgagatggagtttcactcttattgcgcaggctggagtacaatggcatgatctcagctcactgcaacctccgcctcctggattcaagtgatcctcctgcctcagcctccagggtagctgggactacaggcatgcgctgccatgcctagctaatttttatatgtttagtagagatggagtttcaccatgttggcgaagctggtcttgaactcctgacatcaggtgatctgcctgcctcagcctcccaaagtgctggggttacagacgtgagccaccatgcctgacctggtttggtattttgttaaacagaaccaaaggccagacagattttctgtgcttggatttagtctatattggaagtaccttgaggctgaaggcacgtggctgtgagcacgacacaggaagatacagatttgctgaaaagaatagtgaacataaagcagaagccagaactgctgatggccgtcagcccggtccctccattccacctgacggtgcagcaaattctgccgacttgccagagaggcagctccaggagggagaagctgctgtgctttcctgaagcagcaaatgtgttttctgctgagcaaccaaaaccaagatcccagccaagacccacgattgcccagatccaccctccctgaaaggaacttgggcagtaatgcccagtcctaggcagttgctgaaatctttgccttttattttcttttttgagctgggatcttgctctgtcgcccagactggagtggagtgcagtggcacagtcatagcgccatgtagccttggactcccaagctcaagagatcctcccgcctcagccttacaagtagctgggactataggtacacgtcaccatgcctggctaacattttctattttttgtagagatggggtatttgttgccaaggctggtctagaagtcctgggcttggccgggcacagtgactcacgcctgtaatcccagcactttgggaggctgaggcaggcggatcacgaggtcaggagttcaagaccagcctggccaatatggtgaaaccctgtttctactaaaaatagaaaaattagctgggcgtggtggtgtgcgcctgtaatcccagctactctggaggctgaggcaggagaatcgcttgaccccaggaggcggaggttgcagtgacccaagattgtgccactgtactccagcctgggcgacagagactccgtctcaaaaaaaaaaaaaaaaaaaggaaaagaaagcctgggcgtaaggatccttctgccttgacctcccaagtgctggaattgcaggcatgagccattgcacccggcttttttttttttttttctttgagacaggcacttgcactgttgcctagactggagtgcagtagcgggattagagttcactgcagcctcaacctcccaagctcaagcgatcctcccaccttacccttcctgaatggatggggccacaggtgtgtaccatcacacgtagttaatttttaaactttttcagagacggggtttctccatgttgcccaggctggtcttgaactcccggcttccagtgatcctcctgcctcagcttcccaaagtgctgggattacaggcatgaaccactgcacccaaccttttttcattcccttaacgaaacctttggatgaacaaaaattcttaatttcagtgaagttcagtttatcgacttcaatttatacattttataaagtttatgaatttttttttttttttttagacggagtcttgctctgtcgcccaggctggagtgcagtggctatacccaggtgtgatcataactcactccagcctcaaactcctgggctcaaggattcctcctgcctcagtctccagagtaggtgggaccacaggcacatccaccacactggctaattttttttatttgtagtggagactacgtcttactgtttgcccaggctggtctccaactcctgggttcaagtgatccacctcattctcccaaagcgctgggattgtaggagtgagccactgcacccagcctgtctgctaatattatgtttaagagttctgaatctttttttaaattttttaaaatttttaattttttattttttttgagacagtcttgctctgtcgcccaggctggagtgcaatggtgcaatcttggctcaatgcaacctccgccttctgggttcaagcgattctcctgccttagcctcctgagtagctgggattacaggtacacgccaccatgcctggctaatttttttgtatttttagtagagatgggatttcaccatgttggtcaggctggtctcgacctcctgacctcgtgatcctcctgcctccaccccccaaagcgccaggattctaggtgtgagccaccacacctgtcctgaatctatatttatgagagacattggccttaagctctctttttttttttttttttttttttttgagatggagtctcgctctgtcacccaggctggagtgcagtggcgcaatctcggctcactgcaagctccgcctcccgggttcacgccattctcctgcctcagcctcccaagtggctgggactacaggcgccggccaccacgcccggctaattttttgtatttttagtagagatggggtttcaccgtgttagccgggatagtctcaatctcctgacctcgtgatccgcctgcctcggcctcccaaagtgctgggattacaggcgtgagccaccgcgcctggccaagttctctttcttataatgtgctttgttgtcaagatgatgctgacctcataaaatatgctgggagagtgtttcctctgttttatggcctgaagagttagtgtaggaatagaatcatttctacattggaagaattcactaattgatgtcttctggacctggaattttagtttttggaaagttttaaactatggattaaaaattttaaataggccgggtgtggtgcatcatgcctgtaatcccagcactttgggaggctgaggcaggtagatcacaatgtcaggaatttgagaccagcctggccaatatggtgaaacaccgtctctactaaaaataaaaaaattacccggcatggtggtgcatgcacctgtagtcccagccactcgggaggctgtggaagaagaaactcttgaacccaggaagtgggggttgcagtgagtcgagatcgtgccactgcactccagcctgggtgacagagcgagactcttatctcaaaaacaaaaggctaggcgtggtggctcacacctgtaatcccaacactttgggaggcccaggcggatggatcatgaggtcaggagattgagaccatcctggctaagacggtgaaaccccgtctctactaaaaatacaaaaaattagccaagtgtggtggtgggcacctatagtcccagctactcaggaggctgaggcaggagaatggcgtgaacccaggaggcggagcttgcagtgagccgagatcgcgccactgcactccagcctgggagacagagcaagattccatctcaaaaaaaaaaaaaaaatttaaatagttataggactacagacgttttaaatttcctcttgtgtcagtttagaaggttgtatttatcaggaatgtgttcagttcatctaaattttcaaatgtgttgctgtggaatttttcataattatcctctatctttttttttttttctttttttctgagacggggtctcactctgtcgcccaggctggagtgcagtggcacgatcctggctcactgcaacatctgcctcccaggttcaagcaattctcctgcctcagcctcctgagtagctgggactacaggtgcccggctaatttttgtatttttagtagagatggggtttcaccatgttggccagtgtggtctcgaactcctgacctcaggtgatccacccactttggcctcccaaagtgttgcgattacaggcgtgagccaacatgcccagcccaaggaggtgacatcttgaggggacaccttcggggtggacaggttgagtctctgtcacctaggaagtgcctccccttttaccactgtattatctgcggttagcacagtgcaaacatggaggcctctttctgtccctatccagccctggctctgggagtggtgggctcgcgacttaggcctgtctgcctgatttcctgcagagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctctgcctgcctctccccactgcactggcacagccccgccttgccgctgctgatccattgccggtgtgaccgcggccgctcgtgctgtagctggttcttacgtccaacctgggggcagtctgcccagatcgcctgcctggcctcgcctctgcccatcagacacttggtgctggaatctccgaggctgggagggactgggagcgccccagttctgtgtcctgactgggtggggtggaggggctgctccacatctcacagcgttctctggctgcagaatctccagccaagtcctccgtgctcgtggtgggaatcgtcatcggtgtcttgctactcacggcagcggctgtaggaggagctctgttgtggagaaggatgaggagtgggctgccaggtggggggcagcgggaggaagagcctctgagagagggacagagaccccaagagaggggcacacagacctgggaggacagagacccagagaggggggacagagatcagagagaggtggagacagaaacccagagatgggagaacagaggtgcagagagagggggacggagacagagacccagagacgggggaacagagacccagaggggacagagagaggtgcggacagagggagggggagacagacccagaggagggaggcaaagatgtagaaagaggggggacggaaaattgggagaaggggagacaaaggcccagaaggaaggggatagagactgaggaagagtgtgtgagacacacacacaaatgggggacgccagtcagacccagagcgcctcagagattctgatgacctctccctctctctctctcctcagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 38448 - DNA, 12685 bp, Homo sapiens
attgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagaggtcagcgggaggggagggccggggcgaggggcggccgggcccggccgagtgggagcgagtgatgcccgggagccaccaacctttgggttctcggactgaaccctgagcggggtcgccccgcagcgccctgaaggtcggagagttcttgccctcgggaacctgcccccagccactcgcccctaaggcttccttcaccttgcacgacccggcaactccttcctgacccggggcagcccggcgcaggggcttccccgtcccgcaccttctgcgagggacccctcagcccgggcatcgaacccggcggccccggtcccgggcgcactagcgtcatccccactccctcactgtggtctgtagcgctgcaccctcctagcctccttccgccgccaccaacccacccccctcgggagtggaaagcagcccctttgcctgggacctgcaacagacgcaagccctccctcccccttcccccagggctccctgaccttggcgtctccagggatggccgcatccttgccttccagaacctttgagaggattcctgtcactgcgggaaagggcagcaacttccctgtgcttcggggtgggggtcggactcccttggcctgggctagctgggctgtggctgcaaggcaaaggatgccacagaagacagagggacagtgaaacattctctgccctccccaccgagagagccgagcgctgggtgatgggagtccgtgggagtcaggctaagagcatcttgtaattatggaggcaatggagtaggaggcgaacctgaagccagtggctgcccccagagagcagtggtcacttgttacgcttggggcagggggcagggagagcctgtcagtcatatgctccttggtggggagggccaggaaggaggttgaaaccaattcccccacccccacccacagtccagctgtggggctgagagggagctagctgtggggttgctttcagccacctgctccccatcccgagggacgccatgggagtcctaatagagagaggaggaaaaccttgtcaaatccattatgcagcagcaataatgcctgctccctccagacagcactccacagtttacacagccctgtcctgtccacagtgccacctaatgctcctgccccttttacaagtgaggaaacaggcttcaaaatgttaatgcctgacccaagtttcatcaatttaaattcaggtctccaggctcccaggaaatcctctctagggagcgcttcctagtttgggggaattccaggatgagcaagacagggtcccttgtttataggaagattactaattcagaggaggcacccagggttgcaaaagacaggagactggtgggaaggtgagtaaccaaggagggcttccttcagaaggaggcagtattcactcatggccctgaatgaggagggaggtgccaccgggcagagcagaggagaggaggtgcgctccagggcatgaagcctgcagggtgcaccgtggcagtggagagtggagagagaagtggcaggtggagacgccggatggtctagtggctaatacctgggatcaacccccagctccttcactctccagctgtggaaccacaggcaaataccttaacctctcggcctcattttctacatccacaaaatgggattcatcataatagaacctggttcacagaattattacaaagactcaaagagttcatatacatacagtatttaaattctcacctgcatatagcattcacaaaatgctaattattattattagtgctcatagttagagcaaaccaatatggcttagtgctcctttgtccttctgatgattgactattttgactgtcttccccaggctcctggtccccaccccacccccagggcaagcaagtgccttcacagacctcttcagcaccttccgcgcccgcccatcccacacttgcactcgataccagtcggttcagggaagaagggagcaagcttggaaagatggtgcaggttgccatggcaatgatgggggaggaggggtggatgcccagcagagcctggccaaggattcagggcagagaaagctcacttcattaccatattttactacactggcccagtctgccgacggttgcaccccagaagtgccttggtatcagaggcgagtagatggagggcaggagttggggaaaaggagacattgagaaggctgttggcgagaagaaggccaaggtctgtggaaagtagaaggaatagctgggaagcatccagtcctggactcagattcgaatcctggctttgctacatactacctgtgtgaggctctttaagcctcagtgacctcatctgtgaaatggtggtgagaggggaagggacatttacagcccttttctccctcccttgcccacaactactgtgccccagcatggcacccgggtcagcccctgccagctctggagctgtcatcatctctccctcttatgcctcttcagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtaaggagggggcaccggggactctcaggctaacaggactcagggcctgaggtctgctgggtacaaattgggagccttccccagccccggctgtgctccccatattccagagggggaaactgaggcccataaaggttctcttctgccaagctgggatcccatcttcctagatcttcccctcccaagctcctcttttgttaagccctctcattctccctccaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccaggtgagtagacaggccccacctaggctggtcctgctgcagctgcatcagccaggtggtgggcccgcggcagagaggaaacccccactcctgggaagcgcgggggttgtggaccacccgactccatttctgcccccactagctttcagtgctgtgaaaaggttatttagggccccagagggagttcagtccttggtgtgtgactttgagtaagtaacttaatctctctgagattcagtttcctcatctgaagaatggggtgttaagaattcctaccccatctggagttggagtaaggaacaagtgagatgaatgtaaggatagcttacggcagagtaatcaatcagccagtgtgtttgcattattagtagtgttacttttataattgctatttccactattttggagtctagcacaggaatccatgggagaggcgtctcttgagctttaggattctgagaagaagactggattctaggcaggatagtcctgggcttggttagggtaaggccctgggattggcttactttgtaatgagacctatcccaagggctgaagagtggtctgcggacatgctctgaaacctagacctggtttgaagccccagccaggttgctggtttgctgtgtcactcaggctgtgtctccggcccatgctgggcctccctttcatgagcccctccagctctgggtttcctgccatgggtgctgagaatcctgttcctcgccctgcacccacccccatgccaattactgctgtcgtgtcttcacagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggtgagcaccaggccacggggatgggtgagggtgggaacctctgtgggaagactagggacaggtacctgctcctcctggggtccttgctggaatccttgacctctgcaaaacatgtgtccaccaaactaaactccttccaggtaaaaagccatgactgtgctggtaggagcccaccatgggcacagccctggaattagagtcagaagtaggaagctgccccttcccctggcacctccctgagattcctttgtccaatggggctaacggtccaccttcagggcagctgcaagtctccagggaggggaacccgcaaagggcttagagactgcagtacctaagtgtgagctcttgctccagtgctccagagagggatatttgccccaatcacgttcacctacatgctgtccctccttgccaccctcgccgtaggagtctagcctttggacagagcttgctcttccccataggaaggccctgattctttgtgtccttttccgtaataagttcccccaaagcagcccccacccacctacccagttcacccggcaagggcttgcagagtatgacttgcttctggagtccagcgcaggaatccatgggagaggcatctcttaggctttaagattctgagaagcctgagttctaggcaggatagtcctgggcttggttagggtgaggcactgggacttgctcactttgtaatgatatctttcctgaggatcgaagagcggtctgtggacatgctttgaaacctagacctagtttcaagccctgcctgggtttgtgcatgtcccgtctctgtgtctccccatctcctacgccctcctatgctcactcttattaagcagatctttcctagacacttacagcctgccaagccctgtgtcttcactctgcagatccaaacacgagcaagggccagtccctatctggcagaaaggggccccagtggtagggaagggagctggatgggcatgaattggattagaaggcatgtgggtgtgtaagcactgagggaggttcaaagtgcggtgggagctcaggtgagtgggtgcagtaagggggaaattcatcccaccactggaaaagctttctaaaggaaatggtctgtgagttgttggaggcttaaagcatcagcaggtaaagtaagaaagggcagagcaggctgaaggcacagactgggcaaaggcttggagtcacgaatgggtgccgtgtgtgtgggaaacttgtgtgtagctgaagcagagagtgcatggagagatgtcacaaccgaagttaaggctggaccagaccctggagggcccccaaatgcccggctaagctttgaccttatgggcagtggggaggcgtaagtggtctttgggtgggggagagctgtaaggtgtgagctgcactgaggcggggtccttctgggttggaggatggtgaagaggagattcagactggagccagggaggtcagatggctttggctccttgtctttccccttcaatccagcccacagttcagcatgcaccttgccaaactgagcctatactctcttccccaggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccaggtgggcagtttccctccacccagggggcaaaggagggagggctggttatagagtgcagttgagcagatttggaggctgccatgctgcctctagatccccaggtgagcagacccaaggacagattttttcaaggaagcagcacaaagcaggcataatccattccttcattcattcattcggccactatcttcccagccccagccatgtgccaggcatagcaagtgtctgtgagtcttattctaagagatgccaaccaatcctgtgccccaggtagagccctcatagccactactccatccccctgcttccaccaaatgatcctttctctgggccgttcacattcccccaaaaagcccagctgcagttctgcggttgtgaactcttcttattcatgccctgagcctgggtcaaggccatggactcagtagccccagttcgaattctggttctgatgcttttgggatgggcaaaaccttgggcaagccagttaacattcccctacccaagcctcagtttcttcacttgtgaaataggaataataatgcatcccttagcatttttgaaaataaaatacagtgctacatatcaggcacccaggacggttcccagcacataggtttttgtttgatcaaaggaagcttatcattcagagggtcaagtgtctggtcctgggacctggaagtgaatctcccgcatgccacctcagtggctgtggaaagcggaagtctgggggaagcgggcccgggcaggcaggggagtgagccaccttgccaggtgggaggtggttaaatggcttcatggatcttagagaggccaagagtgggtcagagtttggggtctagagcgaggatgcttgggtttagatcccagccccgctactttttgctgtgtggtcttaagtgagctatgtaacctctgtgcctcagtttcctcctgtgtaaaatggggataatcatgaatgcaggaagtgctgaggccatgcctggcagctagcaagcatttggcttctctgtctcctttggccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggtaaggagacctccatctctgcctgggaaggctggaggccaagtcccaggagccccatgagctgaggggcctggggctgagcccctcctccacccccaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgagtggcaggtgcccagctcatgtgagtctgcatttgtgtgggcacagttacgcacacacacctttcctccttcctcatgtgggtccccaagagaacagcttcttcttgagacgagaaacctcatgggaggaaccacagcttcaacttcttttgttccagccacctctctcccgagtcaagtaaccctaacagccccccgaccttagacactttcacgctcattattgcactggcaagtgcgctggcctgagagagtcgagagcacatactctgggatcagaaagttttagtttgaaacacatctttgttgtcaaccagctttgtgatcatgggctggtctcttaacctctctgagcctcgttacctaaactttaaaatgagaacatatcttcgggttgttgtaagaattaaaagcactttaagacagtatttagcagatagcaggggctgaaacaatggcagttattgctgttataatatgatgtaataattatacaatggtaaaaattattattattattattaccggtgattgtgaagtgaaataaaagggagggtggtagagcaacttcctctatcttgaagttctaagaggggaagcatggagtctgcatgtatgcaaatcccagccacctgaagggggaaggtgcctttccccacttgtggtcctttgctcaaatgtgtgtggttcctgctggagggccttggtgggagatctgctttgtcccacctctgcctacctggctgtagctggttgccaggtggctccaagagcaatgtcaaaggccagcatgaataaggagccaaagttttgggttcacacccctgctctgccaggaggaagactggtatgcaatggccagttcccctgactgagccccagggaacctcaaggaatggcccctacagtaaaatcttaaacaaagaacaggggcttaaccaacaatcctgctgcaacatgcattccagtgacacacagagctgaactcagtgggagcccgtcctacggcctgaggtcagggctgctctcttctggcccatgccttttttttttttttaatctatttattttgaaacagagtctcactctgtccccaggctggagtgcaatggtacagtccggctcactgcagtctcagctacccaggctcaagggatcctcccacctcagcctccccagtagctaggactacaggcatgtgccaccacacccggctgatttattgtattttttgtagagagggagttttgccatgttgcccaggctggtctcaaactcctggactcaagcgatccacccacctcggcctctcagagtgctgggactacaggcatgagccacccacccggcccagcctcacacctgtctttagtggcttagcccgcccacctgccctctgcccttccataggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggtgagtggaggcctgaggaagctggcaggccttggcgagtcacactgggacggagagggcgcaggggacacagccatgggcccaagtcggggtcagaaaaactgccctgttgcttgcagttccttctgcccacctccaccctgggccgcccagccaatgatcgctttctgtgaaattgctgacttccgcatccctctcctccttccctgcctcacttctcccgtagcaccctccacttcctaatctacgtcagtactggttaatgttgcctgtccatcctttccacgctcctcccccgagaatgtcagccccttgaagctgcggtctgtctatgctggtcgtaccctcagagcctaagatgacacagagctcaggaaatgaacaccctcggagggggctccccaaaacccagggagaggtggcccacgcctctggaatctagcttccaggcccttcagagagtgagcgcccccagggtccccgtaagagagcgtctcccctgcggtccacttgggagcaagagcggtgatcgaggcacagcgccagtcgggagtgggctggggcggctcgcctgcaggtggaagggcctgaccccaagaggggcggatgtctgcgtttgagaaacaggagctgctggtgattaggagccgccggggacgagctgcgggtctccagcagctgggccctgggcaggctggggccgctcagcgctgacggccagtcccggcctccccgccctgcaggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtaagcagctggggaccaggagagtagaccccctgagaagggtggaggggcccccaaaatgttcgtgggtgggagtgaagagtgtgccaggagcccagagtgtgtgggggagttgtgcggtctaggtctgagtgcagtgggattggggataggctcagaatggggtggccgcataaggggggaagccctctagctatgaagggctgaggtgtgggtagtgtggggaccgggtcttgagggaaaagggaactgccccctaggtgtgggattggggtccaggtatgcaccggggtgcaaagagtagagggatagtagcccatgagcctgctgggagtacccggttccctctgggtgggggctgtccgtggcgaagacctcccccacctccggagggcagcccgtgagggtgctgggagcacccggttccctctgggtgggggctgtctgtatggaaggccccccacctccagctcctttccaccctcaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggtgacagttggggggtcagggggatgaggtcaacatctccagatgggggctcatggtagaggggaatgggaggaagggaccctggtacctcgaccccttagggttttcagagtgaggactgactctgtgaggtagtgagctctctgcagctggaggtgatcaagcagtggctggagtatggcagtgggaggttggttagatggctctaactgaggaccctcccaataactcagaccctagggctgagtggcagacaggtgattgacacgcgtcccctctctccctgtgttttgtctatctgcctgtgtctctgttttctctctggtctctcctccatgtggcctatctctgtgggagtggtttctctgtgcatgcgtgcgtgccctcgcatgtctctgcctgtgtctgtgtgccccacaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccag

SEQ ID NO: 38449 - DNA, 13530 bp, Homo sapiens
ggctggagtgcagtggtgcagtggtgcaatctcggctcactgcaacctccgcctcctgggttcaagcgattcctgtgcctcagccttccgagtagctgggattacaggcatgtgccaccacgcccagctaatttttttttttttttttttttttttgtatttttagtagagacagggttttaccatgttggccaggctggtctcaaactcctgatctcaagagatctgcctgcctcggcctcccaaagttctgggattacaggtgtgagccactcgactcagccaataatgcatatttttatttccacctgctttactgtcagaatgagtaagacagagaagaaatcattaaacaccaggattctacttcctgctggagttttctgcctgagatgttaggagaggaaactctcaggatctcagaaaatcacatctatcacggttggtagaagtagattctagagtcagccagaactgagttcaagtcccaactgcatggctttgggcaactgacttgtcctctctgaggcccagattccctttcggtaatgtggagatggcagtgtatctacctcacaaagcagtggtgagattacaataaggtaggcatgtaaagcgccaggcacatactaactgctcaataaatgggaggcatcataattgtatattattcacagcccaaggaaagtgtagcccagagagggcaaggaacttccctgaggtcacacagaaaatcatgtgctggttgtatgccctggaagttgtggagagggagtgttgggtgtctcctggggacctgtcctctgatgggctcttgttccggctaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatggtaagtaatacaggaggaaaccggggtatgtttgctacatgaatccaggagctgtagcaaagagccccccaaatatagtggcttagatgagatcgaagttttctcctcttttgagtagaagtccaagagtttgcagcccaggactgtaggcacctcactggagtcaggacccaggctctatctacctggggctctgccatccatcggggagtaagcctgccttcatggtcctagatggctgtcaccaagtctgccctccagccaggaagagagaaagaagaagagaaagtgccctttcctgtttcaggcagaacctgggagttccatacatcactctgcctgctcccactggccaggagcctcattgcaatgggatgctgggaaatgtagtctttaggatagctgtgtgtgactatatggagggccatctgggagtcttggccacatagagatgttctctgctccttctctccaataacctgtgcctgtgccctgccccgggcattccttcagcaatctcgagtcatacacctggacatgactgagtcttggcacaacagtgggttcattctgggactgagaagtcttgcctgaatcaaagcagtcaccctctcttctctccctctctgtctctgtgtctcttgtgtctgctctgctctctcctctattttttttttttttccaggcagagtcttgctccatcactcaggctggagtgcagtggcttgacctcggctcactgcaacctccgcctcccaggttcaagccatcctcccgctttagcttcccaagtagctgggattataagtgtatgccaccactcctggctaatttttgtatttttagtagagatgaggtttcaccatgctggccaggctggtctcaaactcctgacttcaaatgatccacctgcctcagcctcccaaattgctgcagttagaggcatgagccactgttcctggctttgctctctcctcttataaaatagtgagtctcggccgggcgcggtggctcacgcctgtaatcccagcactttgggaggccgaggtgggtggatcatgaggtcagaggttcaagtccagcctgaccaacatggtgaaaccccctgtctactaaaaaaatacaaaaattagcccggagcggtggcgcgtgcctgtaattctgtagcaggacgagccacagacaaaactcctcagacaccggattaaagaaggaagaggtttttattcggccgggagcatcagcgtcttaagagccgagctccccgaaaaagaaattcctagcacttttaagggcttacaacgctaaggggtccacgtgaaagggccacgatagatcaagtaagcgtgaggaacgtgactgggggctacagacatcagctaacagaacaaaacgttttacagtgctttctcatacaatgtctggaatttacagataacaccagtagttttggtcagggattaatattattattattattttaaccaccaggaccagatggtggcgccaaggtcatctagctatttatcgtacttctgtttttttccagcgttttgctttctccctttttttcctgtcttataaactagggaaaaggggaggtgggggagaagctgggaaggacaacaggagaagtggtggtctcattccaatcccagctactcaggaggctgaggcaagagaatcgcttaaacccggaaggcggaggttgcagtgagccaagactgcaccactgcactccagcctgggcgacagagcaagactccatctctaaataaataaataaataggccgggcgtggtggttcatgcctgtaatcccagcattttgggaggccgaggcgggcggatcacgaagtcaggagataagaccatcctggctaacacggtgaaaccccgtctctactaaaaatacaaaaattagctgggggtggtggcgggcgcctgtagtcccagctactctggaggctgagaggagaatggcgtgagcccgggaggcggagcttgtggtgagctgagatcgcgccactgcactccagcctgggtgacagagcaagattccgtctcaaaaaaaataaaaataaaaataaataaataaataaataaaaacaagtgagtctcggctgggtgctggactccacctcctgggttaaagtgattctcctgcgtcagtctcccaagtggctgggattacaggcatatgccaccacgcttggctaatttttgtatttttagtagagatggggtttcactgtgttggctaggctggtcttgaactcctgacctcaagtgatctgcccgccctggcctcccaaagtgctgggattacaggtgtgagccaccacaccccgccaagattaaatacattaatgtagtgcttagcataatacctggcacataactgttaactgctcttactgttgtcaccattggaccaggggatggtctcctgctgatcttggtccctgcatcttgactgggaagagggttgtagccacatggaacagtcctgaacactccgtgtgcgtagacagcgggaagagatcacttctcagagaagcaggggtcaggtggacccccccaaaatgcctattcctaggccctcctgaaagtaaaggcaaggaaccttgaggctcaggattttgaaatcaagaggggatgaataacaacatgttgaaatggctgagcatcccattgtagaatcacagagtcctggccacagagaaacttaaaaaatcatagaatgtaagaatcaaacgctagtgtcaccgtcttaggatagtaacattttagagccctagagcatttaaaggtttgaacacgatcttagaattataaagttaggctgggcacggtggctcatgcctgtaatcccagcaccttgggaggccgaggcgggtggatcacttgaggtcaggagttcaagactagcctcgccaacatggtgaaaccccgtctctgctaaaaatacaaaaattagctgggcctggtggtgcatgcctgtaatcccagctactcgggaggctcaggcaggagaattgcttgaacctaggagacagaggctgcagtgagccgagattgcgccactgcactccagcctgggcaacagagagaaactctgtctcaaataaaataaaataaaaggaaactcttctcttaaaaaaaataattataaagttagtatcatagactgattattactgattcttgaagtcaccaaatctgacaattaaagatgctcatattttgaattataaaatcacaaattcatgcactgatatgttgtaatagagggttattattatcgagacagagtctcactctgttgcccaggctggagtgcagtggcaagatcatggctcactgcagcctccacctactgggctcaattgatcctcatgcctcagcctcccctatggctgggactacaggcatgcaccaccactcccagataatatttaacattttcagtagagacagttctcattatgttgtccaggctggtctcaaaccaggcatgagccactgtgcccagctgagatttatactttaaatttacacattccactatagagaaatacaccaacaccatagagagcttggggaaaataaataaaaatagaagaaagaggacaaaatcacaccactcacagggaaccatcattaacattttgaatatttccttctagtctttcttttttttttccttttttgagatggagtctcactctgtcacccaggctggagtgcgatggtgccatctcagctcactataactgtgcctcctgggttcaagtgattctcatgccacggcctcctgagtagctgggattacaggcgtgcaccaccacggccacctaatttttgtatttttagtagagacagggtttcaccacgttggccaggctggtcttgaactcctgcctgacctcaggtgatccactctcctcagcctcccaaagtgctgagattacacacatgagccaccgcacccagccatttccttctagtcttttaaaatgaaattctaggtcaggcatgatggctcacacctgtaatcccagcactttgggaggccgaggtgggcggatcacgaggtcaggagaacaagaccttcctggctaacacggtgaaaccccatctttactaaaaatacaaaatagccaggcgtggtggcgggcgcccgtagtcccagctacttggcaggctgaggcaggagaatggcctgaacccgggaggcggagcttgcagtgagctgagatcgcaccactgcactccagcctgggcgacagagcgagactctgtctcaaaaaaaccaacaaaaaaaagaaattctaacagaaaaatattaaagttctccatcatagaatctttggattccaaagtcctggcccctcagcaatttgaaatagcacagcctagcatttctgcaatcacaacatattggaaacttgaaataactgagcatctgggaattttgaattcagtggctgttgggatctctgaattccagaatcttaaaatcactgaaactctggaaacagcaaagaccagaatcacaaatgctatgcactcacacacttggaataaataaatgcatttttttttcttttgagactgggtctcactctgttgcccaggctagagtgcagtggcatgatcatggctcactgaagcctccttctcttccattcaagtaatcctcctgcctcagcctcccaagtagctgggacgacgggtgtgcgccaccatgtcaggctaattttttattttttgtagagactgggtctcactatattgcccaagctgttctcgaactcctgggctcaagtgatcctcccacctcagcctcccaaagtgctaggattacagacatgagccacctcgcccagcccagaataaatgaatcttacaggaggaaaattaaaaataagaaagcccatgaggctgggcacagtggctcacacctgtaatcctagcactttgggaggctgaggtgggtggatcacctgaggtcaggagttcgagaccagcctggacaacatgacaaaaccctgtctctactaaaaatatgaaaattagccaggcatagtggcgcatgcctgtaatcctagctactcaggaggctgaggcaggagaattgcttgaacctgggggatggagggtgcagtgagctgagatcacaccactgcactgcactccagcctgggtgacagagcgagactccatctcaaaaaaaaaaaaaaaaagagaaaaagaaaaggaaaatacaaggaataataaaatgctcaaattccaaacatccggaatgaacactcctggtaacattttgtcatgtgtgtctcattgcattcattattaacaaaagaaatgtgagactgtgtgtgaattgcataactggcttccacaatcattgttttgaactgatagaattactttgccaccaatcccatggccccccagctttctcccaagtttcagggcccaagattctcaaatcacaggattccctgtctatggcagggaactggaggctctaggaggagatcgaaggcaccccctcaccccatcccgagggaatcccagttctacccctgtctagatgggtgccacaagtccctggacctctgtttcctactctagatcatggatatactaacaatccctccaagtcgctgacctctgcgccctgtcccccaggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggaggtgagcgctgctgagcgggaggtgggcacggcgggggcatcgcagatgccagccgcgggactgagtcttccccctcccccggtgcactcagatgaacgacccgagccagcccaacgaggagggcatcactgccttgcacaacgccatctgcggcgccaactactctatcgtggatttcctcatcaccgcgggtgccaatgtcaactcccccgacagccacggctggtgagccccgacccgcgcggtgggctgggtcccccgtgggcggacgcgcagcctctcacgcatcgttccccgcaaccccccacccccacgcctaggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcaggtgcgaggcagggctgctggcgcctgggtacctggcgggtgcgcaggagcggggaggggagcaactaccccctactagggagagaagggtatgggggctgtaccaaccacttggcaggattgccgaggaggaggatgagggatggaccgcttgcgggggtggggggactatgccctcctaagggaaaaggggacatggaggctgtgctatgcgagctggacacctttggggaggagagtggctgtgaagattggtctgctcacctttcacatcttcaagggtgaggagctgaacgtttcaaccctgccatctacctggcatagggctctgggcaggtgggctctgccacttgtgggagaggcattgccacaccactggcaggtgagcaggctacagctgccagaaaggggcttgtaggaagacacaaggctgtaccctatctctccagggggcaggctacatcacctggttccccgacgggcagggcgaagtaggctgtgccacggggattgtgcacagggtcatttcacacctggaggagccagttgtatctcggtgtgggcaaggaacttcacggagagttggagtgaggcaggtcctaggacttatgggtgagacagagggttatatatttgaaaggtgagcctggtcaggctacaagacattgtagagaccccctgtctctacaaatatttatttattattatttttgagacagagtctcactgtcacccaggctggagtgcagtggctcaatctcggctcactgcaacctccacctcctggattcaagcaattctctgcctcagcctcttgagtagctgggactacaggtgctcaccaccatgcccgactcatttttttgtatttttagtacagaaggggttttgcagtgttgcccaggctggtcccgaactcttgagctcaggcaatctgcccaccttggcctcccaaagtgctaagattcaggtgtgagccaccacacctgacctctacgaaatatttatttatttttatttatttattttttgagacagagtcttgctctgtcacccaggctggagtgcaatggcaccatagcccactacaacctctgcctcctcggtgaaagcgattctcctgcctcaggctcccgagtaactgggattacaggcaagggccccacggcccgctaactttttttttttttttttttgtatttttagtagagacggggttttgccatgttggccaggctggtctcaaacccctgacctcagaggatccgcctgccttggcctcccaaagtgctgtgattataggtgtgagccactgtgcccggcctacaaaatatttaataataacataaagaatcaggaggaggctgaggcaggaggattgcttgaatctggaagttcgaggctgcagtaagcttgatctcaccactgcactcccgcagcctgggtggcagagtgagaccttgtctgaaaaaaaaaaagaaaagaaaagaaaaagaaagccaggcgcggtggctcatgcctgtaatcctagcactttgggaggctcgaggcgggcggattgcatgagctcaggatttccaaaccagcctgggcaacacggtgaaaccccgtctctattaaaaatataaaacaatttagccgggtgtagcggcgtgggcctgtagtcccagctactttggaggctgaggcaggagaattgctggaacccaggaggcggaggttgcagtgagccgaaatcgcgccactgcactccagcctgggcgacagagcaagactccgtctccaaaaagaaaagaaaagaaaagaaaagaaagaggcagatgagccaacttaaaggaccctatcattcaaggaaggtgcgaatcttccttagagactgtaccacttaagctaagcgccagggtagggcaaaagactggacctctagggttgacacgggcattcagcaatgtacaagaaggaaatgagggccgggccaggtggctcacgcctgtaatcccagcactttgggaggccgaggcgggtggatcacttgaggtcaggagtttgataccagcctgaccaacatggtgaaaccccgtctctactaaagatacaaaaattggccaggcatggtggcgcacacctgtaatcccagctacttggaaggctgaggcaggagaatggctcgaactccggaggcggaggttgcagtgagaccgcaccattgcactcctgcctgggcgacaagagcgaaattccatctcaaaaaaaaaaaaaaaaaaaaaaaggccgggcgcggtggctcacgcctgtaatcccagcactttgggaggccaatgtgggcggatcacaaggtcaggagatcgagaccatcctggctaacacggtgaaaccctgactctactaaaaataccaaaaattagccaggcgtggtggcgggcgcctgtagtcccagctactcgggaggctgaggcaggagaatggtgtgaacccgggaggcggaggttgcagtgagccgagatcgtgccactgcactccagcctgggcgacagagcgagactctgtctcaaaaaaaaaaaaaaaagaaagaaaagaaatgggagcctctgaccctgcctcgggagtgggtggcccactggcatgcctcccccagtttcctcgaacgctcaaagacggccagtcccggcatctgactccagctccggttcccatccacagccatgggcacacacaacatttcaggtggttgctgggacaggcgccaaattccagggtctgtcctggaccccacgtggcccctgttcctggaccccctgggccaggctctcaccttcccctccgtggcatgtttcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcggggtgagcccaggggagaagtcatggggacctcccgacagttgggggttggggaaaagggggatcccacaggaaaaagaagaggcaacaggaacaaaccgttatattgggagagggaggtctgaaaagctcattattgctcatggggaggagacgaaaagtccgttatatttaatagtaatgtcgggggtaagggtcccttatagttagtggagtaggtgaggaaaagccctttattttatttttaaatttctattatttttttatttttatttttattttatttatttatttctgaaacggagtctcgctctgtcgcccaggctggagtgcaatggcgccatctgtgctcactgcaacctcgggccccccccacccgggctcaaccagttctcctgcctgggattacaggcgcccaccaccaccacgcccggctactttttgtatttttagtagagacggggtttcaccatgttggccaggctggttttgatctactgacctcaaatgatccacctgccttggtctcccaaagtgctgggattacaggcatgagccaccgcacccggccaatttgtatttatttatttgagatggagtcttgctttgtcacccagactggagtgcagtgataagatgtgggctcactgcaacctctgcctcccgggctcaagtgatcctccctccttggcctccagagtagctgggatgacaggcgcatgccaccacgcacggctaattttttttttttttttgtattttgtgtagacagggtttcatcacgttggccaggctggtcttgaactcctgacctcaggtgacctgcccgcctcagcctcccaaagtcctgggattacaggcatgtgccaccgcacctggctggaagcgccctttataaagctgtcaggatgtagggtgctcgccagtactgccttactagttatttgattggtttctgctcaatccaatgtttttattatcatccctggttgtattggtggagaggttaaagaataatccattttagccaagggaagcgacaaagaagaatctcattttaatgatggtgggtgggttacagaattgtagattaaggctgggagagggcaaaagactggacctctagggctgacacagggattcagcaatgtacaagaaggaagtggagggcccggccaggtggctcacacctgtaatcccagcactttgggaggccaaggcgggcggatctcctgaggtcaggagttctagaccagcctggccaacatggtgaaactccatctctactaaaaatacaaaaaaaaaaagttagccgggtgtggtggcgggtgcctgtaatcccagctcatcaggaggctgacacaggagaatcgcttaagcctgggagattgatcctgcagtgagccctgatggtgccactgcactccagcctgggtgacaataaaaatatatgttatatataaatatataatatataaatatataatatatatttatatataatataacagatggagaggaagctttcattacactgcattgggcagaatgaggaaaaatccattaataaaattacagtgtaactgaggaaaattctctattagggttaggggagaaggcaaggaagattccgttacattcctgagaagggagatttttttattttggttttttttttctgtgtgtgtgtgtgtgtgtgttttgtttttggagacacagcttcagctgcgtcgcccaggctggagtgcagtggcgcgatcttggctcactgcagcctccacctcccggattcaagtgattctcctgcctcagcctcccaagtagctgggattacgggcatgcaccaccacgcccagctaattttttgtgtttttagtagagacagggtctcgtcatgttgaccaggcttgtcttgaactcctgagctcaggtcatccacccacctcggcctcccaaactgctgggattataggtgtgacccactgctcccggccctgagagaggagattttttaaatatggaggtgggacccaaaaagacaaccaaggtgttagagagaggtgggcttctccttatggcagttaggagacactggaaatattccatttcatcagtggaggctctgattggaaggttccatctggttcttggaggtgacacagaacttggattctggagcagtttgggaggtgctgagaggtccccttaggaaggggtgggaggatagagacaggcagcggatttgcatgtgggatgaggaggtgggagctcctgatgtctgaagatcctgtctctccccagctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaa

SEQ ID NO: 38450 - DNA, 17639 bp, Homo sapiens
ggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcaggtaaggaggggccttctccccgtctcctgccgcagctagagggggagccccgtccctcgccccggcgggaagcccagccgccgttcccctccttgctccgcgagcggcccatttccgctcgggcgcagctcggacggccaaggcggcgtttgggagggaaggccctggatgtgggaacccacgggaggggtgccgggcagtcgggagtcgctcggggcgcgggggcacgcgaggcccgggagggagccgcacgtagcggcgtcgggctcggccccggctggaggcagtgcgggtggagatccggacctcggcgacccggtccggcgcggggtggcggcacgggctccagccccacggtggctgcccgcagcggccgaggtgctcctgagccaagcctgccgccggttcggggctttgctgccccgtgagggggccatgtcgaagcctccgctccctctggactcggggaatgcaggtgggggctggctttgccctcttctctgcagtgaggaggggccgcagggtcgtccagtccccagcggggcttggcggtgctggagattcagttgttcccgtcataacaacctgttgagggctcgtgtcgtgccaggccttgttctaggggaccgagtcctgagcactcccgggatagagagtagtaaatacccagacgcggctcgggcgctggagacagctgagaagggaaggcttctcagaggaggtgtcaggagagagctgggggagagccagcccaaaggccctgaggaacggaccagctcagcaggtggaaggcaagcagggagggcaaggtgcaggtcagattgggcccaggcctccccatcttactggggtctccggcttaggacagggaccacacgcctgccagccccaaggccgaaggacaacaggggagagcaaagtaacttacttggcctctgccctatggagccttccccaccttgtcacccctgggctccaccccttctcaccacccttaggccctagggtttgtaagctcaacaacccgtcggtgtgggaagcactgagggcccctctccccagggtttcctatccggtagctgtgggtggggtttggtcaatcctgttgcacagatgagagagcagggaaagctgagtcccagagaggagagagaaggccttacccagtcgttctcagcgggtcctgcattgcgtgaccatgacctgagcctagccagcatcctgtccctcaactgggtgggagggagggaggcagaggcccctggaatgttgtgagtctgggagactcctcccaggtggaagaaacagtctgtcccagtttccctgttcctgggaggcctggggttgcccagggtgctctgcaccgcaggaattcctcctctgagaatcacccctgggctccaccccttctcaccaccccttctcaccacccttaggcccctatcgtgagctgaccaacccctcccacttctttgtcagtgcttgggagcatcagtctaagagaactaagtagagaaggctgaggactgaccccttctctgcctctcctctcctctgtataaggggacagtaattgtcctctctcccttagaaggcgatgccattgttaagtgtgtcaccacgtgtaaagcactgagcaccatgtctgcacataggaagtgtgcatcctattaactaaaagtcagtgcgggccaggcgcagtggctcatgcctgtaatcgtagcactttgggaggctgaagtgggtggatcatctgaggtcaggagtttgagaccagcttggccaacatggtgaaaccccatttctactaaaaatacaaaaattagccgggtgtggtggtgcacacctgtaatcccagctactcaggaggctgaggcgggagaatcgcttgaatccaggaggcggaggttgcagtgacccaagatcgcaccattgcactccagcctaggtgacaaagcgagactctgtctcaaaaaaaaaaaaaaaaaaaagtcagtgcttcagttatttcctaagctttgatacgtaatggcaatcctggtatggccagcagccccataaccccagtgtggttgctggatcaagtagcagcagcaggggcaccacctgggagcctgtgggaaacacagactgttcagccctacccctgcccttgggagcagcatctgcatgttaacaacaccagggtatttcccacatcaggtctgagaagatagctctagaacaagcctggtgctcttgacccacaggtggagaagccgaggcctggagaggggcacctggcaagttgttgactgggggcctgggctctggagacagacagcctggattgctggcctggcaagtggctgcccctctgagctccacgtgcacaatgcggataacataagtacctccctcccagggttggaggccagggctcagaggttaggcacagaggttactacgttgttggcaggggagtgggggcaggcagagcagctgacacctcctctgtgtttcctcagaccccacagcaatgggggcttcacaagaggtccatggacctgggaaccaattcctttccctccttgcccttcagtctcttctctggtaatcccagcaacttgggaggctgaggtgggagaattgcttgaacccgggaggtggaggttgcagtgagccgacatcgcgccactgcactccagcctggacgacagagcaagactctgtctcaaaaaaaaaaaaaaaaaaagaaaagcagcaaccacctttgtacatgtgtcacttttgtagatgtttacatccctggttttgtttgatccttacggcacccttattaggcagatgttgtccccatgatacttggagggggagtgactcaccccaggtcacacagcaagcacgtggcagaaccagcagtgcagccccgtcttgttgactccaaaatctgtgttagctggaggtttttcactggtgaattagagaagtcagactcaaactggcctaggcagaaaaggggatttgttgggttttataactgaaaagtccaagcgggtaggactggctttggatgtggctgaatccaggggctccagtgagctcatcaagatctgtctccatccgtgtctcagctctccactcctccgcgtcggctttactctgaggcgggtacctgagcgtgaggtcaaggtggtacagccctgacttactgagctcagcagagagtgtttcctcaattgtcaatgagaatctgccctgagacttttgctctaataatttattctaataataatttagatcaaaagcctcagggcagattttcattggccagggtgatggaacatcctgactagccagacttagatcacaggtgcattccctgggttgtgaagggttagtcacgcatccctaaacttccagagagtctagagtctgggagctgagtttccacctcaggaaaacggtgctcttaccaactggcagcagcctggatgctgggcaggcaaaaccagaagcccaccccgccctccataccctggactctgcctgactcccccactctcctactccctgcccctgttcctccccactggcctctgtgcctcaaggggcctctcagcttgctggtgactgctgggtgcctggcctgcaccctggccctgcccgtcttggggctgcgtgacattccattctgggtcagagttggtgctgggctgctaggaccaggcgttcactctgcctggcttggctttataataggggtggggatagctggtcatggtggcccacacctgtaatctcagcactttgggaggctcaggcaggtggatcacttgaggtccagagttctagaccagcctggccaacatggcaaaaccctgtctctactaaaaatacaaaaattagccaggtgtggtggtgcacacttgtgatcctagctacttgggaggctgagatgggaagactccttgaacccagaaggctgaacttgggaagcagaggttgcagtgagctgagattgcaccactgcactctagcctgggtgacagagtgagactttgtctgaaaaatatatgaataaataaataatggggtggggaggagagggctgtagaatctccctccttcatcaggtcactgatactctcaactcaaagttacaagttattatctcatgccaccagaagtcatgcaggaggcgcgctgcacacccgcttccagctgtaagctcctgcatgctcagcgtggtggcccagtcctccaggggtgcaggaagacagttctggacaccccacacaggcacagatccccccatgaggcatcacatgcctttgcctcaaccaactgctggccaggagcagaagggccacccttcttgacttcgaccagagccactctgcagggcatgctagctgtaggggaagacagttagttactcatttggcagactgtcctatgcattgcagacatttggcagccctggaccctgcacacaaaaaaatccacagtcctccattccctagcagttgccatgtcaaactagagcagtgctccacaccggctccaccccagagaccattggctgaaattaatggagactcaacttctggtcctggggaggggcccctgcttgaacactaggttttatggagggatcctgaacaaaatagtagcttgttagtgaggaagaaggggacagtgtctggtggtcagtgttggcctcagttgcaaaacatccagtgactcaggccagaaactgcaccatcagccgtctttggcctcttctctcattccctgtgtttgatctgtcagtgggtcttgttggccaagcctcccaaaggtctcccaagtccctctgttccacctgcactgctgccactagtgcaagcctctgtcctctcatgcatggactgttgcaggagctcctcatggcctccctgtctctgttcctcctccacttcagtcccttttcactggcatcctgtccccatggaaaccagacctctcactccttgtaacacccttctggttgcacttagagtgaagtcgagttgcatgtgggacctggccctgccaacctttctggtatcagctaccctggcctgttttttgcccttgggacaggccaaacctgtttctacctctggacttgtgcatctggatcttaggtgattctccctggaatgttctttatctcgatctttccaaggctggctcctgcttatttattgagatctcggctcaaaatgtcaccttgtttgactacccagtccaagcagtacctttatattcattgggatttgggctagctgttgaaacaaaggctaggataataaaatagattatttttatctatgcaggcagcctctgtgcaagctgtccagtacatgcacggaggcctcattgtgctggggacccagacaccttctttctcattgctctgttaccctcgtacagggtttctgcctcgtggtctgaggaggctgctcttgctcccactgtcgtatctatattccagccaccgggaagggaggagggcatgatctgaaattagcagacctcactctgctcgtgtcatatgtttataacaaaaaaaaagttctttttaaagacaagtcagggtttttatctttgttgggcctctgttttagagtttatgtcttcacaccatgggattagatcaaatgacaggctgaaggactgtcagcctgtctcagctcgtgtccagttggataaaactcagccacatggccacacccagttgcagggaagctgggaaaggtccccattgtgctgggaagcgatgtgtaagctaaactccattggttccatcactaaagggaagggtagatgttgggggaacccagcagtctctactgtgtttcttgtcattctgctccacctctctgttttcttcacttagcatttatctctagaagtttgcttctttttttttttttttttttttttttttttttttagacagggtctcactctgtggcccagcctggagtgcagtggtgtgatcatagcttgctgctgcctgctgcctggagctcctgggctcaagtgatccttccacctcggccccaccgagtagctaagactacaggtatgcaccaccatacctggctagttttttaaactttttgtagaaatagcgtcttgctgtgttgctcaggctggtctcaaactcctgggctcaagtgatcctcccacctcggcctcccaaagtgttgggattacaggtgtaagccactgtgccctgtcaagtttgcttttttttttttttccaagtttgctttttaaatagggttttcatgcttgttgttggcttcaccttgctgtgagggcagggccttgtctgctctgttccgtgccacgtccaaccacctagacttgtgcctggcacccagtaggtgctagttaaggtctgctgagcaaataaaagcacgtgtgggctgggcatggtggctcacacctgtaatcccagcactttgggaggccgaggtgggcggatcacgaggtcaggagatcgagaccatcctggccaacgtgatgaaaccccgtctctactaaaatacaaaaaattagccgggtatggtggcacgtgcctgtagccccagctactcgggaggctgaggcaggggaatcgcttgaacctgggaggcagaggttgaaatgagccgagatcacgccactgcactctagcctggagacagagcaagacaatgtctcaaaaaaaaaaaaagcatgtgtgaatgaagggtgggcttctttgcccccctcccaacagtagggaaggagccatcttctttcttaggatctactatgtgtcaggcatttgttctctttaatattccccatcacttgaagattgcagctatggcctcattttattatttttaattaattaatttattcttttttgaggcaaggtcccactctgtcacccaggctggagtgcagtggcacgatcatagctcactgcagcctcgaactcctgggctcaagccatactcccacctcagccttcctattagctgggactacaggtatgcaccactatacctggctaagttttgtgtttgtttgtttctttttttttttttctgagatggagtttcactcttgttgcccaggctggagagcaatggtgtgatctcagctcaccgcaacctctgcctcctgggttcaagtgattctcctgcctcagcctcctgagtagctgggattacaggcatgcaccaccatgcctggctaattttttttttttttttttgagacggagtcttgctgtgttgcccaagctggagagcaatggtgtgatctcagctaaacgtaacctatgcctcccgggttcaagggattctcctgcctcagcctcccaggtagctgggattacaggcatgtgccaccatgcccggctaatttttttgtatttttagtagagacagggtttttccatgttggtcagggtggtctcgaactcctgacctcaggtgatccacccgccttggcctcccaaagtgctgggattacaggcgtgagccaccgtgcctggccctaattttgtattttttttttttagtagaggcggggtttctccatgttggtcagtctggcctcaaactcccaacctcaggtgatccacctacctcagcctcccaaagtgctgggattacaggtgtgagccaccgtgcccagcctttttttttttttttttgagacagagtcttgccctgttgcccaggctggagtgcagtggcacgatctcagctcactgcaacctccacctcccgggttcaagccattctcctgcctcagccttccaagtagctggcattacagctggacgccaccatgcctggctaatttttgtattttttagtagagatggggttttggcatgttggccaggcttgtcttgaactcctgaccgcaagtgattcgcctgccttggcctcccaaagtgctgggattactggcatgagcctccgcacccggccaatttttgtattttttgtagagatgaggtcttgctatgttgcccaggctggtctggaactcctgagctcaagcagtcctccctcctcagcctcccaaagtgttgggattgcaagtgtgagtcactacaccctgctgtccttactgtttagatggggacttgatcccagagccagtgagtggcccactggagcaacctgagccccagcccatggcccgcccccttcagagtcttccctccctttcatccagaggtgttctggtgtttaagggcttggaccagcaatggaaatattcctaagtccccccacccctgtcttgggctgctattgttcagggatagctttggtgacaacacaagcagggctcctgttgcgtttctgcagaccttgctgacaggcatgcagctcactgggcggctccttgctgaaggggaggcctgggcctttgatgtgttgtcgggacaaatcttttttctttttcttttttttttttttttgagatggagtctcgctctgtcgcccaggctggagcacagtggcaccatctcggctcactgcaagctccgccacctgggttcatgcaattcttctgcctcagcctcctgagtagctgggactataggcacatgccaccatgcccaactaatttttttttttttttgtattttagtagagatggggtttcaccatgttgtctaggctggtcccgaactcctgagctcaggcaatctgcccgcctcggcctcccaaagtgctaggattacaggcatgagccaccgcgcccggccacatcttttttactttttaaaatttactgaagtacacctatgacttaggagtcatcggtgtgtggcttgatgaattaccacacagtgaacacacctgtgtacccaccacctggatctgacacccagacgctggcaggcctcccccaattaccatgcgcttcatctccccaaaggcgccctgtctgcatttctccacggatcatacgcctgtcggcccttgtgcctggcttcacgctatatcacttctgagagtcattcgtgttgcctgtagcagtgggttgttctttttatgctgtgcaagtgtcaaccgtaggaacctgccaccatttatgcccatgctctggggctgctccccgcctggggctgtcatccacagcctttacaagcattcctggtgaagcagagtcacaggcatctggcccaatctgttcaaatcattctaaatgttggcatctgttacgttctggtgccccaggccacacctggatcaccccgaactccctgcggaagtacctgttgctgcctcctgagagtcctctagcttaggagtcttggttttccgaccagaccctcagtcccctaaccccagagtggttcccaggaccccagaccaccagctctcctgtcttccaggctagactcgacctctcatgctcagagtgtcatgtggacctctggcctatggacccaccctgtccctggcttcaccctgcagcgtggccattgcagacacacttgccttgcccctctgtggtacagcctcttcccccatgcccatctccagttggagacctcctgtgcatcttctaggcatggctcagtgtcccctccatctttgtctgtggtggcagagggagacaagggccagagggtgcaaccgaggagggcatggtgctcagctctggccctcagcagcgctgtggcctcacacaagtcagtggcctctgagttctgcatggtgtggcaggtcagaaccatggctgaccgctaccaagaactcctcacgtgtgtgccttgtttgaggcactcggcatcaccacagcctcacttgttacacccattccatggtggggggacacaggcacggagaggacaggaaggaaggggcagggctgggctgtgaacccagagcctatgctcttacccacgctgctctcatgggccctcaggactgaaaggagccaagtggctgtgccttgcacatggagatgcttagctgagggggtggctttgttagactatttgcaggtcgtgagatagagcctgagatgggggactgggcccctgcctgggggattgggtcgtgacctgtgtggagccccacactgagctgcagtgggtggggagggtggtttacaggggtgctctgtgcagcccctctgattttcccctgggagtcccaggtccaggggaaggaggacagtggcccaggccacacagctcactgggcggctctcactcccccagggctggctgctggcgggatggacaccctggaggaggtgacttgggccaatgggagcacagcgctacccccacccctggcaccaaacatcagtgtgcctcatcgctgcctgctgctgctctacgaagacattggcacctccaggtgaggcagtcacaacgctgggcaggctcgctgagtgtcagtggcttttcctggtgtaggggggtggtgagggtggggcagattgtgtcttggagagggggtgcatatgtggcctcgccagtgagccagctcctgtgcccatccgccagggtccggtactgggacctcttgctgctcatccccaatgtgctcttcctcatcttcctgctctggaagcttccatctgctcgggcgaagatccgcatcacctccagccccatttttatcaccttctacatcctggtgagttcactgcagttgacagaaaagccaactccaactgggttaaacaaaaagggaattaactgcttctataatgaaaataagcttcaggtatggctggatccaggcagttaaatgatatcgttaggatctgtttctgcatctctgatctctttgggacttatctcagatgagttcccctcatatggtgtcaaagatggccaggagcaactttgagctaacatcctgcctctacaactcaggcaaacagtgcctgtttgctgatagtgccagtgtagacctgggatttcctctgactggcccacctaggatcccatcctcatccctgagccaagcactgtggctagcaaggaaaggggcactgtgaagctgggagggcagcatcagctcagctggaccatatggactgagggagcccacaacagaattggggagctggtactagaggggaggggaatggatgctgggtggggaaaatgcccactgcatcctccatccattcgtcccccatctgtccattctgtgaaacctctttggagaagacatcttacttgctgggagagcctgcattgtcaccacttggtggtcctggcacgtgttgcctggggagaggtgtcagggctgtggttgagaaggcagctccaaatgtgggctctcctggtataggctccaggtgtgggctgtcccagtataggtgccaggtgtgggcttcaggtgtgggctgtccaggtgtgggcttcgggtgtgggctctccaggtgtaggcttccggtgcgggctgtcctggtgtgggcttcgggtgtgggctgtccagctgccttccttcagggcgcccttcccctgtctgcagggcctgcctgactggagtcctcccttctctgtggcccttagataccaccacatgagagctgagtggctccctggtcccctccttgtggtctagcccagaacttcccagtcagaggagtgggctgtgggcaggcagagagacagacaaggggctggggaagcctggaggttgtagtggcctgatgtccctcacacctacaagatggtggtagacaggactgggaactgaggcctgctttctttgcttctctcccactgcttctctcaccatttattcatttgtgtatttattcaacagatattaaacacctactgtatgctaggcagatgtccttttgtggggtaagggggagtgcaggcagggagaaagagccagggctaaatgtccaggaacatataacagggcccagcccatcaacttttggggactttgtcctaaagagttcaggaggcagtgttaagagtggactcaggaagtccagctctgaaccccagccatgctgctgtgtgacctggggccagtggcttggtctctctgtgccccagtgcccttctgcataacagatgttgatctgctttagctatggtgttcatgtgagcacctatgaagtcgtctgcatagctgcagcccagtgggagcctggcatacagtaggcgtgtggtagtttgttgcttttactgcctgccctgctgacacaatttctcatggcacaaaagacagagtatatatggatctgggcatgtgtcagaagacccaactgagactcacagaagccagtttttgactgagaaactgggcagttcctgggcctcaggcacagcaggatttgggggcacagcagtgctgctggggcaccatctccatctcccactcagcctgggatctccccgatggccctgctctctcgccatctgcccttgtggcagcagggtggtgtccatggtgccaggcttgcatgctgtccgtctgcctttcccagcagccccacctgacatcctgggtctctctcacaaggctcccttggggcctatgcccttccctgaactagccctgaggccaggggaatggcacacaccactggccagtgctgcgtcccaggcccatccctgaagccaggagcggtggactcagcctcacctggaaccaccgaagtgggggtgagaagggagaggaaggggatggatataccaggccgataagcaccacagatgctgagcaggcactttgtgaaacctgctgggctggtggcttccctagaggtctctgcacctcttctcggtgaccttttgcctggtcccgcatgcctcagaattaaaaccatgaatacggtaataacagcaaatgtatacttggcccttcctgggtgccaggcaggcttctgctgcatctgttaatccatttgacccaacaatcaaacacagtaggttttgtttctgcccccattttatagatgagaaagctaaggtacagagccaggaagcagcagcgtgctgcttgtgatgtgaacctggcccatctggctccaccatgcgcactcctgctcaccagcccaaggctgttggtgctagccaggaagctggggccccgagagggagggccaggctggaagtcacctgcagttgagggtctgcaactctgtgagccttgcttcctggagtgatccccacctccctgtgtcccaccctgactttgcgccttcctcctttccgacctcaggaatcaaaggctcctgtagatatgggggtgggcttgctgcccctgccgatgcagaggctcttgttccctgactgccacaccactcccttgcccaccaggtgtttgtggtggcgctggtgggcattgcccgggccgtggtatccatgacggtgagcacctcgaacgctgcaactgttgctgataaggtgcggctgggccctctgagggaggccagggaggcctggcctggggtgggctggggatgctggtccaggctgacgctgtgcccactctgcgtgcagatcctgtgggagatcacccgcttcttcctgctggccatcgagctgagtgtgatcatcctgggcctggcctttggtgtgtgtaccgctgggctcttgggccctggcgatgctctcccctgcccctccctggctgtgggctgactctggagtggtcacctgggctggctcctgcctgctgaccagcatgtttcttccaggccacctggagagtaagtccagcatcaagcgggtgctggccatcaccacagtgctgtccctggcctactctgtcacccaggtaagagggtgagtgtgggcaggggacgctaggagtcagggcaccaggcacccactgcttctgggtctgggtcaggtttccagtctttatcaccttcagagttctcaaaactttgcacctgagaaatcacatggggtgcttgttaccgaggcacattctggggtcccctggagatttggatccagtgggccagggcgccaggatgggaggctcaggacttgccgttttaataaggagttcaggtagggatggtgcaggtccgcagacccccctgagaagcatgcatctagaggcccctttcttagattgggggcagggactgcaccttgtccatctctgcccccttccccatgtgactcagcccaagactgggccggctctggatgctgcaatcagttgggcaggacatggccagggagcagactggggcaggtgagttgagggtcaggccaagaggctgaacttggtgtggtggagagcttagggggctttgcatcagggaaagcccctgggagagagaagccttgagatcctctcccttcctcccttcctgcttgcccctgcaggggaccctggagatcctgtaccctgatgcccatctctcagctgaggactttaatatctatggccatgggggccgccagttctggctggtcagctcctgcttcttcttcctggtgaggttcaggctggggcagctggggtggctggggccttagggccaggtagggattggattcctgggtttctggctgtgggtctgggctggcgcccccagcaccttctcagccctgcctgtctctgtaggtctactctctggtggtcatccttcccaagaccccgctgaaggagcgcatctccctgccttgtgagcagctggccggcggctctgggacaggcggggatgggagggagtctaccgggccactgtagagctggtagctgggagctggagctgtagagttccaggctgggagctggagagccctgggtgagagggaggcctagaggggccccgggggacacaccaggcttgagggtagtaggtgctggaggcagagcctggcctgtccagggtgggacctcacgacccaccctgtccggcccccagctcggaggagcttctacgtgtatgcgggcatcctggcactgctcaacctactgcaggggctggggagtgtgctgctgtgcttcgacatcatcgaggggctctggtgcgtgggggccgcagggtgtctgcctcgtgggggcatgggaagtgggcggcagggtgtccacccgctgggggcatggggaggtgtggagtcagcatggggctaggaggccccgcgctgacccgccttctccgcagctgtgtagatgccacaaccttcctgtacttcagcttcttcgctccgctcatctacgtggctttcctccggggcttcttcgggtgagtctgtggccgccggcgcccccgcgtggctgccggcggaactgcgccttcttccagcatgggtgtgaggattgaagctgagaggctgtgtatgcatacagtgcgcatgcgcacgcacatacatacatgcacttgggcacacacatacagatacacatgcacatgcacacagatatacgcacacccacccacatgtgcatggacacgtgcacatgcacacacggatgcacaagcatgcacacatgcacatgcacacacaaacacgcacatacggatacacacgggcatatgcacacaaacatgcacgtgcacacccacatgcatgcatacacacatgaacacgtgctcaacatatacatacatgtagatatatgcacatatccacatatacatacatatatatgcacattgtatgtacagtacacacagacatactctccccacgagagagagagtgactatgcacggtgttctacattgctggtttttatttaataatatattaactcattcattcgcaagcattcattgagcacctactgtgtgccagacactgctagagccagaagatgcgaggcccacagcggatgcaaatcctgtcctcacaaagcttgtaccctgttgggggaagacttaagtggggagcaggtttggggtgggaagtcagttggattctctgggggtgagtacactgctgtgcacatgtgcatctgcagaagcgtctgtgagatgggatgctgaagacatgggattgggggtcccactccagaccttaatgtggtcggaatgtgggtgttttgtcccccctttctcacctgccaggtcttgtggggaggggatcagcctcccacctgggtgaagctgggagagggccagactggtccatggccccagcttggatctttgcacacaatttctcccctgagcctcaggctcctttttgtaaattgggtgtagtgtgtcccccttggagagttgccctgagggccgagggacgaggtcagagtggagtgggtggtaacatgagcagcaggggtcacaggagtgggggcggaggccacagccaatgtctcctgagtgcttgggcaggcactgttgaagcctcatgatttatgtccattcttcctccacacggtgtccacacacccatttcaccatgaggaagcaggcacagatgccccccgcctgagctcacacagccagggggaggagggctgggttccaaaacaagtctagatgggctctggggtccagctcacaggcccactcagagtgggtgtcaggcgactgttggtcaattccttccttatctggtggccccatcagcctggagaggaaggctcttcctgaatcactcagtgaggcttccatgcccctcttttccttttatcagctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataaaaaggaaaaggagcagaa

SEQ ID NO: 38451 - DNA, 144237 bp, Homo sapiens
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtgagtgaatgaatgtgcgtgtgtgatggtgtacgtgtgtgtgagtgtgcgtgttatatttgtgtgtagagggaaatggagccggccagggctgctgggctgttgatactgatgctgtcaagaccacagatcagattaggagaaggtgaggtcagcctgcctgttcccatgtctctgggtcaggcaagctgttcagaggccaaccttgtcagtcccctgtcttcagatgtttctgtggttctggcagggatgtctggggtgcggcttgtccctgctctgagagagcaaccagtcagaaggagtttcgtttgctggggaagttgctggtgtcagtggctgcttgggactgaggccagctacaggagtagggagggacacagggaccaagggagggggaagcttgggagtctcttctgctacttgcctgcccattgcagggggatgagtattttttcttcttcatctctttccctgccacccacttgagctgctgtgagggcacctttcttctaggggctcacttagctccctgaggtctgaccttggctgcagggaggggctggcaggcctggcaaggttagggttcaaagcacttttcccatctccactcctcagtgtgggccctgctcccttgcccatgggcacagactggcagaagtgccccctctgccctctccaaccactagcccttactccttcctcacccctctgggcagaaatggctaatccaggtggttaatgaacagacaggggcagctgccttccccctgctcctccctctccccccacccctcctgtcctctgactctgatgccctgcctgccacccgttcccaggctggagaatccatacagagctgacctcagtgtcagtcccccaacccccaatccaggacttgggccaggactgcctgcccagatgttttaggctggctactgttctagaagaggaaactgggtgggggtgataggggggacccggagaagcctgctgtgctcccaggctgggctccctgcaggggaggggatggggttgggggataggatgggtgctgggtggggaggagatggaggaggagggcaggcaggcaggcggttgtgggggtgagaataggagggggacctggaaactagggtgccagggtctttggagacaagggcttctcttctggaagtcccagctgcctcttcaatgtggcagcagtggggaaggtgtagggggagcaccctctcttcccctcctgaagctgcctggggtgggtggagaccatggtggctcacatgtgacctcaagttgcacctgcccctgccagctggtggccactcctgtaagcctgaatacagctctccttggacctcagtacttgctatagctggggcaccccttgcctgaaacctctggcccagggttgtggaagggagtgagggaggatgtggattgagatggagaggttggggggagagacccgaatgggatcagcactggagacccaacttggggttggcttggactctgctgcccatggagggcagggatttggagagcagtgggctggaccaggctggggagggtctcggccagtccggccgagcaccagggctgggagccagcactgtaaccaggagctgagggttcttggcggtggaggaggcaacctgggaccctctgcttccaggcgcctggccttgagcccttctggctctgcttccccatccctcatcccatgcttcttcacacttcacttcccgcaaggccccagtgaagaatttcccagggaggtggtggtgtccaggaagtataagcacagagaacctggtggccaggtggagcggggctgggttgggatgcttatgggttcagagaagatgttattgttttgcagaccaacttctggcctctgatgggctgtggctgaagccttggagtttggggaccctcaggctcctgtttctacccagataggagcaggagtcaaggggggccagaaagaacttttgtttggtctaagggagaggagcctcagaggtggaatcttggctcaggtgaaggaagagcttcctaaggaccctggtgggtcagcaggaggatgggctatcttgtaaggtggagagcatcttgtactggggggagtttagacagaggccgaataagggcttggaaggattcctgggctgggatgtggttagaggcgatgacctggatggtctcttgggatgctgagggcctgggatacttggagtcggggagttctctgacaccagaatgggggatcaggaagctgtgtcctctggcctggggcgtgggcgcagaccactcgcaggggccccctccttcctgccaatgtgtaaggaaccaagagcccgacgctctgccctggcactgtgcccctccctcacacccgtggctcaactgcctaccaggtccgcacccagctgcttcctgcaaaggttctgaggttcttcctatgcctcctggcccactctgccccttgcctgtggtgggctgcgtgacagtgtggagttgaggggacagcaagcaccacaggcttcacccccaatccctgcagttagagcccatgttccctgttgaggggctctggggctggtgtgcaaggaccgggggtgggtgctgggatgttgggcatcttgaacccctgcccagtttggcctccccaaaacaggcctccctagccagcctggagatagtagaccaagggcagtgccaggatctgagatgcagaaaaactcaggcatgggtctcatatgagcctcagtttccacatttgtaaataatgcgggttgtccgggcagcatcaagtggcttgcataactggcatggggtgaggggtgcaaggcaaggcagttgctctcaagggcctcttaggagggtgagtgggggaggagcagtcacctctcacaggcctttccaaacctgctttccctgaggtgggcagtgagaggagaaccagagagggctggggccaaagctttccccaaaccaaacaggtttgggcttcccatgatggaagtgcccgtgagtgcttccgggtgggcttgaaacccaccctggactccatccttcctacaccagccagcctcctccacagcccctctgtggatgcctgtgcccccttttctcctgaccagagagggtgacacagtaggagattgagatcacccaactcaaccaccgcctccgaccaggggagccccctcacagtcttggtttcatctgagagggaggtcctttccgatgtctaactccaatcctcttctccagtcagggactacatgaagttgctaaatgacgacactctttcctggggtttgaaagagactcagtgatggtgggagggttgtgcagggaaggatcgggagacctgagtgtgccgtgagcctgaggcaccagggcaggagcgagggggacaggcaaaggctctcggctgccagtgcctctggtttcttggctcagttctggagccaaaagcctctttgaccccaggaaactgaggcccagttgagcgatatgtttggaggtggggggcagaggagataggcaggaaagccctcccagttaccagcctccaaataaagcaaatcagaaatgggtggagggagagggtggtttttggagactggggtttgggaggactggcctagactttgtcccccttactatccaccaatggcccctcgctcaatagctccctggccagatggctcttagctttctagggctgttaggcatgcagaggtgtgggcataagtgagctgggacaaggaggtgggggtggcagggtggccagcctggcaggctttgcccacatcccctggtgacacttccattatgcaaggtcacaccggcccttccctctttccttccctccaatggtctggagcgctttcccgtccaggaggttgctggacgctagagagccccagtgcagcctctacccaggttggtggccttggccatcttcctacttgccccacctcaacttccctcaaggggagaggcttgtctctgtggagctggagcccatgtgggaggggtggtgggtgggcctgagccagtccttggagctaccgcctccagggctagtctgggctctgcagtccctgcctttttaggcctggaagcctgtagctcagccctgggtgtgggagacaggagggactggaccagcaaggcgggggcctggggagctgatgggggtcaggggtcacaggaatggctggggggaattctggccctttggccactatggggccccagacctgggtccatttcccccagggaccttcctagaccttcatcttctcctgcagagaagatgggaccccacagcgttctgtgatccttgcaagtttcccatttgctcacctgtcttctggatggattacaagctccttgagggcagacctgcacctctggcctctctggtgatccttgctgtgcttggcagagtgccgctcaacatggatggctggctaatggagggcagaggggtgagggttttgatgaggcctggtgaggatttgttagacttggactgagaggtctgtcttgaggcagagaatgtgagtctggtgccagactgctggggatcaacttatgatgacccggtttaccagctgtggtctcagcaagtgactgaacctctgtgagcctcagtttcctcactatcaaatgggataatgtctgcttcaaggtatggttgtgaggatcaaacgagttaatttatttaaaacactttgggcggtgtctggcacatagcagatgctcaatgaaggttagttattattattattattattattggtggtggtggtgatggagttctctctctcttgtcttgttgttccatctctaagatgaagagaattatgggaccagagagtggagaagatgctggtgtcattttcccttaagaggtcctaacatcagatcccagggaagaatcttctcttcccccactctgtctctctctgcaattagagggcagacagggagctgagcggccctccggaggtcttgtctgttcagggagcccatgcagatctgtgtttacagaggactctgagaaagttgccatcactgtaaacaagatgcattattataaaccagcctgagctccccttctgggatcccatcccatgccttgatgagagtcacagaatcggagactcccaggctgagcaaggacctcacctggcctccaggaagcctgccctggaccatgggctacacccatagatatggcatctacattttaaagtaggatccccaaataactgcttcaaattattgtgtcttatgccctctaggtccccccaaaatctaactggcattcctcttgatgcagctttaattcagtcccttgttggtagtgggtaggggagaaccatgtccactcttcctgcatgccatataagctgagagctttgaacccgtgcaagggtagggctcctggccacaatccctctctgtcccaggcctctgccctctctggggtctcctgttttccggtgcccctgacattcctcattagcaggggtcagccctcaaggcctgccaagctgtattctccacccaacgcagttcccacccagggaggctggggttgctctgggtcgggggtgaactccatttccggacccctggcccgcccagttgcagctgcaaaaggcattaagcttttttttggagaaagaatgggcttgggttgatgatgatgacagctggggagtgttcctgagctcagcctggccctatcttgcttcccttccttggcccctgctcacctctgcccaatttctaggccatttctcatgtagaggtgggccttatctttaccccttgaccttgaccagacctggacaatcagctggtctccagccaccctgtatgggagcagtttttgtgttcagtcctgggcttggtgctgggttaggggataggggtggggaagagggcttcaggggaagcggaaagaggggctccaccctgggtccatctgggtgggagagcagtgctcctcaagtgagcagatctgagtctaggcctggctctgtccctagcctctggaggagtcccacctgagtcccttctctcgctgggcctcagtgccctcaactgtaaatgaagggctgaaaggtgcaggggtggggggtctgtgagtccatctccccggggcctctgctgggcgtcccccagtcccaacgctgtggaacttcaccttggattgaccttgcttccctccccgccctgcccccaactctggcagtcgctggcaggaagtcctgctgattagggccctaatcaccggctgagactcccagaaatggcagagctggttgagtgagaggggccgccaagccaggaaggggggctggcatggggagaagcctccacccagggacatgagctggggttcgggctatgatttgggggtggcagagatgggccagccccaggggttggctccttgggtccggggcagtgcctgtggacccactgtggacgctgtgcggcagcagctgagtccagctgggcacacggggccgctggattgttcactttaaaagcctttgagggcatccaccctatgccagttaaggtgctgggtatgaggctggaaagaccgggagacacgatctagtggggggagtaggggagtaggggagtagacagagtgttgctgcaaaacgcagtgggaatgtcaagcaggaggcagctcatgtgagctggcagagcggaggaagctttggagaagaggtaccatttgagatggattttgaagtttggcaaggagttttgcggggaggaaaaggggcaaagacttcttcaggcacaggggaaggcatgtgcagaggcccagtggcatgcaggtaaggagaaataacaagcgtgggtctccctcccagctctgctacatgggtctgagccttagtgtctgcatctgtaaaataggattcatatttccaaccttgtagtgctagcgtgggtatgaaatgagatgctatttgtaaagttctcagcccagtgcctggcatggagcaaacccacagtatatggaggcttaaaatggcatgtgtgggaaaggatggctttggggagagcctgaaactgttgcttggggctcaagatggggggatattctgaggcaggttaaagaggggagcggcaggggattttaatacagggaagacatgatgagactgtgatttaggaagggcatttgggccactgtgacggctgtactgggcaggggagtcctaggggcaggcctcaagccagggcctgggttcctggaatcctatgttcaaattcctcagccctggggctggaaaatcctctcccaagtcacttcatctccctgatccctctgggcttccttccagcataccatcctcccctcctggattgggaggccaaggaggcccctgaaatctccttcctgggagatctttcaggccaggagagagccatccttggcaagtcttcacacgcagccctgggatggatgaactgcagcaggcaggagtgagggtagactgtaggcagcttatatttttaaggcaccgagaggatcctttgggggcctcctttaccatctgacctggaacacagtagccccttactgtttgttgaatgaatgaatgaatgaacgaacaggagtgttccctggtcagggtggaggagcctgattgctcggaggcagccatgcccagcctggctctacgtggcctggtgagtgcagagagtggctgcctgtccagagctagatggaatgttgagtgtctcaaaggccaggtgcctggcatgtcgcaggtggtcagggactgtgtgttgatgaagaagagggaatttcagcagcgtttatttcctagagcaatgacctctcatgaggcagtgtgatgtgggggtcaccttcacagtgtctgcagccacacggtctgcatgtgaatcctgaccccatctcttgcaggctatatgactatgaacaacttacctgacctgccagtgcttccctttgctcacctgtaaaatgcaggaaacaaatagagcgggtctggcatgcaggctgttctgcataaaccttggtgattgttattgctgtttttgttatggttattactattattgatacagtgggagagagtggggctggcagcaggggtttcttggctgggatgagtgcaactgcccagagtgggaggggagagcacaagagatagatgaggctcctctggaggcttagaaggaattcggtggctcacgaactgcttccaccaccacacatgtggctgcctctgctgtggccggctgagctaggccaagcgtgggagtggaggcagtggtcaggtctggattccaggctggagccctgggagagcagaggcgagccagggtgaggggtgggggctgggggaggagaggtgattggagaggaggccatgactctcccaagttcccagctgggaccctaagaattcctcccatcatctcctgccagagggcctggcccttgagctccagagcctccggagggcctgcagtccatctccctgcctcctgggcagactgttctgagtaggtggcctggagtccagtgccccttcactgttggaaagtgattcctccccagtaaccgctgtctggctgcaactccttcctccccctcctcaccctgccttcagatctcccgtcttcagcactgctttgcaacaggagggtgacagagtcaacttcaggggcctgctctgacttggggcagagagagaggtctgtgtagtgccgcggaaggacctgtggcaggggcgtcaggtgacctgctagtcccttttggcactgtgtgacttcaggcaaattgcttccactttttgggctttggtttcctcaattgcgaaatgagaagttcgagttaggggcgttctctcttttcagcagtgctgaaattctgtaagtgcatggatctttctgaacagagaggctcctagtcttggggcctttggcagagctgtccagcatcgaggtgggatcctgttggctcttcaggcatctgctgggatgccatctgaaatgctggggaggtccttccagcactggaattggaacgttctttgcccagtgaccactcctccaggcagcttgatttcttggaacagagcagagggcaacagctgtcagggttgggctggccagaatctcccgtctctgtcccagtgactcaggtggggatacgcttggcaggattggagccaatgaagcaaaggaggggactggggaagatctgctgcctgccttggccacccaaagggaacagagtgggaggaagtgatgtgctggggatgggggtgcagaggcaaagtgagtaacagttgtgagtaatggctcagtgtctccactgggtaggtggctcctagactgcacagagctgtctggggctccggaaattctccccggaggcccagccactgaatcacagcagcctgagctcctccctccctgtcctccttaggagctgggggtcccggccagcagggtgccacacctcatcccctctgcctctctgtgcttctctggatcagcccctcccatcacctatgccttcacaccccctcagctccatcgatgctctgtcttgtcttccaagcatccaggtgacttggcttgcctcaaggagtgtagaatttgcagtctggctgtcctgggtttgagtcccagctcaaccactcatcgctgtgtgaccttggccaacacatttctccgctgtaaggttcagtagcctcatatgtgaaaagaggctactgcttgttgaatctcttgttggaaggattaaatgggataatctgtatgaagtacatgttctttgtatgtgttcaaataatatggttgtcccgagccctaaactctgttttgcccttcctcaccacctctgtccctaaaattccagctacctgtgcttccaccccataatgttcaggctgcgtatcctcctatctactccaccctattgtttgtgcacctgctcttccatttctgacacctcccacccagcttctgcccgtgtgccttatcctttcacctgctcttccagaaggatgggtggggctcagatgggacaggcaagtgtgaggagaatttgctgcttgccaaggctgcagtgggcactttgaaaggagctgggaggtctgggtgtgcttcaggggccctgggctgctcttgttccccccatctctgctggctcatgctccccctgttccagtctgtacatatgggctcctttccccttctggcttcctggaattggctgtgcttggggccatgcagagtgtccctgccagtggatgtgttggcggtgctgatgtgtttctgtttgtgtggctctggttggggtggggcccaagcaccagggggtgactttgtatctgggtccggcagtggtcaggcatgtgcgctgtgtgtgccttgggctgttttgagctgtgtgtatgcagggctgcagtgtctgggtcaccgggtctttagctgatgccagctttgtcttctatccgtttaaaatctctcagtgttttccgagtcagagagccaggtcttcttccgcccctccgtttgccctcctccttcccctccagacctggtttcagatacgtgcatctctgaggtctgcctgggagcaaggaagcattacgaagggtggatatgcgtcaaatggagccaaacaatgctggtgacagccaggcctactctggccttcagtgctggctgtgcgtcaagcctctgctgcctgataattggaaatgagagggggcttcccgccactcggccccagatggatttcaaggagcaacagagagctgggctgtcctgccctcgggactttctgcttgcgggggctcctggtgcagcctcgtccatcagagcagatggggttccagaacaccagtccccgatgcgcgctaattgtgcagaataattgcactgcctcctgtcgctgccatctaggggccaggagttttccacatgagtgaattttcagataactgaagcttatgcatggaagaattcagagctcaggaaaaacggtggatttttttgatggaaagttctcacattgtacagtgtcccatgctttctttgactttgacaatagatgggatcttaaaaatcagctccttcctctccctctattgtttctcagtttcttcttctgtaaaatggggatacgaataggacctgcttcacaggggtgaggtgaagattacgtgctttgagacgcataagaagcttagaactgagcccagtgcatagaatttactggtctgtaaatgaggatgctgaggtgcagaaaatgccattaatcacctccaggttaacatagagggaagtaacatctcctaagcatattctgtatcccagacaattttactgatggcacctaagtcaactttattgaatacttccagccactctgcaaagatgatctcacccccattttacagaggggcaaactgagacgcagggaagttaaataaggtatcaatagctggtctgtagcaaaactggcatttgagcccatgcctgactcccagtccaggtttttttctatccctcctcttaccctgtagttagaaactcatggcctcttagtgtgttcaggaatctggaaatgaggacccgcaaacaggagttacgatctcatggagctgaatctgctcccaggtaccaggtttgggtttagtgcacagctgtctggagtcaggcgatgagaaaaaatgacctctggggacgtccagggaacataaagccatagatcagctttgaggatgtgggatgtttttcctaagtaatatgtggctgggttgctttccaccctgttcctcattttggccagccttaaattcttgaaaggagacataggtaaacatcagaaaggatttcctggttgtccaccacataggacagtgatacaggcagcatagggaacccgaagagtcaaaaatgtaaggcacttcttcaaatctgagatgtcttttattaaaaaacattttaacgtttccgaaaatggaatgcaccttaggatcgatgtgtacaattcaagtagccttccctcctcctcaaaaactgttactcagttgatgatgctacatacaatcaacagcatccttgaaattaggaaacagggaggtgaacacctgtggtttgcaagtaattctacaggtgttgaaagtggagaggtctctacgcccttgtcctggctggcaaacagacgatggcctagcttcagaagacaggggctgatgtctgtgtgggtctctgatgtctgtgtggatttgagtgtggccccagcctcagaattctctattttgggcctggcttagccccccgcacctaccctcacatgtccccgtggtggttggcatggtcctcagcactgcctgagacctttggctctttgggttttcccactgctcttagatttttttcccatgcacccttcctgccttactgttctagcacagctaaggtcaaagacttttgtcccttcaagtttccatctagaaacagaaacccttggtggaaagtgaggggttggggtgggcagcctcgctctgggtggaaaaacagatggacttgaatcccagtgaaatcctagccctcttcatacctccattatagcattactggggctgttttacaattctctgtttacatgcctgtctcccccaccgggccacaagtttccctcccgggcggggccatcctcattcatctgtctccagagctgggaacctggcatggaggggcactcagtgggcattgttgagtgaacacgtggtctcgctccccacgcctgtcacctcctttcacaccagttccactagaaccatgaccacagaccacagccctttccttgagcagctcttctaggaacttcctagaagctctgttctctgtgctgccggccctgtcccccagcctccctgcttcagaataggtcagggagaaggggtggggttttcctgctttttgggttgctggagaaggcgactctgaagcctgcattccatattgcctgttcacacctcctcttctagcatggcggctggcttccccctagtcctccggccgcgtgcctcagcagctctgactgccccactttcctgcccctccatcttcttatgttcctcggatcccctctttaatctctctcctctgctccctgaccagctcagagcctcttccaggctggactctcgggctccagccctacacctcacccatggcttctcactggctctgggggcatgaggccactccagggtcctggacattggcctcagcctggccctccaggtcatgtgcagtgtggcatgggttgcctctctgaccgcctttctctgtttggccctgtgtgccctgggcacagccaactggtctctttgtgttctctgacccctggcatctctcctccctacccatctcaaaggccatgttctccatgaaactttctgtgacccccgactgggaaaggtggtgtggtcctgggcagagctgaggcttcggacacagccgcggcagaacttggttcaatttccattatttactggttgtgtgaccttaggctgagaatgcaacctcttagtgcctcatttcctcatctgtgaaatggactgatagcccctagctcagagtgcgccgtattgaatgaaagcggacctgaacgtaattttctctggccagagcaagggctttgaggtggagaggtgagaaatgggagtggagagggaggcatagccaggtcccgaagggcctgatggccatattaggacatttggactttctcccgtgagctgggagctatgcaagaactttaggcagagaagtgacactgctggatgtgcattttagaaatagctccctggctgccaaatggagaatggggtggaggggacaaggcggagggcagggagaccagtgttgtaggctgttgcaatcatctctatgattaataggacctgagaaggggtgtatgtggctcagagaggtatttaggaggaggagttgcctaggcttggtggaagggaggggaaagaatgaaggaagacagacacatgggcctctggcttgaacgactttggtggccggggcgggtggggggtggagggctgagggaggggtggtgggtggagatgggggtggtggcaggtgttgtcagtgccatgcaggaaggccaggaggtggccgagtgtgggcaggatcatgaaaccaggatgctgacgggtcatgccctgggcccctccgtgccctctgacccctgctggtgcttccctgtggccttgcctgtcccggccttttgtcctggctattgcggggaccctctcaccctgccccggtaggcttgctgtcttgtgctccctgggcctggcactccataggtactcagtgcagctctgctgaaccccatgtctctgacccccctgctcatcagcacatgctcctaagaagtccggcctagtgtgcagcctcacctctcccagcttccctgattaggggtgtgggtgagtgtggcccctgagccgggacccttgagatccccgcttgggttgtctggaggctaatctccagagaagactccctgccttcacctggggtaggcccatctgggtgccatggtgtcgtgccttcttccaggctggcttgggagggcctggcttcagtggctgggaggcccatggtcccacagcttggcctgctggtccccccgagttccccttgttgttgtcagcttctgactgaagctgcccagaactccacattccgcaggctcctgaagggtcaggcacacctgctcttccctgcctcgttcaggtctggttgttgagtggcccttatgtggacctggcagctgctctgtgtgtgggtgtggttagaggtggggaggttcttgtctgaagaggaactcccctgtctggagagcccatctcgagtggcttgcaggacagggagcctagcagtgggctggggggtcagtgagtggggctggggaagaggatcctgagacaagaagaggaaatggaagaggaagcagtgggcagctggagctttggggataggttgatggggccagtgatttaagaggagctcagctcaggaggatttggggaggggtggggcctggggccttggtgagtcagccctctgggactcccctgtgtcctgtctgcttcaggttctgggtcccagcctgtgctgggtttggggaaagggccaggcccactccctgtccccactgtctttggagggacactcagggcttgggtgtgtgtgccctggcttggtgttgctgggaacaggccccttcttgcctccaggaacttgatgcacttcatttcctggtccaaacagaactctataaaagggaaggaaacagactagcaggccagggagcctggagaggctggagcaagccccggtgaaggccagctgcctggtggggagggcacaggcctggggaggaaatgggccggggcagtggccaccttctctccaggatccctcctcctgagggcctgaggctcagcctgggaggccagtgtctttgagctgtgctgggacccttgagacctctggccctttcaggcaagccttgtaatcttgtccccacaccctccctccatggccttggcattcttgcagctccttgtctgttgagcatcctcaggtcctgaaggaggcctgcctccctcctggttggcaggctaacaactggccctctcccctgggcctcccagcttgccttaccaggttgaatgggggctgtctggggccttcctgagttctagtggactcatggtgtgagccctgaagtgctggactgtccacagataggagggtcacctgcctatttcttcatatgggcatggagactggggccttctgggattattgtctggattttttctggaccgctctggtatcatttcagagaacagggctcagaagctgcctgcctcctggccacaggttcctggggcagggcccagagggtgaacagcaggcagagctgtgggcatgccaggtctgctctaagagtgggtagtggcaccctcccgtgctctgggtgaggaagagaagtcaagggtggggatgggggtcactgcaaatgtgtgttttgttagagtggagatgagggcccctaggcttcagggtgcctgatggcctcttgtctctgggttatagggtcctcttctcccccactttctccttccccttattgttattagtaatgtgactatacatccttgcttgccttaaacttcccacccttcagctcccccagaccctactcctggacatctttatctggagcatagtttcagcctggtccttctcctacacaagtgcctttactggctccccagtgccaatggctaaaatttaactccttcactgggcattcaaggttgcctatggtcaagcctagaaagaccgttgtgccatccttcttcccttcatcccttccaatgcctgcttcaatgctcctcttcctttccttcacccatcctgtgtcccagccaaaggggggcttcttgtggttctttcaacacgccaagcattcccacctccatgcctttttaatgtgtaattcctacccccaaatgtcctttccccatctctacctttcaaaaccttatccactcaccaagtgggcatcaggctctgagccaggcatggggacttctcaatggaaatggcccatgtgctgcctgctctcggggctttcaggggtagtgggtgagacacacagtggataaacagaagcaatgcatcctccatgccaggctcaggtgcccttgctccatggagcctgcctggggcccctgagttttctctgtgatcccatagccctggcacctctgccacagcatgggccctgtcccactgtagaggcagcgtgacaggtggggcaaggcaggtgtttgaatccagcagacctgggtgagccctgataccatcctttggaagctgtgccttctctggtctggcagaattgttgagaggactgcctgagaccctggaggatgtggatgctaatgcttgcctcgtgggtggttgtgaggagtgaagcgatgtatacacaaaagcttagaacagtgcttgacatgcagagagcttagcaatgaacacttgctgccacaatgactaccactagttattccacttggggtaaattgcttaacttctctgagcccatttacctgaaaaacttgtcaagaagatcgcaaaaaataaggtatgtaaagcacccagctcagagacacacagtgggtgctctacaaaccccagtttccttccctcccatgtaacttttggggcagggatgtgaggtgggtgtcagcaaagaacttctctggaagcaacccaagtgtccatggatggatgaatagaaaaacacgaagtggtgtaatctgtacaatggaacagtattcagccttaaaaagaagttctcatacatgctacaacatgaatgactcttgaaaatatgatgctaagggtattagtctgcttgggctgccataacaaaataccatacgccgggtgacttaaacaatagaaatgaattttcttatggttctggaggctggaatccagaggctgagatcaaggtatgagcagtgttggtttctcctgagacctctcttcttggcttggagatgccgccttctccctgtgccttcacatggtcttccctggtatatttctgtgccctcgtttcctctacttacaaggacaccagtcagattggattagggcctcattttaacttagttatctcattaaagaccctgtctccaaatacagtcacattctgaggctactgagggttaggactttaatatatgaaggaggacatagaattcagcctctaacactaagtaaaataagccaggtatcaaagggcaaatattatatgattactcttataggaggtacctagaataggcaaattcataaagaaagagagtagattagaggtaaccaggggtttgggggaggggaaatgagggctagtgagtgtgaggatgtttgggatgatgaaaagtttctagaaatggataatggtaatggttgtacattaccgtgaatgtacttaatgccaccgaatacatttagaaatagttaaaatagtaagtgttatgttatgtgcattttaccacagtaaagaaaaggggactagcaggagatggtggggggaccccttttccactcagtcttatatgaaatgctgaatgcccagatgcacgtgggtctcgtttaagctaggggcaaagctgtcctctccagtcccaggggccaggtgagtgtgagtgtgtgtggtgagcccctttggagggctgggcaagcttaggagtttgggattttacataaccaaggctgagaggttggctctttcttggtggcctggggacaggagtgtcacccagttggggccctggtcctgccacttgcaggtttgggaggtgagaggggcagtgctaggcagacgcctgggttttctcttgatctgcaaagagcagtgcctggagtccacagaccataaaaatgcctggagtccacaggccacacgcacaaaaaaaagatttatttacatttttaaaaggggtttggtttgagaaacatgtaaaaacacgacagaacatttcataggccattttacacaataaaataggcaataatagcacttatatttttgcaagcataaacactcaggagtttaatgatagtcacactggtataacgattatgagcagatgaaccgtattcataaagaagtaagcaaaagggaaatgtacaaacacatattgctgtggttggtaattgtgtacccctagctttataactgcagtcacctgaaataccatgatgagacaacccaggtcttatgatgagactgatcaaaaacctcagtgggccaccactgcataaccactgcgccagacacccaaagggccaagatctcaagaaattttgtctttcacaaatgcaggtgtagtgggattatgatctaaactccttcccagctgattaacctgggcaaacttcatgaccttgtggagcctctgtttctccatatgtgaaatgggagcaatattgctgactctgcgggcttggagggtctcggagagatcaggtgtatgacaaaattagccccagtgcctggtgcatagtaggtgcttaacaaatggcagcgattgtggccacaagtggccacaggtgcctcctttctttaggccttgaatcactttcattcttcaacagacatttattgtgtacctactgtgtgctggctctgtgctggactagtttgacggataagatgtgcttcctgccctcatgacacttgttttctagaggaggaaacagattatagacaaggaagcacacacacctataattacaaattgtaataaggtctgtgaaggcagagatatgagtgtgggagagagaatattgtgtggggctgtgtgtgtgtgtgtgtgagagagagagagagagaaacataagggaattagggagggtctctggggtggtgacatttaagccaaagccagaaggacaggaaggacacagctacgcagacagctggaggaagagcattccagacagagggaactgtgtactcacaggctccaaggaagaacagaactaggtgttggagggattgaggggaacccacctctgtgtgtggcttcgggtcccggacaagggggctgagcatagaacgaagagggagaggagggcagagcctgggtcatgcagggagttccctgcctgggctggctgctctctagtgctttttccctcatgtcctgggggagtctgcacgggtgtgccctgttgttggcattgtgctcagggacctttgaagttgagaaaatactagtgggtgtgggggctgacgagtgccaggcatcagccctggtctgggaggctaccatgctcaccttccagctgcacccacggggctccacctcgcagcctccagagccagactgctctgctgcagtgctgggcaaattgttaacctttctgtgccttagtttcttcatctgtgaattgggggtaatagcatccaatgagagcaaagggcttggtacagtaactaagctttggttagtatgagcaaagggctgagtgtagacatagtgcactcactccgtgagcattgttcctgtggctgtggatggctccgtggatgtgtgtgtttctagcatagaggacaagagcatgtctccagacccggaccctgactttgcatcgtgcctcctgttggccaactcattagcctctatgtgcctcagtcttctcatccacaaaatggggataataatgacaacgctcagcattgttacgtgaattaaatgagttaattaatgcaaactgctgagaacagtgcctggcacagagcaagggtgatgggagtttatttgctgctgtgatttttattgctatgttattgagagtgaaaagattgagcaggacaccctgtcagttcccaatgtctaaatggtttgcttgaggtccactgggggaagggggcttacctgaggctgactttctgggtctgagccctggaatcctgcactgacagctctgggaggtgagcctatgacagcgctggcaccaagaccccctatagccacccccagagtctgccccctgcagagggaggcttccttacctgggccccctggggactccaggactgtggggccacagggcatgggccatagagtggcagggggccctggctctccctggcacattccgggctcctgagagggtggccaggggccagggtgccggagagaaggcgagagccttttaaggaaacatttctttgcttaaaaaaaaagagagagacaagaaacactgaaacacacaacaaagtcagtgggctggccggccagtgggcctggaatgcacggctgtgggcggaggatggaggacgccgtcgggggtggcaggccacgagggggcaccaaggcatcaggcccttgggctggggcttgacagctcccccgcagggccaggttcttagggggtgcctctgcctcgggaggccagggaagggacctgcggtcaggatacctgggccccctcctgtccactgcctgagagtaggtctgggagggagaccttcctcttcgtctcagagaacacctgtctcttctgctgctggttcaaaatgtagccataaccccctccctcccttttccaatccccagcttctaaatggagagcagaaacacacctcctgtgagggaggggactggtggaacctggggccctggcagtggcaggcatcagcccgtcctctggcagcttggcctggctcgcggtccctgcccagcccaagctcagaaaaagaacacagcaagggtgctgtcctgggaattgtactccctcccccaggactgagggacccatggtgacagagtgggttgggagaaggcaccctggggccctggcccctgaccttgaaaactcccagtccccagagcagggtttggtgctgtgcttggcagggacagcagtgtcccccgtagctgagacctggtctcgtgggcagggtaagcagagagccctgcaggccacagccagctctggggacctccccttcccgcccagtctgttaccctggcaccctctcccccagccctgggctctgtctctcagaggcctcttctaaaacaatcactcatagccccgtgctggtgtggattaaggaccccgggcttctgggggcagttctgttccccctgtgtctcctcattcttccgaaattggggccacgagtgataagcttcccttcacatgtcatcttgggacttagactgcctgggttcaaatctcggccacttatcagctgtgtgaccttaggcaatttaacccatccatgccccgcgcaccgcaactgtgggaataacaatagtaacccaccttactgggttattgaaaggattaaaaatgttaacagaggtaaagcatttataatcatgcctgtcatctagtacacactcaatagtattgggtattattgttgttggttctgttcggccccctgttcttctcccaccagtcctagaattctgtggagcaaagaggaataaatgctaggactccatttgggcctctttgctggagaatgagttgggcagggagtctgtagcccgactgtgtcaaaaacccaggaatgccaactcccagccacctctgccccttccagagcttggagcacactgtcccacaggtgctgaccttatctgggctgctgtgtcaagcctggggaatccctgggctgctgggatgacagcatgcggtcagctggaggaagggctcagctagggtgcccaatgcccagtcagtaccagctggggctgggctgagggctcttgctgccaccactccaccgggctggtgggtggggaggggttgcccactgtctgggggaggcagctaccccctctttggacatccatggcttgttcccagataacctcatgcccgagggacagtctcccactctgtgcccactgtgggccccttgcctggtgttcaggttgggaatcggagccaaggttgaggactgagctccaagaaaaacgtgtcctggctagaaaaaaggagcacattcagtctctgataaatgcccctgctaattgtcagggtaatggctcgcctgccaggcctggccaggggaatgttatctcagggaagggagcgatggagccttccctccctcccctctactctcctcctccctctcgctccctcccctccactctcctcttccctctccctccctcccctctactctccccctctcccttcttccctctgtctggaagttcaagttgccatctccttctctggatcagagaggaagatgaggatcatgaaactggtgaagatcatagctcactcccagagagtgcttctgcctctccaagccttccacatgtgttagccacactcatggctttctttggaagggctggtgggtcccttttaccaacccatttcatgcatgctccgggaaagtgccagagctggtaggagccttctgcagctctgacctttgggtgagatcccttagcaatggggagaaccaaggaggtgactctcccttttctgatgatggtcctaatcacagtttttaaaaatgtaaaatgaattttaccatattgtagaaaattcaggacatagagcaaaaaaaaaaaaaaaaaatccttcttcttattacctgaagcttctgttattgaaatgccggtgcagtgatctccagtctcccagcatgtgcatatttgtcacagaattttaattgtgacgctcatttcatttttgccttctgcggcccccgctccctttcccaggcgttattgctggagtagtttttctgtgttgctccatagtctgctgaagaactctcaacccagaaggtgtcagcccgtgtgagggaatgaagcagggggaggtgtggggtgacctcaggaggtgctggctgtctctagagacaagatatgctcacctgcccgttctctgttccttccacaggtggctgccccctgcgttcctccatccaaccatgagctggtggtgagtgacagcccttccttgccctgcaagccctgcctcctctccctccgcagctcccagctgcagctttctttagacccaaatatgttggtaactggggtgtcggacaattaggtggaggaggagggtcgacctccctgggccgaagcgggcctgggaggaaatgagtcatgaggtcccttctgatgagatgcagtgcctgctatttccaaccttgagacttgcgtccttagaaaaacccataaaagggcatcttgtgtgtctccaggcctggccaggtgcctgttgtcccgggactcagaggaccaggggctgccacggcatctccttctgcctgcctggtcccgggtcaggcaccctggggctggaggcgggggatgaccctcagagtccattcacctgggcagtttttccctacaggcgacctctgttctgcctctaagccccttggcttgactttgcttttctgctccctttccatttcccccactcctcttcccgtcacccccgaatcagccttgcaccatagcctggactggggtgggatccctgtgagttgtgggctgtagagagggccctgctccaccctgatgccagctgggctgatttggcacactgggcactcttccttcctgcctctcgccaccttctcacccttcagaggtcttcttcctccccaccatggccctagaagcagacaaggctctgggcgctgctggggaaggaagggggctgcctgcatgcacctgtgtgcctgtgtacaggtgtgtgggtgtgtcccggaaggacaccttgcgggcacaatcggatcaggctgtggagttgcctgtggcagtactaatgtcggcaggagcctggggcggggcgtggctgtcctggggcccaggcagttgtaggtacctcacacacctctgttgtgacttgctcagcccagacactgggtgctcagtcaggccagagtctccttcctttcatcaatatccacttgctgtatgacaaggggctggtcccatcctgtttctttctggacctcaattttccttgctgtggagatgctccaaggggcccctccatgttgatgagtgttccctctccctccctccctattcagggtggtgatggagtgaaatgaagtgcacagaagtgcttgggactctaagtgtcactgctctgcacgctcgggctcaggcctgctggggttgtttaccttctttgcagtggtccctccttccctggtctcactagggccaggctctcccgggcctcagtgctgcccagccctgctgctgcagatgtggagtgttattcatacggagcccagtggagggtcatctggcaacagcgggggctggggggtggagtgcagtcgggcttggaactgccagcaagaaatcgcgcttggattgcagagggacaccatgggagtccgaggagggcgggcggggaggggtgagtgtccatttctccttattccagctgaactcccaccttgtggctaagaacagaatgtccttggctgctttatgaggctgggggttcagggtttagggaccaccaggcagaagctagatgtctggctgctgggagtctcatgagctttgtttacatgaagagcggtcagaggttaggacaaaagggaataggttggcattccagctggggggactgcagttagaatccagaagagactcgtgcctgagcaaggctgcgtgtctctgtgaggtgccccgcctgtgcagggggctctgcccttcgaggaggctggatcagccacctggtggtgaaatggctgtgtcaccagacggtgctcccagaggctcccctgcctgagtcacaacccgcctccccagcggtaaagagcgagggagttagaccacctccttctgcatcccagctcccccgctccctggtgtacgaccctgacattgctaacctccctggacctccgtttctcttcttcataatggacgttagtgacggtacctatgctgtaagcctgccaaaagaccaaagtgagcacattaatccatttaattcatgttttccaagtccttcaatgctggcccacctcactggagcaaaagctcaggttcttccgttggcccaagcagccctacgtgacaggtttccttttgcctcagctccttctcgttcacccgtgtcttgtcattttcctctctcacctcatctccttctcagcacctcactcattctgtttcagccgcccggccttcctgctggttcttgaacatatatgatgcctccaggcctttgcacttactattccccctgcctggaatgctcttcccacagatacccacaaggcttttcccccagtcgcaagtctttttttttttttttttttgagaacagtctcactgtgttgcccaggctggagtgcagtggtgtgatcttggctcactgcaacctccacctcctgggttcaagcatttctcccgcctcagcctcctgagtagctgggactacaggcgcacggcaccacaccttgctgatttttgcatttttagtagagatggggtttcattaggttggctaggttggcttgaactcctgacctcaaatgatcctcccgcctcggcctctcaaagtgctgggattacaggcgtgagctactgcgcgcccggccgaacctcaaatttttattgaagtgtcagcatttccctttccccagcacccagtctcccttccatgcttccactgcccctcagcatgcatcgccccgatacactatgcattttacttatttatcttgtttaaggggttttgcccatgccagcatgtaaactccattaggacaaggaatttttatctattttgttcggtgctgtgtccccgctgccttgcacacggtaggtgctctatatatgtttcttgaatggctggaaggaaggcattcagcccgatgtctggcagattaggtactcaataaacaggactgctatgactccatgttccctagctggtgaatgggtggggctgttgagtcctaaaggtggggggccatgggggaaggtggcagctgccttcagctggaagctctgctactgtccctggggagtgggaaagtggcccaggggaaaccgggagaaagtttggcttccccaggagcactcagcacctgtttcctcacgggcgggcgaggcaagtgctttgaacaggttcacaagagggaggaaagggcgggtttgtatttttccttccttttccatttgttgcctgcccttcagcctcggtaggctgctctccggcctccctgcccattctctgtccctcatggtgtgtctgtccttctgtgtgttgtgttttcttcatgtctcagttgagttccagctctctgtctggacttctcactgatcttgcttaaattccaacccctgggattaggacctctcatcccagacatagaatttctgcccggcttcaggccctgccagccaaatacatttcccaacctgtgcccgggccagccagggtaaagtggcttaatcttcaaccatgttttcatcttactcaacagatgttgcccaaggccttgggtagaagggacctagggtcaccaccctcctgtggggcactggtggggcaggatggagaggcaagagggcttgtttgccacggacactcctgatccttgcaaagagctgaagcagcttttctcaacttctgaaaaataagtcaaaagaatttttcaagggtgatcgccaaatgggttggccaccaaggtcggcggatgtcaggtcttctgtgtgcgggagagctgcactgggggtggaatgatgtgcacattgcttctacttgcccaggcaggcccagcacaggggcttggaacgtccctgtagaatgacttggaggtctgcaggtcagggtggggggtctggaggggaggaggtgaatgggggaataggaattgcccagtaggaaatcatgcttggattgcagggggacaccatgggagcccgaggaggctggtttcactcataatagtaatagcaacagtgagagattaaccctttactggaacttcatatctgccgagcttcgttctaaacactttacaaaaataaactgatttaatcctgattacagtgcaatgagggaggtgctgtgatgatcccaatgtcacagatgaagaactgaagctgaaggccacagagctatgaaaagggggagctgggattctgacacggtggtctggcaccagagttcaccctcctaagcatgaataataactgacgtcactgtcacttgcatagcacttgccgttttcaaagccttttccatgacgtggggccattgggacctcacagtgacctgtgtggaagcctggcaggcccaagcccaccctgagaagacaggaacaaactgtacatggagcaaactgggtgccttgttcatggtcacacagctcgcagtggcagggctgggtcaggagtggattcttggtctgtgtttctccccaggctgccctcggtgcttgctcctgatttaagtacccgatgttgccgggtgatgggcttctcctgagcccctctttctaaacagctagcttctctgtttgccagtaggcttgggatttgagggagggtctgtccatccatgtaaccatccagccatcttaccaatacatatctctggagcacctaccccctgggcttaggacccctcagtgccaggcactgttctacgtgctggggcttcagagttcctttctgccacagttgtcagtgcttcttgaagacagacgggcatggagtagacctggagccacagggtggagaggactttggacgctatctagtcccatcctgttcttttgcagataaagaaacaggccctgatcttcttaagtgactttctgaaggtctcgcagtgtcagatctgaggcattgtgctgcctcatggaagcagagaaggatgtgacgttaactggaagcagagaaagggagcggagcactcagcttcagtgtgcgggctcgctccatcaagggtgatgtgcagtcacttcagtcagcctgaactccgacccgatgcatttcatcccaaggcactgggcaggccatgggtggccatccttgggaaatcctgaaaaaatggctgattttcaaaggggaggggcaaactctgagcattgcattcccaagaggatgctgagcatggggagggaggttgaaaaccccaacttgtgcaacccctagggccgcttagcctagagagagaagacgtgggacgggcacagaatgggagtgagaatatgttgaaagacaaatggattcattttccattgttctgcaaagtagaacttggtaggtagaggtcctcagaaagaggaggaaactcagctcctcatttgccaaaaggggttcaaagtgctccttaaagaacagcatttaggctggatgcggtggctcacgcctataatcccagcactttgggatgctgaggcgggtggatcacaaggtcaagagatcgagaccatcctggctaacatggtgaaaccccgtctctactaaaaatacaaaaattggctgggcgtggtgtcttgtgcctgtagtcctagctacttgggaggctgaggcagaggttgcagtgagctgagatcgcaccactgcactccagtctggcgacagagcgagactccgtgtcaaaacaaaaacaaaaacaaaacaaaaaaacccaaaacattcttactgatacctatcaggtataaggcaccatgctgatggaagcaccagctccacagggagctgcctgggtagaagtcctcaggctcactgaggtcctgtcatttggctgcgttacaaagtgacaagatccacagaggtccaggcatccctgaatgtgctgaatacctcccctgtaatccccactttgaaaggcccaagtagggtgaagggttctgacctcagggaaccctctgttcagtgggagagggagaaccacactatggaaatagtgcctgactctggggttttgaccagaggtggtagccttggtgttcaggggaggaagtgatttgcttgtgctgtggtggttggggaaacctgccttctgttcaagcctagtttaagtctggaacaaatagaagagaggagggaaggagggagggcgttttggaaggtagcagggctgaaacagaaagggcgtaggaccttggtaccaattgctgagtctgaaagagggccaggcaatctagtgtaaatgttttgggcaagtctctcttgctggcgggaagagagaaccaggcaatcttgtatcaccagggcccaaacaacccttggtgaccctgcctggggcttgtggtgggagcagtgtgggtgcaggaatgggggcagggatgagcgtgacaggcctggtgggcctgagcagctgtgaacagaggctgcatgctggagaagagagagcaagcagtggagtggctggagggagaaggggccagatattggaggagtccacaaaccacactggggaacttgaacttgatgtgctaagcactaagggctatcctgggtccctgagtggggaagtgacccaaagcagggtgttagagctgggagtctgctgccagtttcagggtggcttggcagggagggaccgccaggggagggctgagctggtatagatgctcagtgtggcttcaaggctgcaggcaagggtggctggaggggtgtggaggaagggcacagccttccagtgccctggccaggtcggggaggagagccatatccactgaaggacatggcaagagggaacacaaaatattccaacctgtgcaagccggctgcattgggggtgtccacagttgcacagcctcagtcaggatttgggtgttgggccccttggggtgaattaggagaaggggctgaggacaggtgtggtctggccagatccttcccctgtggagaaatcagacataactctccccttaatcacatggagcctattcttttcctctggtggcctgggcctgctgggaggggatgtggcccctggagcaactgagcagatatacttcagggtcccaggctccactgccagcatcctctgccagccccatctgctcagtgctctttctctagccctcacccatcggctcccacttcctcaagactgagcgaggggagagcacagggctctgggaggtgcagacctcagaggtcttagactcggaggcgcagatctgatctcacattgagcggccaccctccctggaaactccgtctcctcatttgcagaaaggtgttcaaagtgctccttctagagcccttgcttatgacagtgaagggaggtgatgccttgggaggcacggggcacggagaaagcgctctctccctttgctgccttctgccgctgccgctgccttgttttcgtgattaggctgttgatagagggctctcataggtctgtatgtggggacgattaaatggggccgcacctctaacgtgccatctcacagcctgccatgctccaagtgccccataaactctgtttccctgcccttcccttctgtttttagccccctccttgcatttgcttatgattctatttttgaaacaagtgagcctagaataactttctctgggtcctgggtctgaggccattccagccctcgctagccctccctgccagctcccagttccttcccctcttgataggcagtgcgatggtgacctcgcagttcattgccatggcagtagatctggtcatggggtggtctttttggcccccaagccccccagattccaggcctcccagggggcaagagtcgggagagttggagggtggaaaggggcagggtgtaaggaatttccggacggaatgttcctccggaggctgagcccgcattctgcgcaccctcctccccaatccccttcccctcggccctgggctcaggcatgggaacctcccccaccctgttgtttccttcctctaaaacagcagcacagatacatttttcccagcccaccctccttgcaggccactaacctgtcctcctgcgtgagcctctaggccgtcctggcagccaccccccaaccttccagcagaaaggcccctcctggccccaccttgggcccatgcagtgggggagggtaaaggcatgtgtggagagggcatatgtgtctttttttggaaaaaaattgaggaaaggatgtggagcttcccttatccaccctgtggttcccgacccctcgaattcaggaagttctctctgttgtctgatctcagtctttcctatgcagcccagttcctattctttctgtggaagtatggttaagaagtgtcttcctactgaggacctggacagaagtcctgctataactggccttcaattttcagaaagcttgttccccacaggaaggcagttatcagaggaactgcctggagatcattgccagggagaggggagatagcatgatggggaggtgaggagcaaggttcaaacagcagctctcctaccgactggctgtggaaccttgggtgagtcactacatctcccaggccctcagtttcctaaactgtaccctgcggtaatgctcgcctcccagggtggttgtgaggactggtgatcaggaaagcaaagagcccagtactgtgttccgggcattgccatccctaaatgaatagttgtaattcttgcaataagtttatgaaaaggcatctcagggccagggccaggatgagggccagagagtgaggcctctagggtgcaagatctgaggagtcatcactctcaggattatgcaagtgcactcgcaggacctcagagtgagagcaatgccttcttaaatgttgtgccccaacattcgccctagtccccaccttgctttgctctaactgctggttttgggactctagagcagagcagcccgctaagagcagggcttggttttcaggtagtgataggttcaaaccctgccacctgcttctaagctggattctgagttgtccctcctgggaggtaaggggggactctggaagacccctggtggaacagtgagtcagctgctctcactttggaaagcctggggaccttaagctccaggctttgtcctgggactgggcagtgggtggagacagacataggggtctgtctgtgtttggcctccacccacttcatccctttgcagctgacttgaggaggaaggaaaagaagagcctgcagggaggcaccagctcaccctgccagcaggatggctgggggccaagggtgagggcagtgagatgagcctggcagtgggctttacaaacctgggaaccagctccagccatgccacaaacctcaccatgaaaggctgggcagatcagacctccctggacctcaatttccccatgtgtgaaacagggggatggaggagatgatgtcttaagtccctctcagagcagatgtccccaggagtggcatgcaaggatggttgtgtgtgtgtgtgtgtgtgtgtgtgtgtgtgtgtgtgtgtgtgtgtgtatgtgtatgtggtagctgtagaaacatcctggccaggaatggagtgaagatgaaggtcaggggctttggttccagagggtcccgggagtgccagctggactcattaggcagtgtcaatggtagggcttcccactggccccggcctccctgcagggcctggggcagtggcagcctcaggggatcctgccctcctgttaccagtcccatgcctttttccttcccagtagccccaaggctggaagtgttgggaaacagagagataggacttgaatcctgggagagttgggttggagggcagaggagggtcgggcagcatgcatgctggctgtgtttgcaaacactgcaggacaactgggatgtttagatggtgcagggggtggggacttggaaatttttagctcctcagaaagcatctcaaccagtaagctgaaggcatctgaactctggcaagcgtcaccctgtggccggcctccagctggcatggggaaggggtgggggcaaaggggatggtgctcagatgatcactggcaggaggagaaagtttctcttgcactgctgaggcctgtggtttctaatattgacttcagctcccttgtgtgcaccatgccagacccaggagggttggggcaagagggtcacagtgaggcagggtgggctggagagggcctgggcctcagggatatgaggtgctgccccgaggctagagacgataaacaatagtgatagctgacaagtattgagagctttctagtgtcttgcactcttctaagtgctttatgtgctttattgcatttgatccccccaaaataaccctgtgcgggcctgttgaggagcaggaaggacaaggtgacctgcttaaggttgcatagttaggtagcagccgagagaattagcatgtggacctgggcagtctgctgccaaggccttttagggagcagtcagtccaaatcctgccacctgctcccaagctgattccgagttggagttgtcctgcctggaggcaagggagctgttagctgaggctggttgttctcggagaagcatctgggacctgtgttgcctggaaacctggtagaaatgcacgtccttaagtcccaccgtaggtctaactgtgtgtgtgtgtgtgtgtgtgtgtgtgtgtgggcacccaggcacctgtgggtcaacagccctctaggtggtgctatgcatgttcaagtttgagacccctgggctcatgctctgctgagggtcgaggcctattaggaggctttaaccagaggaggaagagaggcttttctgggccctgaacgggcctggggcaggtgtagcatctctagcttgtccaccctactccatgtctgtccattctaggaggctgggtagcggacaggtcaggagtgagggctttggagttgggggatttgggtttgcatctcagttccgctgtggtctgccttctgggagttcccttccttcccacaggagaccagagcagctctgagacgaggcagctgggctgttctgcccaacctcaggtctccacgtgggaatgacagagcccctggaaaagaagggagaggctggagggtagagagggcctggggtgggcgacactgctttagcggggagggggtgtggggggtggtccctggtagaggggtgggtggggctgggttgttggcggctgaggggagcacctggtcctaataagcaggcagctccacgagctctgacttaccctgagtgggttaggggattagtgggttaggattagggctgagctgagagagggcagaacgtgccatcattattcctcctccagagccatcctcggactccaagtggagagaaggtggtgtacctagcagcagggaggatagtggaggagaggtgtgggaggggttggcccctgtccccccaacccctgtgcctggaccccgttgtccctctaccgtccccagctgccttggccctgaactgctcaggaagtttcatcccctggagagtagttttggcctcagccgcctgtcttccaggcagtaggggtagatgagtctgggccatttccagagagagcactgttacctccgctcagcccagtctcttcctccatgcctatctgtgcccactcctcctccctgacgccggaaccttttagaggatcattctgtccattcccctgcctttggacatgagcagctcatccctcagctctcagggatggggttggagcaggcgcctcttgtgccgagacacatggtcttaaacctgggtcacacttgtcctcgtcaaggtttgcttcacaaccattccagttgtgctcaggcctttctgcccaatttgagggccccataaccacttcactgagttggaaacggtggatcagaatcctctcagattctgatcaggaggtgaacctggcataagaagtttctcttcttgctatggggagaaatcaaaccatctttagtaggaagcccttctgctgccctgagtgaagaaaggagggtgccagagtgagggatgggatcagccaacaggagtttattgatggcccactatgcatacatccaccctggtaggagggagtttccaaatgaattggtccaaattttgcttagaatctattttggatgaaggtggaataagaatcacaaataaaacaatagttggggaaacaagtcatctattcccatgatgagattattcatacactaaggaccagacagggaggtgattggagttcagaggtgggaaagagatcctacttgctggggtggccagggagggctaactggaggaagagagccctccttgtaggaaaagaagggaaagcattccataagtaaagacctggatgtgggaacaggcaagaagagtttaggggctggggctgatggagcagagcctttgtgcttggaaatggaggtgtgtgaggcccagtggtgggtggcctgaaagcccactgaagtaatgagactggctggctgcactatttcaggctgctgggatttcacttagagccccaagatggggttcaaatcctgccgtctctattagagttgatgatgttggctcagtcatttaactttcttatctgtagagtggggataaaaggtattaatggtactcacctccctggattcttgggaataaatgagatgctgtaagtcattgacctctccaatttgtggggtcagcaactgtatgaaccagaggcctggcgccgggcactgagcgtgggtctttggtgaaggtttgtggaaccagatggttctagcactattaggatggttttccacatgtcaaactctccctcctgtgcttggggccagccagattatgcctgagtcttgggttggcctcatcatccctgtctcagggggcattctgcccatcagggccactagccatggggagagagcccatccctgggatgtctgccctaagggctcatgctgtttctccttctgtccacagcccatcaccactgagaatgcaccaaagaatgtagtggacaaggtgagtgatggcaggtggtggtgggggagctggaacagcctgggcaggtgtgagaaggctggaagtggagagtggatttgggggagagtggacagatgtggttggggaaatgcttccggagtagatttggggaacttgcagggaagtagtggggcggctgctgactctgggagaagggcatctgaccatccctgtgtgtttggaaatgggctgctaggcaactgggcaggcagagagggaggggcagggtgggagctgagagggagcagccggtggttaaatgtgggcttccttatgaaatatgcagaatgcaagaaaatcaggcggatctttccaaacaggtctttctgagctagctgagagttggacagtttcctcaaggctatgcggaagatgaagggaggaaagtaggtgggttctgccatggggaaactgaggttagctaccgagagagatctcctggcgatggccagcaggaaatcatgggcttggagatgaaggacttcggttcaaatcttgactctgccaaggttctaattatgtgactgtgggcaaggcatgagcctgtctgtgcctcagttttcttatctgcaaaatgagaataatagtatctcccacaggagtggctgtgagttgtaaaggagaggatttggttagttctgagggggccttgatatgggcaaagaaatgtgaaacaaagaccaaagttctttcccaggcccctctgccaacctcctcatctgccgctcctgacaaacccagcaaggtgcattttgattatttttcttgcctcccctctctgactgccttttctctgtctgcagggagaaggagcctcccggggtggaaacacacggaaaagcctcgaggacaacgtgagtgtggatggggagaagaaggatggggctgggccctggtggccagggggaatggggtggggtgggaggtggataatgtcttgtttcgtgggcttcctttacctctctctagaaggagaggctggcattgtgggcaggcccatttccttacaggctgggcctcagcctttggtgctgcctccatctaagcgagatccagagctcattcatcagcgactgcgccaggcctcggtgctcagggcgggtgggaggagagagggtgtgtgatgagtggccatggggatcaaggggaaatgcgcaaaaccacagcaagggaaaccgagggctgaggcagagaaggagccctgactcttggcggggggtcttagtccttggggaagtggtagtgcttccctggagacaagagtcttagaaaatagcaagctccactgtgtggcttagatgctattggttcaggaggaggctgggagatgggtccacgggtccccatgggctcctcctgcctcccattttggggagaggggaaggggcggatgcctgaaatggaaggatcccacagaagggctcggggtctcttccaggacgtgctttgagccccgttcggggttggtcttgtctccacaccccaggggcagactcccagcacagtggggctttgtcttttcttccctgcccctctctgaccgtactccctgtgctggcccctccgtcttcacccgccctgggctgcagaggaacagggagtggttttggtggttggcacaggggtagatgttgatggcacgaggccctatcatctgacagctgcctgacccacggtggggagggccctggagggagtgctgcgggagcaggaggggcagttcctataggcagcctgactcccatggtgagcccactgccaccaccacattgccctggggcagccctgcatgtccagccctacaaagcggcagcatcccatggaccgcatggggcctctccaggtggagcagggagcatgcctcttaaattagtggggaaggttctgctcaaggtatgcatgagttcccctgggcgtggggtactcatactggggaggggcccttgtcccgctttgtgatgtttctgggactggggtgcagggggaacctaattttttgtgtgtacctactaccaaggatgtacaggtttaatgtactcaaaatatatcatacgtgctcaataaatgtaagccattcttattactgttattttgactaagggctgggagctgtgttgggtgttttgcgatcctcctgacacccctgtatggcagaggctatgaatccactttatagatgaggaagcagaggcttggcgttgctgaatgatttggtgaatgccactccatcccttcctgggactgctgctggggtctggtgttatcctgaactgctaacctttggcaaggggacagggtgatggtgtgtgaaccaagccttctaggcaatggtctgggcacactcaggagccacatcctagagctgctgtccccacatccccagtctgggccagatggatcccgtcaactagagctacagcaagagacagtgaagttagacgtcacgaagaacttttgattgcaagagtgtgcacgaccttggtcctagggaagaaagaggtggccgtttagttgtgactgaggctctttggctttttttagaagaaagtattggtgatctgggatggatgtgtctgtgcctgtgtgtcggggtgggtaagtgtgctgtcttgtctggctatgggaggagagacaaaatgagctttggaaaggtaagcaagtgagcagctaccagaacggcctgtgtactgtaaaagaggagagaaaacctaatttgtaaggctcctgtcacctgtctcaggttgggttggctccagggtcattgagccagtcccctgcccagccacgggactctccagcagtccaccccgggggaggaggacctgggcctgctgctgtgataatgtggctgtttgtcaagctgtgttgctgtctctggcccacggcccaggactcacaggcaggaatggctgttttcctcctgccgagttggtgtgtagtggagtttgtggatagtgtgctgtgtcgcactttgttttggaaaaatccaggctagtgggcaggaaggagaggggaaggggtgtggctgaagggggtgctatgtgggggttggccacagcccccagaggagatgtaggaatggggccgggcccctgacgtaggttggtcaccaatctctggctgcctgacaaggcccctggtgttcgcttacagaccctcctcccaactgtgcccctctggggatctgggctcaggaaatggcttttcttttggtcctgagctgttgtgtttggtctgtggacctcaaaggaaagcagggctcttcccacagaggcattgcttcaaaccaaccccacccaaggctggaggttcgtgctccttgcctcatgacggggaagaaggcagcagataacagaacctggggtcatagaccttgagccacccagtagtgtctgagtggtgatccactcttgcctgcaatgaggaccaaggcaaaaagagttggctgaatctgcagcaggaaggatgagggttagataccaggaggaaattcctgacagtgagaaaagtaagacactctgtctgggaggctgtcgaatttcctttcatggtgccctttcagcaaaggaaggattgtgttttggaggtaaggatggggagagttctgtttggtgtttagagagttggatgaaaagttctgtaatcaacctgtgtcttgagaggagccaggaagaagttcaaagccatttgggtaaggtgatttgtgatccccggagaggaaaagaataggattacaggcaggcagagagcttattttcctttttataaggtttgtaaagtcctgtagtcgttttccctaggggctccacgcggagtaggcagaagattatgtgagcactgtgcagtgcccattttacagatggacaaatgagacggaacctctactcctcacactgggtatggtgatgagtatcatggtctgtaaaatataagctctctgaggtcagggacttcacttcctttgtcccctggtgtctagaacatggctgggcacacagctggtggcactcggtggatgtttgctgaatgagagaatgagcatgaagattggaggcccagggatgaccggatgccttgtgttactcccactgtgcttgtaaaaagcctacgtgatgaggcatgcttccaaaggcaccatctctagcctcgtgtgaggtcacctgtgtttctggagcagtagggtgtgtttgctgacatgccgtgcccctgccccagcccatttgttgttctctgagttctgtctgtctgtgtgtaccgacactcagacgtgtcaccgtgcatgtctgctgtccgccagcaagggtcacgtgcccccaaactttgcagaaaacaggaagccccgtcagtgagagggcagcccagtgattcatcaggggatgacagtcccagctgttcgtcccccatcctctgcactggggtcactgtccagggtggcttcctccccatgcctcccctcccctccccgcccggtggagcagagcgggcttggactttgccttatcacctctggaggcggcctggccagactctgtttgggccaagtttttatttatcttcactggctttttttggggtggggaggctgaggaatgtggagtgttgtaatgtttggaagagggcggtggggaaaggggagccaggtctcctgtcctgcttgtcctgcttacccctgcacctttgcaggctcccggccccccttggttccccagttccccctgccaagcccatatcaatatggcccattgtctttctccagctccctgggtctggtcccatgctcctggccacacctcacgtcttggctaccgttgtggcttccagttgttcaaagcagctgtggtggcttcctccaaaagtggctacggatcagcaacagatgaaactcaaggggctatttatagcagggtggccctggggcctggagcagggcctagggcctggggagattcagggactcctcattagggaccagtgaaatggagatgggtgaactgttgggtttctgtgttcctctgagggggcagttttggaacagcctggtttgggtcttgaaaaccaaacacagtcactcgttgactcccagctccacccctgtctaatccccccacccccaagcttgactcatgcaaactggagtcctcagggccagaagagctgtgagacttagaaacttccccccagtagccccacttggctcttccctccttcactgctgaggagctgctcattggtccgaggcagctgggactctgggcagagccttcttccggacagctggatggagggtccccctcttagcagagctgctctaacttggggctcagctgggagctggacctcggaacccacctatcctgcctcgtaggcactgcggagccaggagaggggtgcaggggctcctcttcttggagaccccgtggtcaagccccaggttggagtgtgaatcctgcctggccgtcaacttcccagggacttgagggtaagttattctgtgcctcagtttcttcctttcttggcagattgtggtcctgtctctttaaagaagaggctgcaacttggcggtaggaaaagaccattttctgagaggcacatgggtgtttggaaggtgtcaatgggctcaggaggtctgagaatctagaaactggccttcccaattctgcatcctgtgaggtgactggaaggatgggtagaggcgatgcagggtgttggttttctatagaggtgaatgtttggttgtaactacccttttcatttttcttgatacaaaagtaacaacaaaaacaacagctgtcatctggtaaataccaggcatgatgcgaagtgccttatatgcataactcctttggatcctcactgccagcctgaaggttgtcccattttacatgtgacattacaagaggctcagaggggttaagtaactggcagggctgcccagcaggatcctggaatccaaactctgtggtctgtgggcctctgaccctgtgctttcacacccgccatgccatcctgctgccctgggatggattgggcccatttgcttaagtttgtaccactcgacagctgtgaaaaggggagtgggtgagatggttactgtctgccacagacagtggggagtgggccctcaggagcatggctcactgtcttaggcctcgtcttggttcctgcatgctccacctgcctgttctggtctctaaactcaattgaatgacttgatgttacagctttcaagcagagaagtgtggggtgatggtggcaagacagaggggcgccattactctcatcgctccttttgtggtggcagtcgtattctcctcctggggtttctcttgtgttggcgagtgtatcaaagtgaagtgtgtttccattgattcagtaactgttgagtgtgccctcagtgtggatggcaccagcccagtggggtgcactcctcagcattcgggattcttccttttgtccctctggggcttgcacacaggcaggcacactcacgtggaatcagtgttgatggctttggcttcgggcaggctgtgtttttgcaggggttagggtggcagggccagaatgttggcaaggaaagaagaggatcatgtttgcccccgtggacagctctctggtgtgctcctcctgccatcctgcccacccctgcataatgctgcttctcttctctccttcccagggctccaccagggtcaccccgagtgtccagccccacctccagcccatcaggtatgcctggcccgtgggggcagggggcgggagtgcaagcaggggggtcactgtgggtgtccctgttaagtcttgcctctgggtcccccggactgcagccataaagccacgggtggggagtgtgggcaaacgtgaaaggcacaggagaggatgcgtgcggatgccgttggcaacagttgtgttttgagctcttagccagcccttgagctgagtctttatttacctgcatgagctcatctagtccttgcaacaaccccgcaaggtacgtattttattccctttggtagagcagcatttcagagagatgaggtgacttgtaaaggtcacacagccaccaagaggcagcacttggatttgcgtttagggctgatgagcattgaggcctgtgctggatctcttcctctctgcagacaggattctgactgggcagagtcatttatgaaagggaagttccctatctggctgggctggcaggggccgggggaaggggatgcacaagggactttgtgtcctggcgatccagagagtttgttttgccctctctgcctcaccttcacccactgaggctcctgagatgattggggatgccagccctgcagtagagttgaagcccctggaagtttctggcccagctgccagctgtccacagactggaggtggctccttagaggatcccctccttcccttagacctgggcaggtggatgcagagtgtgatgctgaggctgtccggctggtggcactgttctgcatttgcgtccttcctgggatccagcctgtagacaggggcgggtcagtgccccagatgggccacgtctgactcatggccctcaccagcacggcccctcttgctccccttcctgtgctgagggagaggctgaaatcacaggagcttgtcttgcgagtttttctgacattctagtttcttccttggagccagaacagagaggggttttggaggatggggaggaggggatgctgcaagttagctgaggctccccgccctcacacccacttgcttgcaggtatgtgtgcgtgtggcttcttgtcccagactggtcaccacctacaagaactgtccttgggtaggcagttggcttgagatagaaacttctcccccacagctgcaatgagaagctttccatagggacaagaagtagctgggactcagagtcaaactcaaaccgggctccttacctctgggtgctggtccccagtcccactcaggcccctgtcatcccaacagagaggtcctgccatgcctcatccttggctgccccatctccacaccccacctggactgggattgaaccctggtggaggtctggattcctcatggcttctcagcatctgggggcttgttctgtctagtgccagagagccctcatcacttttaaataccccagtggtattcctttcgctgccctccactctccactttatcccgctgtggtgaaaggttagcagaatgaaatgtcagtgctgcctgcatttgatagagggggaagcgagacactaggaggtcaatgattggggaaaaagctggagggatgggggaggtgcttctagaagcaagaggtgggcttcccaagtgggcatcctggacccttcctctggaagaaaagttgggagagatgtaaagatgcgagcccctcccttcctcacccagtgcccagtggagaggatggccagcccaggggcctccccacctctccgggaaacgcatggtgctggcggctgcccgccactgcagcaacaagggctctgtgccctcttgttttctgggcccttagaaatcagggaggctgctgccaagaagcagctctggcaggcagtgggagctgccagaggtggggagaaggccaaggaacaaagggcaggagttggcctgcctccgggagggctggaatgtgtgctgtggtctggcttacctggaacccaggtgaacgtgtcacctgagatgccccctcccctgagaggtttcccgcccactccacagctcgagagctaggggcgggcagtgggaagtctccgttccagggctggagagcgcccagcgcaggctctccttcctcttccagagcagtctggggcctttcgggagacttctgcctggccaggcagccagtgttgggagccagagctcctgggttcctgggccagtctggccctggctctgagctctggagtcacaggttgaaggcagtggccaaaggactgatgggaaccaagaattggtgtcatcacagtttggttctgaaatggcctgaggtccttgccagccctacccagcttgttctcgccggcactcccaagccggccacattggccttgccagaggaagcctgtggccttggccttgggttgaagagcagccaagcaccctgggctgcatatgggggtcacacagggtgtgtatggggtgcagctatctggggccttccctgtgggctggattctgatatggaccctccgctgcctgctgtctccctagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctggtgaggatggatcctcgtgcccactgtcctgtgccctctatgcttccatctgctcaccacctctacatgactggtatccctgccaccagcccctgtgccagcatgccctcttctctttgtttatctgcctttcccctcaggcagctctcgtgcctgagtcttcaatcactctccagcccagctctcctctaaggagtgtgctgcagctggaatgtagcatctggaactctgtgtgtgcatgtgtgtgctggccaggagaagagagtaccaataagagttcaggttattgagcgcttgctactagccaggccctgttccaactgctttccacgcacttaacctttgcagcagccctagcaagcaggcacttgccagagcacagagaggtggggttatttgcctaaggttgcagggtcaggaagtggcagagctggcacagggtcggtgcctctgagaagtctgagggcagagtcttggcaacatgtgtcttaagggaccctgggttgctggcacctggctcggcctggcccagaggagtcaccttggcacacgggagagaggtgctggcggtggtctccactaacgcagaaaggctgatccgtccttggccccagaggagggctcaggtccattttagagggaggtgcctgtggactggacccacagatctgatctgtacaacctcaggtggctgtccccagggtgtttgaggtgggatgtaggaggctgcattagtttcccagggccactgtagcaaatgaggtggccctttctatccatgggtttcacctctttggactcaatccatcatgagttgaaaatattcagaaaaaacccaacagtaaataacaataaaaaacaatacaaataaaaacaatacagcagaacaactatttgcagagcgtttatattgtattaggtattacaagtaacctagagatgatttaaagtctacggaagtatatgcataagttatatgcaaatagtacattttttatatgcaagttatatgtaaatagtacatattttatgtaagagacctgagcacccatggattttggtatccactatccatggcggggtggaggggtcctagatccaaatcctccatagacaccaagtgatgactctacctcaaatctggtggctcaaaataacagaaatttattctctcacagttctgaaggctggaaatctgaaatcaaggtgttgacggggccatgctccctctgaatcctatggcagagaatcccttcttgccttttcctagcttgcggtgggattccttggtttgtagcgcatcactccaatctctacctccatctccacgtggccttcttcagtgtctctctgtgtgtcttctcttcctacaaggacatcaattattggacttagggtccaccctagatccaggttgatgtcatattgagatccttaactacttacactggcaaaggcactatttccaaataaggttgtattctgaagttctgggtggacatgacgttttgaggatactattcaaccactatagagacccacctgttagctgcattggggcattgttaagagcttggctttaaacctcagaaagtcctgggttcaaattctggctctgcctttactaactacatgatcttagctgtttagcctcactaagccctagcttctgtgtccgtaaagtgggtctgaggtctacctcttattgttgttgagagaattaagccagctgttagatgtaaagtccttaagacaggctgacaggtggcagacattcattgagtgatggctattgtaccataataaagtgtattcctttacagagtgcaagagtggatgcaaatccacctatttctgattttaggagtccagggttctatgggacttggtgccctgccacccctctctctatcctgcctattccagactgggctgtccccttttctccccaggagatgacacagtgcctttgagtttcctaggcagtggggtggaggtgggaagttctgcatgcccccctcggaggtagaggcaggaattccagagactggagaattccttaggattccagtggtcaggaatgggaccccagtggtcaggcgttgaaaggcatgtgctgggagaggtatgtcaagggtctgattgggcccacccaggatggtttgcccctctgatggaggaagtctggtgacagagaggttgcaacctcatgggatgaggttctagggtcaaggtatgaagtggaaaccagagattgccaactacttatcatctcacacagctggattcccgttcggtgtggtgagaggcaagcggaactggagacaagttccatccccttctcgtcttccattcgggacatccgctcacggaacagggtggctgagtgtctacatctctctctctctcccttttcatcctgaggacctacagttgagttcctcttcgtgacggtgtgtctgctgggactcacctgcatgttcacgtatggatagaattcctatcggggagagagagcgagagcaggcacaggaggtccagggagctcatggctgttccgtggccaggcccctggccgtgagaggacattgacgctctgctggatgctgtcgtgggctcttcagaggaagttggcaatgatgccacggtcctttctgggaccagcaggccatggttctctctctcctcgccgccctcctcaccctcacctcctcatgctctcttccttttgctccttctagctgttcaacctctctgagcggagacctgacatcacgaagctccatgccaaggtgagccaggggctgttttggggtaggggaggagaaggagaacagatggactccctctctggagttcccacataataatcttggggaaaatgctgtgacagtttgtcagagtgccgacttatatctggaaaatggaaaatgatctacttatcatttccacaatgccaattacagaaagcaaagcttggggcagtgactttccacccaggtctgcctgctggggagtacacagaatcacttgggtgaggctggagttgtgagatgtttagtttttggatttaaagcagttgggagccgctgctttcgaccttccagctgccggtttttttgtttgtttgtttgtttttttgagatgcagtccccctctgtcgcccaggctggagtgcagtggcgtgatctcagctcactacaacctccacttcctgggttcaagtgattctcctgcctcagccttccgagtagctgggactacaggcacgtgctaccatgcctggctaatttttgtatttttagtagagatggggtttcgccgtgttggccagcctggtttcaaactcctggcctcaagtgatctgcccaccttggcctcccaaagtgctgggattacaggcatgggccagcgcgtctggacctgttgctgctttttattctgtttgctcgggggctgtgtgtgggctttgccatgggcatctgctcctagctctgagagtttggtacatgctgttgtgtgatcctgggtgggtgatggacttctctgggcctcagtgtgcccctctgaaagtggcctggctggattaggtgtgctctatgggtccttgcagagttctcttttactttaaagttggtgagtctagaaagattttgagaggcccgaagcctgctgttcaggtctgccctttgtgtccttaaggctgctcttggctggcctggaaagtggatggtttgtgtgaccagggcctagaaaagagtcatgaacatcaggcagccttttgctttttcctctcgcagcctgagccaggcctcagggctgtccgtaggagaagagcttgaggacagtgcttggggcccctcagcatgttggaggtcagtcctatggtagggaccttggggtcatcagctccaagcctttctttttgtttgtttttttaacacacatatggggaaattgaggctggaagaggacctgaggcctaaggccccacagtgagtcagtgccagggccaagacccgggaccagggtccccagtactgggtcatgcatggcctttgcccttcactcccctgcctcctcgctggccagtgggcagggaggaaccaagtcctggcaggaaccagcagctgcgggccactgcccaggtactggcacgtggcgtaggtggctcccgctggcttgtttggctctgcagggcttctgccctcttctcactcatggcttgggccacaggtactggaatttggctggcccgacctccacaccccagccctggagaagatctgcagcatctgtaaggccatggacacatggctcaatgcagaccctcacaatgtcgttgttctacacaacaaggtcagagctgtgtgtgtgtgtgtgtgtgtgtgtgtgtgcgcgcgcgcacatgcgcacatgtgtgtgtgcctgaatgtgtccttggatgattgtgtgtacctgcctatatctttggattttgcgagcatataagtctgtgtgtatttttctttctaggggataataggttctgtcttgggcggcacttctaagaagtgtaggggacatcagcttatgtccacggcagtggatgatcagctgtgttttttctgagacttagtccccacctgcctccctcccctgaggcccccttcctccttatgttctcccttaaatccacacccctctctccagccctgactcttttccaccaaggcttctagataagctctggggcagcaaggctggccttagaaataaatgattttgtgtttggggctctttcagggaaaccgaggcaggataggagttgtcatcgcggcttacatgcactacagcaacatttctgccaggtaagaggggcctggagcctcccatcctctgaacatcgacagtgtgacccccctcctctcatccacccacagcctctctgctccctggagtgaggggatacgcacagagggaatgagaagcgatgaggacgggggaaggggcccctggctctgaggcaggagcctgtggacagagggcgggagggaggagagtccacttctctatcaggggttctggtggggcagccttgggaggcaggccctgtcctgagcaacccatgcggccagctcctcggagccacttttccttgccaaactgccttctttttccctgggccagcaggaagggagtcagaaagaaatgtcggatcagatctgggtctggcaaaacagtctagaagttgtctcatctattcctctgcctctggacaacagggccctcttcctacctaggtgtttggaacaagaataaagaacatccagtcactgactccctttccaatcccactctgcagagaggcagagggattcacccattcgttttgttattcactcaacaaggaatatggctgggcgcagtggctcacgcctgtaatcccagcactttgggaggtcaaggcaggtggatcacttgaggtcagaagttcgagaccagcctggccaacatggtgaaactccgtctctactaaaaatacaaaaattagccaggcatggtggggcaggtgcctgtaatcccagctactcaggaggctgaggcaggagaatcccttgaatctgggaggcagggaggttgcagtaagccaagatggtgccactgcactccagcctgggagacagggagactctgtctcaaaaagaaaaaaacaataaatattgaacagacaatgtgccaggctctgttctaggtcctgggaatgcagcagagggcaaagccaggccactgccctcatgggcattaaacacataaacaaatacattagtaatagcaggtgataattatcgtgaaagagtaaagggactcaagaagggcagtggcgaggcaggtccatggttggagaaggcctcttgatgaggtgacactggaacagagacctgagtgaccaggatggaaagggctgagccttatcaagcctgtgggatgtgccctgcacactgagagaagaggaaggatgggaatgcgaggggctgaggtgtttgaagctgagcaagtgagggaagaggaagaggaggggaagctgggaggtggcagagccatggggcctcgcggcctcactgaggactttggggtttgctctaagagtgatgggaagtcactggagcttcgtgatcttttcatttcaaagtgacttctctgagtgctctgtgaggatggtagaatcttctgtggagggcctgccaggaggctgtagttttaggacttcgagcaacccaagtcagtctcacctttgcttaatgataagcaaagatgaggctgcacctttactgcactcctgtacccctactgtgtgccatgagtgccaagctctttatggatattccctcacttcatctccatagtcacctttgaggaaggggcaattatcaccctcatttgatgggtgaggagaatgaagttcagagagattcaggaacttgtaccaggacacggggctcataagtggtagacctgagctgggctcccaggctgctgaactttaaagcctgggctgagtgcggccctgcacagttggagagatgctgaaacactcttttcctgaaagcttctcggcacaggatggcagggggaagaggcttgtcttccctccaggacaaaggtgctctttggccagagtgctctgcaggtctgagggagcaggggtggggaaaacaagcggctcttggatgcaggagttgcctcttttgaccacctgtctctccctgcagtgcggaccaggctctggaccggtttgcaatgaagcggttctatgaggataagattgtgcccattggccagccatcccaaagaaggtgggtctctggggctcacagccccttgcatgtatgtgtgcactcactctatgtggggactagacttgtgtactcacagggatgggatagctgtgcctaggtgggggtgtaccaggcgcaagttttcagatgccagcctgcagtggtgtgagctcaggcacacaggagagcccgggagccagcctgtggtgtgtgcccgcagattggcacagcacttgactctgaggcctgtgctagagagcagtgcaaccttcatggggaagcatgagtctggggataagaaggcgctggtctaggaaggcatgtgctgttcttggccctggaagcaggattgcttcagtgcttggatgagtctacgggagactgcatcactgccccctgctgtgggaggtcagacactcatgataagggtcaccttctgttgggagagtttagacagttttactgagagctttcaaccacatggtctcattggagtctcacaatagcccaggcaggaaacagggcagggatggatttattcattcagcaaaatttaaatcatctactatggctccaagcactgagatatctgggtgaacaggaaaaagtcctttcccttggtgagctgatacctaatgagagagatggacatgaaacaaataaccatacaaacaagacagtgtcagacagcaatgaggctaggaaggaaagagggcactgcagacacgagaactgataggggaacggggctcttttaatagggatggtcagggaatacctcttagagggggtgaatttgagcctaaactggaatcacggtgagctatcgtgtgatgatctaggcatcccattttgcagattagaagctgagccgagggagggggcgtggccatggtctatagtgagtagtggcagaactggaaagtacgtgaaggcctagtaatgcctgggctagggcagtgcctcctggttgtgtgacccactgtcctgagggatcctgctccgtgggtgacatgttgctcaaagacatctcatgcacaggaaggcacaggcagcatcaggggcaggaggtctttgggggaggctgcagccaggatggtgggaaacccaagcccaaactggagacctggatggtgggacgcaggcccagctctgtttgctgctgggagttgtgggcctgccacctgccgtgatgtcagcaccattctgcacactggtgacatggtgctgaatccgccaggcaagggcttatggagctcagcttctagtggatgttacacatataaggaaacaattcagatagtcatgagagctgcaaagaaaaggcaaactatgatggctagagagtgatggggctggaaagagggctgattcaaatggaagggccttctgagaaggtgacgtgtaacatgagatctgggtggggagaaggaagcctccaagtgaacgcacgggataaaggatccagaatgagggaatagcactgactacaagggcctggaggccaaagcatcctatttgcctttttagcccctgagcacactgactgggccaacaagggcctggagctgtgagtcctggagctctccagcctcatcatgctgagggtcccaacacgtgccccatcatcccaccttgcttggctggctagaactgtgctgtcccagctgggggctattcccgccattgtaattggaagcccaagaagtgagtgagtcctcaggtaacccagcaccttatagttgcacaaaacagttgatagccagcctcagagtcagcaaccagaaatgggatgtctttatgtgcagaaaattctggttagggccctggagacagcagctgtggatcaacgagagtcttctcagggaagaaagaatgattggtcaagcactgccttgtcagcctctggcttgccatgtgtgtctgctgactgtaatcacggtgtggcctttgaccttgaaggataaggatactaagagagaagcatgctgttccaatggcacagtgtggcttggagagaatgggtagagagtaacatctctgagtctgagtagtgaaggcctgaagaccagggatcagtgtcacctctcaggaataggattatttagggattccctggtgtattagtccattttcatgctgctgataaagacatacccaagactgggcaatttacaaaagaaagaggtttaatggactcacagttccacgtggctggggaggtctcacaatcatggcggaaggtgaaaggcaaatctcacatggtgacagacaagagaagagagagggtcaagggaaaggggtttccccttacaaaaccatcggatcttgtgagaattattcactaccacgagaatagaatgggggaaaccactcccatgattcaattatctctcactgggtccctcccacaacacgagggaattatgggagctacaactcaagatgagatttgggtgaggatgcagccaaaccatatcatctcgtgttcaacatatgcttgcatagcaggcagttggggcgtgtctgcctggctcctgtctgacactgcctctgcttgtggatgggtcacctctctgagcccagatgtggaagtgcaactgtgggtttactatgcatttattgccaccctcctgccttcttgtcagtgtcacttgcagggaatggagcagatggaggagaggagggcagggaaagagagagggaggggctttgcctgtagctctctcattcattgtcacccgcctccggactcattgtccctcgaacacagacacatcctgttggcacgatccagagatctgataggaaccgctattccaggtttccggcttgagtaatggggcaggggcctgaataggatcgggtgctgcccatcagattatcttacttgagtagtccgaggaggccccacccaaacccagggacagaggcccacaggcttggaggtgggccaaggagccaagagacaggaggggatcttatcatggtcatgtgggctctagttccaccctcttcagagagctactattggctcctgcagagcctcagaatacattctgattggtctagctgactcagcttgtcattccatggccaatcagaaaagggaaaatgccgaccaatcgacgcagaaggactgatctctattgggcagatgaccgatctctagtttattgggcagatgcgttggagcccagacttctttcctgctctccccatccacttccagctttgtgtgttcttgctgtgtgtctctggagtccagtgacccctcctggaccttatttatcctctctgtctagaaggagagggtgtgggttagttcttccattcttccaacagatctttgttaaagaactaggggatgttggctgggtgcggtggctcacacctgtaatcccagcactttgggaggccgaggcgggctgatcacctgaggttgggagtttgagaccagcctgaccaacatggagaaaccctgtctctactaaaaatacaaaattagccgggcatggtggcgcatgcctgtaatcccagctactcaggaggctgaggcaggagaatcacttgaacccgggaggcagaggttgcggtgagccgagattgcgccattgcactccagcctgggcaacaagagtgaaactccatctcaaaaacaaaaacaaaacaaaaaaattgggggaagttgaccctagagatagatacttattagaagctagttacctcgaataccaagtaaactcaaggatacagagagagggacttaatgcactttggtatgatgtagagaaagtgaagaactacattcattaaagtcttgctcactatttgctagactatcacttgtggctactggatctgtgggcagaactggggctgtgagtatgagcgcaagcttgatttgagctttgtgtgggggtgtgagggcgtcagagctgtttggtggttgggcctgccttgtgcagctaaatgatgcctgtcagggatgtggggtggaaattttggtccagcaggagattctcgggctgggagtgaagcaggaaagagatattcatgttgaccaccagagggcggtggcgaactccaagtgggatgcttgacttgacccagctctaggtctggtatacctgctcactcttcctacctagggctcccagcagcaggcaagcatgtctgggagggaggcctggttggggagggggaccatgttggttggggagagggtagagtaggtgagtggtctagggcaatgttcttggaaaagagagaacagggattactgcaccagtacccacctcactccctgaagctgcttctcccaccactacaggtacgtgcattacttcagtggcctgctctccggctccatcaaaatgaacaacaagcccttgtttctgcaccacgtgatcatgcacggcatccccaactttgagtctaaaggaggtacctgccttgagccctctgacctccacccttgccaactcctccctttcatcttccatcttctctaagaggcaaccttgggtagtaacagacagcccgagagctgcagagtcataaggcctccattggactctcaagtgtattgcttcctaaacttttctaagcaccaatctatttgcagtgcctgctggccaatgatgttggatgggcaatgtttttattaatttaatttgccttacaagtgaaaagttggtatttcttcccctttctgcttcctcttttactctttcctcttttcctccttccccttcctaccccgtcttcccccatttcttccttcctttctctctttctcccttcactgtctcctctgcccctcctgcctgccagtttctgctgtcttagctaacacccaccccacttttacaggatgtcggccatttctccgcatctaccaggccatgcaacctgtgtacacatctggcatctagtaagtattacatgggcgtgagaggccagagaagcccaaggcccagggctaaggaccaggtcagaaggttggggagaggagagaatattctcaagagggctgaaaggacagagtcagagaggtttcccactaaccctgtggcgtaggggcagcagggagaaaatgcccctccctcatctcccctccagcagcccactctttttctgcccacctctctcccttagcaacatcccaggagacagccagactagcgtctgcatcaccatcgagccaggactgctcttgaagggagacatcttggtgagtgctgtcctctgtgtcaagccccatccttgtttattttctctcccttcttttcttactcctttcctgcctcttgggacaagacaggtactcctcctgggctgccaggcttggaaccataggctctcagggctcttggaagaccttccagtctcacacagtctgtgtctctcaccctgggcttagctgttgttctggagcatctccagggaaatatcactcagcgtgagctgttacctcctggcttcttattggtgacaaggactctctgaattctagcttcagttcttcctgctgccatttaaatccatcttactttttgcactctgacttgtatgtagaaacttcttgggaggacatttttgtccccagaggccaagactggcctccaattctctgctgttctagaagtttccccacagaactctgagatcctgtttggtgttgatgagctctccctcaccgggtttggggtgagccttgggggctcagtcagcggagctgataaggaggctccctgggacctgacctcccagcctcaggcccctgactggttctgcccgtcttcccacccagctgaagtgctaccacaagaagttccgaagcccagcccgagacgtcatcttccgtgtgcagttccacacctgtgccatccatgacctgggggttgtctttgggaaggaggaccttgatgatgctttcaaaggtgcgctccttgagtggagctgggggtgggcacccctgtggcagggagaggagctcagtttgagacgatatggtgggtatggggaccatcttttctggaccatgtggtctgtctagtctcagggtgatggtaggagagagttgagagagacttgggagagagttgagattggatggtctgggaattccagttgttagtagaagtggagataaactcctcccagtccttgggctgttttatatcttgcagccttctatgactttccctgtctctccttcatcttgtcctcccagtttgtcacatgtgtcctactgacaatcattttttttttcaacattcactgggcatctgctttgggctaggatctgtaccaagtgccggggatacaaagtaaaacatggcatggtctctgccttggtggagctcaaaaatcttgttgagttgggaggcagactagcaggggataattaccctgcagggcagaagagcagtagtggaggggtgtggcagcagcaagggggaaccattttctgagaggagaagaggtggttgggaaaggtttggtgtttgcttttgcttctttcttttatccattggaagttttatctatatcacattaatgcctgggacatataaatacacatttatttacccatctctctctccatccaccaatccatccttacacacatccatccatccatccatccattcatccatccgtctgtccatccatctgtccatccatccacccacccatccatctatgcacccacccattcatccatccattaatccatcccttcattaatctgtccatccatccacatattcattcatctgcccacccatccatctatccatccatccatccatccatccatccacccacccacccacccacccaccaagcatcacttgtgtgtctgtatgtgtcgggcatgtgctagaccctatagatatgaacagaaagaagtcaggccctaccctcagggagttcacagtttcctcagtgagagacacacaaacatgatactatgaagtgttgcctgaagtgatggagacacgcacaagcatgataggtgtcccatggagcagatgccatccttgctgtaacttcttttcctacatgcagtgggcagtgatctgtgtccagagtgggctcaggcggagaaagactggacctggggcttggaggagggtccagatctccttagtgtggtctggctcatgtagaagggtgtttctttaatgagctctccttgcactggagccagaagatgccatcataattacagtacagaatgtaaatgataacagtcttaacaaggaaaaataaaggcatagctgatcaaataaataagggattgggcagaagttgagagaaggaagggtcacagatttcctcctcttacgtagtgggagtcaggagataccatcgaaaattgacatatcaataaatagaggcatggccaggcacggtggctcatgcctgtaatcccagcactttgggaggccaaggcgggaggattgcttgaggccaggagtttaagactagcctggtaaatatagtgagaccccatctctacaaaaaataaaaaaattagccgggcatggtggcatgtgcctgttagcacagctattccaggggctgaggcaggaggatcacttgagcccaggagttcaaggctgcagtgagctatgattgcaccgctgcactttggcctgggcaacagagtgagacctggtctctaaaaagagaaaaagaaatagaggcttaactatcttatttaaagtttcaaagataatcaatagcataaataaaaacaataatctaatcagatttaagaagacaggaagtaggggtagtagtataagtgaaccaaattattcatattaatagtggtcaatccatagaggttatttaaaattcatgtctggctgggtatggtggctcacgcctgtagacccagcactttgggatgctgaggccggtggattgcttgagcccaggagtttgagaccagcctcagcaacacagcaaaactccgtcgctataaaaaatacaaaaatgagccgggcgtggtggcttgcacctgtagtcccagttactctggaggcagaggtaggaggaccactttggcttgggagattgaggttgcagtgagctgtgatcgcaccactgtactccatctagggtgacagagcaagattctgtctcaaaaatataaatatgcactccaggctgggcgacagagcgagactccatctcaaaataaataaaataaaataaaataaaattgggatctagaaatagtggcataaaaatagtggctattatttagagtcttagaggtaaattgctagtagaaaagcaatagaaatagttagaatcagtgacctcattacctcaggcaagtaggacaggggctagagtgggcaggaaatttaatttcattgtatagatataatttcatgtatatatgtataaatatacattgattattattatattattaaccatgtacatatatggtattttaattttttctagaagaaaactttttatggaatcctttttgggactttttgcctatttttatttttccttctctttttccagatgatcgatttccagagtatggcaaagtggagtttgtattttcttatgggccagagaaaattcaaggtataagccgagttagaattcattctctcactccttccttttatcctgaccctatccccagcacccttccacccctggtctgttccacagtgatcaagttatttttgagaggcaggccatcagtaaaggatctgggtttcagagtggacccctagctaaacatgaaccagtgacttaatctctggataataaaaataaaaaagcagacagagaggcactgggttggataaactgttctggtcccattaggtcatcagcctgttatattcagagactgaggtccttggtagatggagggagtggctggcgggcagggggcacacaaaggtgctggatagaagatgtgtatttatgagaactgaggtgattcaacctgaaggctggtttaataataaccttgaagcctctatactggttataagtggagaccagttgttcaccatcttattcgagaatggaatgaaaggagatgaagttaggttatgggcagagggactctggatagactaaagaaaggactgccaagccaggaaggtaactcaccctgacagacttgactaggagctatgctgtctttgagccaggtttttaaaaatttacttatttatttttattttaccttaagttctgggatacacgtgctgaatgtgcagatttgttacataggcatatatgtgccatggtggtttgctgcacctgtcaacccatcgtctacttttaagctctgcatgcattaggtatttgtcccaatgctgagctgggttttctgtggatggctgggagattctgccgtgccccctaggtttctgtctggagcggagagcgttttaagagggggcagggccatgcctgggatgaccctttggaggctttatgtcctttcaatgtcggggctgtgatttccctgctgtccctgatcccacgtagctcataagcagcctgccccccacccccagggtctgaccccaggggcagactttctagtctcttggcactgcctcaggagccccagggacacagaagaaaaagaggcaggtacccagccaggggtcctccccgctttcttccagggggtcttcattcttcagtgcctgtcctgatttacccctatgacccggcatgagccttttcaagaatgtgagaaactagactcccagttctcagtccagcttaagccactggtcccgcccaccacgctcaagaaaatgagaagtccctcagggagcctcttttggggagcttgtgggctttctctgtttttccagctgctgatctcttttccctctctgcactgtctccccgactgccgctgcctttcccatcccacttaggcatggagcacctggagaacgggccgagcgtgtctgtggactataacacctccgaccccctcatccgctgggactcctacgacaacttcagtgggcatcgagatgacggcatggagggtaggtgggacctagtggctcccagcccctatccaaactgcacagcctctgctcacatgaccttgcttctcttggcctgctttcaagagatctgggttcgagaggaggcagaggggaagtgtgaggtacctccgagagctcaccgttaactgggggaagataaggcacatatatgaatgtattaaataaaagtgaggacagagccaaagaaggcagcaaaatggccacaagggggttatcgtggaagtgtgttgctacagccaagtaagttccgtggacagtgagttctctgggattggcagggagggattttgagagctggagtgatctgggaaggctccttggaggatgtggccttgagtggagcttgagataccccccactgtgctgcaaaaacagcatttgtcacatgtgtattaaacccactgttgggtttcttcaggcttgctgcctgagttctctggggtcagagtactaggaacagaggcacaggatctagggcctacaagctttcatcaacagccaacaaaaatgtttgagagctgggaacaaactgataggctctgaaatttgaaaagaaagcagcagaattgaaattaatacatgtttaatttagctacaaacctaacattatgtcaaatggtccactgcaactcaggtcgtctcttgagagttctacatgcattctatttatttatgtggtctatctgcatatgtgtaaggagacgtggggcgggctccgaaagtgagcatgcccagagcccaggaactcttgagatgccctgcctggggtttggccacaagcttcttttcttgagttggtcgtaggactgcagaatgttggagctgggaggaccttcaggatggtccagcccatcacccatctgtgttcagttggggtgactgagacccttcccagaggcagaacctcctgatttacccccgtgacccaggatggccctttcaaggatgccagcacccagcgtctggcttctcctcccagctgaagccagtcctgggtggggctgtgccatcctggggcccctgggtcccatggcagagctaggttagagataggtaggcctgggggcctccctgtgccctctttcctctacacggcgctgtcttctgtctccctccccaaggttttggatttgatgactcctctctgaaaatctttgggcctttccttgaataaagatttctcctctgaccttggggtcaccagaatgagcacaaggtttcagagagaagtgggatgagggagggtggttggactagaatttggggactcactgagagcacatttttttacgtgcaacattgaaaagtggatggcctgtcctcacacctgcctcagttcccaaccccttttcctcccccaggggcccagcaccctcagattggccaagacaccccaccaggcccctccgaccccccaggctgcttgtgaaaagcactcctccatccccgggcgctgagcggccaagcagaaagcagaggctggagcgaatttgttctgaggtttcagtggctgccagcctaattggtcgttgtgctggggatgtttgcatttttaacaagaacatttggcaattggaaagaatttttactgtctctccatctcttcttggtgcatggtcaatgcgatgataaatgtaaaaacatttagtaaactataaagtgccaggcaaataaaaggtaaaataattaacggtgaggaggagatgtgggaaagacggggcttaggatgtatttggctgtgggggaaggaagaagagcagacggtcagagtgggaggcagcccagggacagcagagccgagagcggctccccctctcggcagagggccagcttctcagcctccagacagggcccctctgtccttgcaggatgagctgacctttaactgaccaaaaggtcctgctggttccatccctctgtctgagggaatggattagaagggaaaaaaggaagggcgagggggcagaagaagcggccagggccttccctcaccaaccctctgtcccctctacctgcctatagcggccttcatgagaggcagttagtatgtggttaagaatgcagcctctgcagccaaactacctggcttcaaatcctttgacaaggtactgtccttggggcctcggtttgacctgctgtaaaatgggaattcagtcaacaaatcattttgagccccttgtgggcagcacggcctgaggaaggactgcatgtggtgttttcttgggggtccgtgacacatttgtgtcagctgtggccagtgtgtcaggcgcctgcaagacatggctaagggagaaggcctggatttaccatgcaccagccatggcaccaagaacttggtagttgccatttcatttgatgctcccagccattctatgactcttattatgtccaaatggggaaactggagcacagaggggttaagtaacctgccccagcttgccaagccagtcaagagcagatctgggtttcaagccaccgcgttgccccctgtgctgtcctgggttggctgacgtccctaggggcctgctttgggcatctggttttgtggcagtacctgggtcccactaagcctagtacctctctggctgctacctctcacccatggacagagaaagtcaacccatcctgactgttaggaagagggagggttaggcgaggggggtgtgctggagcgtggcaccccggaggccactgggcttgccctgaggcaggcgttcagcaagacttcagtgcaggcaacagctgagcccctggcccgacccacagagaagagtgtgggccgctcactcaggaatgcttctgatgagtggcaggcctctcgaaataggtagagggaagggtgtccaaggtgacctggggccatttctgaaagtggccccctgcctacctcttctatttcaggcccactgcgggagggtgatagtagaggccagaccattccctctggagcccaccaggagacttggaggaggggggcagggagcacccagccaggcagtcagcagcagatgtcatctctggcctgcatcctctcgtgtggcctgtgtccccaccttgccctctcctggcagtgaggcatggccagcaccaggctcagagctcctggtcccccaggaggccctcctgctgcccctgacttaaccatcatctcaggaactgctctgcatttaaccctttcctcactgcctgcagccccccaacccagctccaagttcaagtttacagcttgcagcactgtgacacttagagccctctcccgaattctgttgaatttctgttctctgaaggctgacttctcaggctcaggtggctgggctagtcataaaacccgagagggagggggcctgccaaaggggcaggaaaccccgaagtatgggccctccttggcattagctcagctcagcctgtaccaaccccatttcctggatgaagaccccagaagtaggcagaggttagcaatcttgtccagggtcatgagacaagatgtggagttgatattggaatccaaatccctttctacctcccttggagctcagcttaacagcaccccggaacccatacccataatccttcaggtggctccttcaggatggtcgtcccatttctgaagccctaatgatgacaggggctcactaccacaaagggaagcccgtttatggtgggacgggtccagctgtgtctctgtgtagcaaagtgtggctgtggtggagactttgggctcacctgctcctgggccaggaggaggggggcgtgatgagggtgaagaatcaaagggaagctcaataataaggaccctcggactggacgaagttctctgttgtgggacagtggctgggaggacagtgcctgccatcttggggaccctttactcccagagcagtgccttctggtgaatcccatgcctgaagtattattaatctgctctggcagccacagcaaagcaccacagacccaggggcttgttcaacagaaatgaattttctcatagttctggaggctacaagtctgagatccagatttcagcagggttggtttctcctgagacctctctccttggcttggagatgctgttttctccctgtatcttcacatcatcttccccctgcttgtattcttaccctcatctcttcttataaagacaccagacgtattggagtagtgctcaccctaatgatctcttttcaccttaattgcctctttaaaggctgtatctccaaatacagtggcatactgagctgctgggggttagggttgcaaaacaggaatctgaatgggggaacagttcagctcgtcacacctgagaaggagttttctgggtcacatgtatttggatgccccaggcctttgatcctgagtgggaggaaggaaaggtcaaggacaggtggtggggagaggtctggttccctccttgcgggcacctctgcctctctccagttagatctggagcctgccggctcagtgctctggctaacaccagttttgcagcctccagaaaccccattagcaacttggcctgagttctgatgccccgtgcccagattccaggtccccatgggtaggggtggcgctgtgtttttgcctctgctgtataaagcaggctccaaattcctccatagtgttccggggcaagccttctcggaagcaagccttgaaccaagggatatggactgccctctgcctctgagaagcctgcaggctgaccaggcctgggttcctgcctgccttctcatccaccccccacctttctgtgacttccttggacatcagttgtttagagtttctcttgactcaacagagaggatgggaacaggggttgggcaagtgaggggtgctctcagaaagtagatttctcagggataaaggacagggtgactcaggggaatgacaaacctcccagcctggctgacaagggtgaggggctggtgtccaccccacttctgcatctctcctggttggcgcccatcagtctttcccttgtttccatggacaatcccaccagaaccgggggctggtgacagggggccttggttttgtgcccaagcttctcagccctcaggggagatcttctagttctaaagggtgcccatccactccccaagtgcttttgtctgggtaggggaggagcctctgcctggagccaggaatccctgttctgtgatgacttcttatgagctgggcttatccaaggactctgtgatactttttttttgaaagaggaaagagggagggaaagagatacagcaaacaggcagagaccaagaaggagaaagaaataaatagatgagagacatggagagatagacaggcatggatagatattggcctgggaggcagaagatttgggttctgggtgtctctggtaactctttttccataggtcctttttatttcttatgaaatgtgagggctggagtagatagtatttctttccatttctttgagctcaagcattgtgtcttttcatgacttgtgaagacctaaaaggggcctgccaggcttccctctcagactttcgcaacccatgggcttagagcaggaaggagcatggcttagtggttctatcagtcaggagaggctcaattatgccacagtgacaaatgatcccaccttctcagtgggcctgacccaacaaaagcatatttctgctcatactacatatccactgggggtcagaaaggtctctgttcatcacagatactctaggctgagggcagcttcatcttgtaggtgcttccttcactgctgcagctgtgggaagaagacaccatggcttgcacactgctcctgcctagaactcacatgttttccttccgctcatgtttaattggccaaaacaagccaaacacccatgcctagcttcaaagggggcaaggaagttgtgcatagaggatgagaagctggaaataaggttgaacagaccaatctctaggaattaaggctatgggacctagaaccagaagatctggttctaagctctattgtttataggtgtgtttcttggccaagtaactttgcctttctgagatccaaatgtcttaattgtaaaatgggttcaataacagtactttcattatagcattattgtctgatatacaatgaggtaatatacatgaaatgtgaaaagcagagtggcgcatgccatgctggcagtgatttgtgtctgttattattattattgaagtgctggaggagagaagatacagacatgattttagccctctcttctttagaaaaagccgcgttccccttgcccctctactctctgggaaccatctatagctggctctgttctgggaaccccactcttgggagtcaggagacatgcctctgacatcaacttgctatgtgaccttggaaaaattacttcccctctctggttctcagtttcattatcagcaaattgaggataatggatttcaaaaagggcttccagctccaaagccctaacaatgttgaggatgctgatgctgatgatgaccttgagatgagagcactgtgtactttctgggtgccaggcaccactgactgtatgttctcttggttaatcctccccaaacacctgtaggtgggtgctgttttgtacttactgggctgaacaagcagaatttgtaggatgtgattaaaaagctacttgttttgtatactactgccctttaagtctaccctgtttccccttcccccaaatgacactggggcaagttccatcccttttctagccactctcaggtaatacaaggtcttttggtgggtaataaataaatacgcccagtgctggtgaacttgctcctcccccttgtcagctcctacctggctgctagctgtgtgtgtgtgtgtgtgtgtgtgtgtgtgttggttggggggcgggggtggtggtggtggtggggaggctcagtaagtcttctttctgttttcctgacttacatatttagggttaggaagggaagaaagggggaacattccagaacattctttcttgcctggtggggttgcacaggcattctctgtgtggagacagagacacaaatgatatctcttgggttctttgccagtggaagattctggaggcattgaatgccctctggcttctctcctgaggcacttctgtaggtatttgggagaccctgtccaactgcccaaaagtctttcattcgctgttccctttgggtggcgaacatggttctgttcagatgctcaggacccccttcctcagcccagtcatccttcgctccctccagcctcctcctgctgaaatctctcacccctgcaggtggccctcatggacagcatttgaggcagcccaggggctggctctctctcaccttggtccaaagtaaaaagtcagcactcctggcccccgcaaagacccgggttgaggtggccagtgcgcccccacccctgttcccacagcacagttaggcccctgtctttcacatcctccatgcgcccgcaggtacctgctgagtctctgagcagactcactgagatgagggagaagcctctagaaaggtgggacctgccaccaaacaccgtgctctccacaattcctcttacaatcttccactttctaatctttttacacctttgatatgtatgtgtgtgcatggtgtgtatggcggtatagtttggagccacaaagcagttttcagccatcactctctttttaaaaacttaatagctgtatagatataatttaataccacaacttcacctctttaaagtatacaattcaatgggttttagtatatttaggcttgtacaaccatcaccgtaatctcattttagaacagttttatcacccccacccaaagaaatcttataactagcagcagccactcccacttctgccaccaactcccaaccctaatctactttctgtctctgtagatttgtctattctggacactttacgtaaatggagtgatacaatatgtggtcttttgtgtctggtttcttttacttgacccaatgtttcattcacgttgtaacatgtatcagtattttattcatttttgttgctgaatgatattctattgtaggccataccatattttgtttatccatacatcaccatcaattgatgaacatttgcattgtttcaactttttggcttgtgtgaagaatgctgctgtcaacatgtatgtgcaagtttttgtgtggacttaggttgtcattgctcttgggtagatagccaggagtggaactgctggatcacctgtgtcatcatttgaggaacagccagagtgtttcccaaagtggctacaccatttggcgttcctaccagcaatgtatgagacttcctccgcatcctcacccacatttattttctatcttttggatgctagccatcctagtgggtgtgaaagggtattgcattgtggtttcaatttgcattttcctaagaattgatgatgttgaacatcttttcatgtgttaattggccattatggatcttctttagaaaactgcccatccacatcctctgtttcctttttaaatttttgttttgtcttttcattattgagttgtaagcattcattttatattctggcaacaggtcccttagcagatatataatttgccgatatattctcccattctgtgagtggtcttttcacttcttgatgtcagtcatctcttctgcaaggcctgcatggtggtcttctgccttacttttgaaatgtgtcattccttgtcctcaggcctcttttacaactgagacccaagtactttcacgttaacatctggtcacaaatagtgttcccatttgatagatgaggaaactgaggcaagtaacagagaagttaaggacttcgtccaacgaagtcttctggataaatggtgaaggcaggattccaacgtggtgggtctgcaaccagtcagggatttgcactgctacttaacattttatgatcttcatctgtagcccaaaatgctttaggctgtatggcctgatctctttccagctttagaagaggtgcctggattagcctggaaaggttgctcacagagagggaggccgagtttcagatccctggatggtagaacaggaaaaagcccatgagttctgccttccagccagccccgggcctgtgtagccctgtctcccttcatctcctggggcccaggccggatgggagagtggtgagaaggtgtcctccaggtttgagagtgagagatttcagcagtggggagcagagtcccagtgctcactctgggtggggctgtgggagagaactcgtgtgcaccacgctgtttgcccttgatgtattttctcaggttctgacattcttgccttctgaacttttgagtaagacgtgggagaaaccagcaagagaggggagtacaggattgcaggtggtcccagataactcagggaaatagtccaaggttcctggggagtgatacatgtgccccttgtatctaagcagagggcttcaggggtgagtttctacatgtgggtgctgagagcctgagattcgaccctgaactgatttttgttgggaaatggtcacctggcctccagaggggatagcccttctggcctgtgacttcaaggtggtgggggcagtagcaggggagggaggaattcaaagctgctactgaaagcttctgaccttgatctatcacatcatataggacaaagggctgagatactagcaggagaggtttgggttagcctcctggtagaacttcccaactgtgagagggtgaatcagctgtgacaggcagattggtcctcttgtcctcttggcccccttgggcagtgatgttgagggacaagaggggtggatcttagtgtgtgctggtctgcatagaggccaagatagaggcctggatgagacagctccttaaggaggattctcggttcttttgcctcccccaagaggggagtcctctcctgactcactggcacaattagtcttgagaattcaaatacaaggcaagcctgaccttgcgggtaaaaagatgacaccactgacccagtatctgccagccacctgcttgcactgttctctgtcgagcagcgctgggtttgtctcaatgccctcggacccttagctggccctgctctgcgaggcagctggcatgcttgggcagcagcctctgcccatggaacacacggtaaaccaataccctcccgagtgaatgtgcctttggtgctctgtaatctctgccatcgggtgcaggctggaaggccggagccacgctcagagccagccggagctctgggcacagtctgctctcttgtgctcaaatatccagatcgaggcaggggtcaggggagtgtgtactctttccccctcagcctccctccctgtttcctctcctgccagacctgtagacaagtgcaagctatccggacccatcaagaccccaagataccgactctaattatatccaataaaaggaatttaagcttctatcaatcaaatactttttcttactcacctaaagctgctttgcacccatcattaccttcctctcttcttcctttccttccttcctttctgtttccagttacttaactgatcccctgctaggtggtgggcactgtgtaagccctggggatatagaaagctgtgccctggggttgtctggagacggggtaggggtgtcagcccagtgctgtatccactctgccctgcagcccgtgggtaaggggctcgggcaagtgccctgtcttctggggatgattatgatcagaggggctggctttgcagagggtctgcatttgaagggcccctgggaggataaatggcattgaaggcagaattgtttttcagattaaaaagtggcataacaacgttgttcaaagtctggaaagtaaaaggaacgagaaacaatcaaatctgactggcttcctcacacaattgctctggtcactgcggtggggtgggtgggaccttagcgggatgttggaggtggtggaggtgagctgagggccagggcacccttgcaggaggccagggaggtgagaacagttgcagtgtggggccaagggaggggctggtgttccccgggggtccctgctgctcccaggagctgagctgagctggcccagaagccctcaccagagtcctggggctccattcccccgtctgctattgaaggggttcaggggcctcttttctcctttgttttgctttcagtttttcaaagcaacctttacaaaataaagcacaccaaacccgcagtagatgcgtccacagagcctgcatttcttgccctggtggacttggctggctgagggctgcctttcctcacctcctccccatgtggccgcctggggagactccatcaggccactcagagtcccacgcaggtgggggtgggttgatgccacccctggctctgatgggtgtgtggctcctacagtgggccttcttgccttcaggctccagccctccagcttccccattcagctcacagcagcatctaaccctccgtggtgaaggtcctctttctggactattccaaatgattccttgctggatctattgaggccttgggcgctcctccctgccttttcagaggctgatttgctttggcaaagttgagcttcttcactcattgtcctcgcctggctttggggccaatctctccatcagcctcggagaggcggcatcctccctggagcctgcctgcatctacccactccctcccctgcctgctacctggcaccctgtcttcctgcagcagaggccctccctcttggtccactctctgagtccctgctttctgtctgatggacagttctgaggctgtttatgggaaaaggcttcaagggatctggggtctggcaaatgatcagtcccttttcctttgataaccctccctctacttcctcagctgctcatggatgattcatcccctataaatctcctttcttctctatgtccctctccctgacacaagaccttctaaaatcctaccagagtcactgagctcacatagcttcagtaatcggctgcctccattaaaattaaggacagtgtcttagagtaggctgggaaggggtggaacccacgtccttgggaggtgatagtctttagatgggaagatccttgggaggccccgtgctgattgggagcatggccttgggactcaggctgtctgggcttgagccctagctttgcctcttgccttttgttgaccttggacaaatcatttagcttttctgggcctcagtgttctcacctgtaaagtggggagaaggctagtacctgtcttatagcattgagaattaaaagtaatcatctatgggcacctagctcagcgactgttatacaggaagtcattactaagcattaacttttgctaataccactacctgaccttgggtagcactttataaaatgcttccccgagttcaccttcaaccatcccagttcttgagctggactttgaaccaaggcctctggctgcaagtccagtgttcttcccactatgcagaactaggtgtctgtgaatcttttccccatcatcatctaaatgccaggctccatccccaggtgtgacccacttcctctgctcaggggtcctgcctccttggcactggtcgtcagtaaccaccaggctgcaggctatggcctcctccctttgagaaaacacatcagcatgcaagagggtgggaatgacataaggataggcctaaccttaagtccatgcaattgaagaagatgaagagaaggaaaaaccccacatcatctacattctttagtacataagctgtcctcagtcacattcgcttcttcattcaataggtctttactgagtgcttactctgtaccggccactcactgttctagatgctggggacagaacaatgaatgaaacaaagatccctgccatgcggcggttccattctagtggaggcagacaataacacatttaaaaacaaccataataaataactgacagagcctgttagaacttgagaaataccctggcaaaaaatggagcagagtaagggtgattgggaatgggggcattgaagagttgacatttttaaaaaggggagttggtcagtcccggccctctgaggaggaacacttgagccaagacttgaaagaggcacagaagctggccagacaaatatctggagaagagcattccaggcagaggtaacagcaggtgcaaaggccctgaggcaggggcccacctgagatgtttgggaagccgggaagaggacagtgtgactgaatggaggttgtgttgggagataaggtaacagggagtagatcacctggggtctggtagccatagtaaggatttggctttggcctcagcctctttatagaatgatacattgtaaagatctttctgtaatggcaggtaaagagtcttctcattttgttcagctgcatactattccactgtatgtgtgcactatgttttaataactaggtttttaaaaactgcctttaaatcatagaaacatttaagctgtttccaatcttttgctgtttccaaaaaaatgctgcagtgaatggcgttgcacatataccattttcatttgggtaagtctatctataggacaaatttctggaagtggaattgctgggtagaagaatatatgaagagataatttttatagacagggccagattggccttcataaggactgtattaattgatgctcccagacagtgatttggctagggatgaggaggagaatctatccgcccacctcctttaatatgcaccccccaatatgtgagatactgttaggtacccataatttcttgtactcctcatgactctcctgtgacctgagttctcttgttcctatttcacagatgaagaaacaagcacagagaggttaagtaacttactgatgcttacacagccaggtaggggtagagcttggattctgacacccaccatttctcagcataacatttctcaccatttctgacaagggtaggagtcctgaggagccctgccctgctgccccatgcagttggggtttgagaacctagggaataggaactgagttaaagtgggaagcctgcctgtccagctctgcccaatgctgtgcctgtgtcctggagacccttgcaggccagtgatgggggaggggagaggccagcccaagggatctggagccacagtggctgaactggccagccccagccttctccctgtcccctccctctgccagccccagtggagaggcctgagaggctgcggactagctaattctgctctggttgaggagctgcctgccgctgtctgccgggtcagcttgctccagggattaagtttcagcatttcactgatgaaaataaatcagcctcttgattgccctgcatggccctgggaacctctgcagcctggtgtgtgtttacagacttcctgtaagtccccttttctgtcctagcctcagggactccatggctgctgcagaaatagcctcagacaagtttggagcctgaagccacccgggcaggtccaagcaggagaggagatacaggcctgccaagtccaggggctctgggatccaaacagtgcctggtagagcatcttctctgagttgtatccttgaggatccagatccaaacaggactttagggatcacctatacttgccctctgccattgcacagtggagtaaactgaggcctgtccaaaatcaccccttagaattctggctctttggctcctagtctgctgctgcagccaggcagcattttctttaggtctgtttgttacaccgtggctggttagagatctaggggcagagttggagaggtgagttttagctgctgctggaaggatggaggtctgacattcaggagaaccctcttgcctttgggggatctgagtaacaggaacaggtgccaggactagattttctagattttctgaaagttgaggagaagaacctttccactccacgcatctgtctaggtaggatgagtgaccatggcttgtggacatgggaaaacaaggcaacttctagagggttctgacaaggtcctagctcattcttgtgcaaaggggactcaggagtctcaccccaaagtcccttttctcctgcccctctttctttgctcaagcattatttacactcacaagactatccctcagggacctggggtgtcctgcctcagacactcctggctccagaatactggacctcagttgttcaatccctgggccatttatctccctgtgccctgggaagcagcaacagagctgttgatggatgtggggagcttcagactgcccaatctttacatctttacagccagtcgatgccctggctgcttatctgggacttatgcctttgattgcttaaaaaaattgttagcagcaaagtgttctttgatgtgtgttcttctccttctccaggggcagtgagatcagattttgatatgaaagctcaaagcttctcagctctctccttcttccctgccttcctctctctgtctgcacattgcttgagaaccttcgagaagcagatgggcgctcctcatgtgatgcaaaggcagaaaggcccaagggtggtgccctggcttctgtctgccatgcaggcctgtgcttcatggtttggtggcctctgcataagtgagtcactttcagcctagccctagatgggcttatttggggaaggaagcagatacccacccagatcctccacccacctctgcacctactcatgcatgtaaccacatggactcctgtactcatagccacctctcatgcatggagccacagggaccccttgactcatagtcacctctcacacatggaaccacatggacccctctgctcacaaccacctctcatgcatggaaccacatggatccctctagtcatagccacctctcatgcatggaagcacatggacccctgtagtcatagccacctctcatgcatggaaccacatgggctcctctgcacacacccacctctctgcatggaaccacatggatctctgccccactgcgtaccccaactctgccccactgcgtacagtattgggagctgtaattataaaactgcccagccagtttgataacccaacttatatgtggatgctgagagaatgggcctgtttgggatcaggaatagtgattgacctcacttgcagagatggtttcattcgtgtgaattataaaccagccctgaggcagtgttctacttgtttccagaaatgctttgagctctggtagcattgtgaggataaatgcataaaattcccagggaaccagtttgatggggacagtgctcacttgcctgctggagtttgttataaaccagcattgtgactttattgtcactctccactccttttttcttgttggatcttctaagatctaaacctttgcctcctccatctcctttcttgtttctccttcctttctgggaagcagaaagagcatgaatgtcagagtcagactggcaatgtaatcctgagcaagctccaacccctgagccttagtttctttatcaggaagatggcataacaatatccactttgaaaggcagttgtggaaccaagcaagggaacttccattaacgtgcaggcacatactcaataacatgcctgcctcattccattctaccctctccttcgcccttgctcccaaagccccatataccctctccccattcagtgaggactgccactgacatggtgtccacgtcctgggagcagtaagggtggggagaagcagaagcgcggtgagtggatatgtcccgaccctcatccaacacaaacatctgcctgggagttgacaattcccttcctgagtaatcctctggcactagggctcctgtcctgttcttagggaacatgctcctgggcctggccctgcccactgccttcctgggatgggaagtgtgaagaccctggaaggctgaggccctgccaggggtgcctgaagcttgtcctgctccgatggccctgtcttccctgtccactgggctgggaggcagggaggaggtcctggggaggtctaaggacatgttttcatcacatatgcagctgctgtgcccaccccaggcagcgggcccttcctccctctatccccagacgtttgaaccttgacaccatgcctatcttgggagaccccttccttctcctgtcctgactgctccctccagccatgtctttctcttccttgatggctgtccatagaaccagaagttttagagttcaaagcttatctcctcccactcattttaccacgttggaaactgagtcccaggaaaaggaaatcacttgcccaagtttaagcagtgaagtagtggcccagatggggttgaaacccaagactcttgagtcttagttcggagatcggtctattacaccccaggctccttcatccctcagtctagctcagggcctctcacctgtggtactattggcatttgggaccaatacaattgcttgggaccaccacaacaattgcttgttgtgggggtctgtcctgtgtattgtaggatgtttagcagcatctttggcctgtacccactagacaccagtagtatttcctccaggtgtgataaccccaaatatctgcagtattgtcacacattccctggggggccctggctacctgggggtgctcctctttcctctaacctctcatctttgtgatctcacctgtcccacctgcagggtgtgaagtagtctttcactggagacactctgttctgtttcctccttctgttctgggacccggctgcttggaaaccaaagcactcagccattctgttctttacgaggaagaacaaagagccaggccaggaatgttgctttatacctacgaatgaaaagaaagaacttgacaggaagggactaagccttggagggggtgaccagggaggctgggcccccttcctccctggagagacccctcagtgtgggtgaggggccctggccacctggctccagctgtaggtctgctggctggaaggatggtctggagggaatgggggcatttgcttgacctacagttgggaagtgtgtcttcattgtagaattgtccaccaatatcctactttcctcgcacagctagacctgcagacatttgtggttcttctgtaatgagagttcacagtctctgagcacccatctcatggcatctgactgagatctggcagtggggaggactccctctgagagccaggggccctggtggcaatctcactccagcactgaccatgtgtgacagtgggaaactcttcccttcgctgacttggacagatgaaatcgggtgggtgggttgggcccaatgaactcacaacatcctctggcttgaccatgcggggattctaggaaattgcctgggctgactgcccacagtgcggtgccatgtggcaaatctggggtcttgaagaatccttggcacctgagaagtttccagaaggtatccagacccaccctcctacctctagaacttgtgttttatgaaactgccctgctcagggccacctcagggggtacaggggatactgggctgcctctgaagacagagtaataccatcatctttcaagcttagtttaacccacccactattgggaaagacttttctcctgctatttcctgtagtttgttttaagaaaaaaaattgtctttttttttcccccaaatagaaacatggtaagacgaagtgtattcttttttgaaccagatttgccatgccctgccctctgcccaagcccccaggaagtcctttcctatttatgcatgcagctgaggttgtgcccgtccttctctccttgtggtccttgaggctgaattcatctctgcaggtggaagtggcaatgcattttcaggcacaccattggcagtaatcagtgttgggataggctcagtatttgttaatggaatggcatcacatccttgtagtctgcaccattttggaagcctcttctctatgctggccattccaggccatgatttttgagcagagatcgggtgggccaaattgtatgtcctgaagcttaagcactgggtgtgatacatatgggctggtgagatagggtcacagaggtactgctcagggggcacagggctagggaagggagacggggaagcccacgctgcactactcgtgttctgtcctttggagcacttctgtgttctgtacactgtgctgagagcttttcatgtgttatatcagtctttgcactacttactgagatacaatgactagtatacccattttacagataaggaaactgaagctcagccaagtaattggctcagggttgccttaagctagtagttggtagtatctgtattcaaaccaatgtctgacttccaagtccatgttcttaacctggcagatgctgaagtgatgagaatgagaagggccaggcataatcttaggctgcattaacaaaagcatggtttccagaaaatgggaggtgacaggcctgttgtgcctcttttaagtcagagcgcccacatgggctgtttgtgggtcccttgcttcaaagtgataaagaacgactggaagcaagtgcagagaagcaaccagaaagtatgtcaggctcagggacttgcagggagaggggttgcctgtcaaaggggagattcaggagggcaggcacgtctcattcagtatctgaagggctctagcgagggggcgattggcttgttctgacccactccatcgggcactgtaaggccagttagtggaaaagagggctccagggtgttttttcctatgttgagctaaaatccactgttacggccccctaaagatgagctgggcttttggaggaagacagtaaaatccctgtacctggaagaatttgagtacagctaggaacagtttttgccaaacctgactctcttattatttgcagctggggagcattttcaaattcaaagtcccaggccccattccagacagttttgcctctgtgtggagccaggggatcggggttcttataaaactccctgggggctttctagtatagctagtccccctggatgatagtggagaaccatcagatggggttgccactggcaggaactattgtgtggtagtgttttccaaagtaaggttcaggttccaaagtatggtcagactgctaattatatatgaactgatattaggtatatttattttgatgtgtattggaaaaaaaggtatgtattttgcacattcaatctgggacatcatggatattgtgcttagaactagtttaagttaaatgaagtttatttttataacttacaaaataataatgtagatgatattcagatggacaaataaacatgaaggttgcgtgcaaacaaaatctctgctaatactgttgtgggttggttggggtggggacaagtgggtgaactggggtgccttaaacctttcaagagcccgaggtttgttggttagttctagaagactctatggaggtaggaggataattgcaatagtttgtccaaactgtggtcttccccaggtggagcctgaggcatagaacccctctgcttcccctcccctggtctccttatttttagtggtctctttgaagtctgtgacaccgagctgtcccattttatctcatcagtgaagataggtcagtggccagggtacagggcactgggtaccatttttgttcttccccttattttctttctttaccctcaaagaacagcagccagagaggggtgctgaaaatggcgaggggctgagggctcaggtgtctgaggggaaacacagggagtagttgggctgtgcctggcagggctttccctcccaatctcgctgtaccaaacttagctgggaaggtctgggcacgaggatggggtagccatagctcagggcaagcctgtgtctgtggaagcattttggggttgcaaactaactggggccctctgcatggagacaccagtcgctgaagctcccactggcctggccgcaaagcccagatcacctcctgtccactctgagaattgggttgggagattcaattgatatgcaaataagtcacaaacaacatgttaataagagtggggatttggtgtcttattatcagttagggactcctggcactttccagggcacatcaggataatggtgggaacttgagggccgttcacctgcctttcagctgcatggctctcggatctgggtggttgggaacgagggtgaggcattgcgaactctgaaaagtgatactctgctattcatgatttccacagatgggaacaaacagaataccaatagccagtcaattggaagcatctcaggtggcctggaggatcaatatacctggccagacacacactggccttcccaaagttaggccctccaaaatgtcaagttgccaagccagaatccaaagctttgcactgagaacttcatgttggggctcctgtcccctcctggagccctgcctgggtgacaccccagtccttctattcaggtcctgtgttcacctctgggaagtgcaggaccctgtggggttttttctttttccttttccaagccaaggaagtgttctggctcctggactctgccctgtggaggggaaagggggagagagagggaaaaaaagatttccaccttattgttcagcagctggaaaattgttgtcatctgttctgccttccatttgctgagaatggaaaaaaaatgtggaaaatttggggaaataaatctcaataccctcataggacctctctcccctccctctctggcccttgcatccctgcctttccgcttggggctcagtttcactttgctcccagattctctccctgcttctcttcagggcactggggctgccatgggtttgggactggggctgggctgggctacactgggactgggctgggctggactgggacccggtggggctgggctgggctgtgctgggaccaggctgggctagactgtgctgggtgagagttgagcaggggctggggctggggctggggctgggctggggttggggctggagttggactgggctggccacttttcctgactcccggccggtgggagtgaagggcttgggaagccaccgtgatgtcattcaagaacggcatagctgcaggatgataagtgaagccctggggacccagctggctgaaattacagacagttttatcccactggcttcctacaagccagagtgaggcagagcaagctgagctggggagagagcgtgcaggagagtggagggagggagggagtggggtgtgtgtgtgtgtgtgtgtgtgtgtgtgtacatgggcaggcaggcggcactggctcctcccacccctgacagtcggagggagcttgagtaggacacagacagcacttggagctgcagccatgtaggaattattgggaacttggggcaccaggatcaaatcagagcgggcttccctccgcttcctccctctccctccctccctccagagggtaagtgtctgctgggcagttgttttgcctgtgagtgttcttgtgtggctttctgctggatctgggctggggtgctcgtgcttctgtgctgggagggtgtggaggggcaggctctgtcacgaccccaccttggaagggcttgtggctgagtggggctgtggcccgctgtgctgctgtctgatgtggatgtgacgggcctggtggtccccttcctggacttgcttctgggacacgtaagagccatagctttcagggcgagggtatctgggttggtgggggggccgtgtgtctgagttgtcctaagtcttgtgggggtaacggttcgtcttgtgcgcgaatggggttggcagagggaatgaggtggatgcatggatagctctggtgagatgttattcaggacgccccctccctgcatctttggcctgagctttggggcacctccagtgctcaccattccccaccggcctcctgtgggctcccattcacggctttctcctgactttggcagagattttggcagcttgactctcctctagccagggatctctgagtgcccaggctggcaccctggcctggcagagaaggacttcagcttgttgtgggctctggagctatttttaccatcctgagtgtgcctgtgatatctgctgcccgtataggctgagggtaggggtgggagtgccaggctcgggttatagcttcaggctggggggaacacaggccaggccggagtcaggaggctgggtctgagaattcacatttgccctgcaggcgtgggccatccagggcagggcagatcacttgccctccaggcccctggtctctcgggactgaagtcaaggtcacgatcaggttttctgctcctactccctttttatggagggcatggtatgaattcaagtaagaagatacctgggacaattgccacgggtccttcctaaggagggtccggggacacatttatcatcatcgcttgacagaagcaccatatattatgttgtcctgtggttctgggtccacagacatagttggagagtccaccttccaatgcctccagccccagccatcttcaccttgaagcagcattagggacaagagcactgaatagggagccaggagttggttttgtacttccttgccgggtgaccttgggtggtcctgagcctgctgagcttcattgtcagcctataaagtgaggggtgggcagggggattaactactcccctaaggcccttcagctctaaaagccccagggcttttaaaaagctctcttggctgagccaacctcccgggccctggagatcccagttctgctgtcccccagagggcctggagcagcagaggcagccgtgggtgggaggggctctattttttatttcattctgaagctgactttctccatcttcaaggccacaggctgacattgagatttgggctccgtgtgggtcttggaccttgagcctccctctttttttcttggactcagcagaatgggaaggtggccaggagaagcccagctggtccaccctccctgggtccagaggcaagcttgtaggtgacactggtgaggtcacttgcttagaggacaaagccacctgcgacaagactgacagcacagccctgagaaaaatcttgttctctcctgttcactttctgaaggtgtgtgctattaaatggaaagaaaaacaggtgtctatttgtcactcatggactggtctgtccctgcccacagggttccaaggccctgtgcttgttgtgggctctggagctatttttaccaaaaaatctttggtaattttttttaccaaaaaatctttttacgtgttcccaacgtgcacctaagtctcctgggctgcacttggcacctgccctctttgctgtttcagaggctgtgtctcctctgtgtggctctccttcagaggttccgggatttctcttcaacctctaattctgcagatcttcagagcccctgcagaagcccattccccttgagaaagttccagagctcgctgcaggctgtggggaacaaagggctgcctcaatccccagctgtctgtgggaagggaagctggcatgggtggaggccaagactgtcacagactgagccccaggaagtccctgccaccaatgccaggatgtttcaggaggtcggggtcttcctggagccacatgctggggttctccacggggccctctgtaccctcatgccttcctcacatcacttcccctggcaggttaaaacccagtggagcaccctgagccacttcttaggctcccgcagccgcaaagcttccactcagtgtgccgccccatttcccctggatggagcctggcattctccatgcaagtcatgggtgacagagaggatccccagagacagcaccctaacttttcgatgcatatgttgtatcttgggatccacagatggtttttggggtgttcatcaactcccttatttcaccagatctcccaggggtcctgggtctagggaagttaatgtccactgggctggagtgtagctggagaggtctgtaggggatgccatggggtaggctctggctcagggacctccaccatgctcagcctttgctgcagaatatgaggaatacatgtcttcatgtttcggctgcactgactctcttccctcacctttggggagaaactcggggtccacctagaacccctgatttttcactgggtggtggtgaaagaagagtatctcaatggctgacagaactacataaagctttctcggctactcggtgtaaggcaagaagcatttatggaacaagcactcttctctagggccattctgtacagccatgcaggttacatattgaacttcaagaggcatcattcacacagaccacattgtggatggcaccgtctgggaaccggccctagggagagggagagagagagagagagagagagataaaggctcttcctcaacaagctctcagcaaagtgggaagacagacatggacatcagtaatgaccattctgtgggtgactgttgtcacagtagagatgtctacaagggacaacaggagcaccgtagaggtttacctgagtctggaggacagtagggaagaagttagattaagggaaatttcccagggaagtttgaactgagtctgaaagcatttgcccaggaggttgggagtttcacgggcaggatgaggaagggcattgcacggaaggaacagcatgcacagaggggaaagagcatatgaagagttgagtaggagtagagtggagggtgttctgggtatggaggacaaggaagtgaggcttcagaaggtaggcagaggcctgttgggaaaaggtctgacatttccagcgtgggggttgggctttaccctgtgggtgatgagagctgttgaaatgtaaagcaggggatggagagaggaaaagtagagagtgcttggatatgccaggtctagcttaagagccttagctcctgagtgctatcactcagcaaagctgcacacacactctcgaatcctcacctgacaggcctgcaggccgggctctgagtgggtaagtggtcaatgcaagctgatatggccattaagatggcagctatgtttctgagtgctggtgtgtctggctgccgaggtggggtgggaaggcgcacttccctgtctcctctccagagccatcccttgtggccttcctggacccagccctccctcctgtcctggtgcctgccccagccatagcctctcctgcctcttcccatggctggggcagagtgtgtggataagggaaaatgcaaccagaacttgctctctgggcaggctcttggccaagcttcacttctcatcaaagctcacctacctctcagatgcacgtggccttggattccccactcctccttttaaggagttttgcccagtctgcctccaaacagcctatgtctggggtaggcacggtgcttcttcctattgtcatggcactgattttcccccacgttgggtggtcatcacggctctgggtaatgcattttaatgaattgttatttgctggacttggacccaaaggactttttatcatgaagggactcatcctgaaaaccttagtaactcattcgctattcaaaacctacctgctggtccgacagggaagggtctgtcttcactgagtcattgccaatgaaggtgactcctttcttgcagtcaatatggctggcaccttttattcttcatggttgggccgtctgtcctaacatctaaataagcaaaacctccctacttttcatgaggaagagaagtggggtttcttgatctcagagcccaaagtgctgatcagctggggcgggtttctctagatgtcctccagccatgtgtgtgccaggacccctggagagctggcaaaaatgcagattcctggccccaccccaggcctctgagtggaagtccctggggatagggtcctgaaatctagatttttaacaatctccagaggaggttcttgtgaacatcagaattagaaaacagctgccctgaaaccgtgtgactttaacatcccctatttgtttccttcgttcttttttaagtgtgtgagatggctgcatccttactttcctgcatcccagcctgagctgcatggctagtgccgcacacacctctgcacccttttctgggagggagccccggggagtgggtgcacaccctagtcagctggggattttcctcagagctttccaaaagcatgactcgtgcatctggattatggctgccctggaataaaggccccgtggtgcaatcaagctcagcatcgagggtggagtctggaactctctgcagctgctgagaagagcagggagacatcctcagacaaagacagtggggccatggagagattttgggttttgcaaccaccaagaggaatgggcaggacactggacctttcagcccacaagagcagatgtccaggctggctgggcttggggcctggagctctccacttggggctgcctgcagcttgtgtttctgcttcagtttatcccactccattgtcacccgtgacaatgcccacagcccccaaacatgcagacccctccctctagcccatgccccattgttctggatgtccagcctcctctcatctgagatgcattcccctgaactgatcactccctttgtggctgctgggacttcaagaggatggctctggagacccctcagattaagagctgtaaagccacctccccagcctcccttaagtccctctcttatcctcctctaccttatttcactcctgtcctctctgcccccgtctctcttttgcccttcctgccttgatggattgaaaccaacattgtgttccggcttcttgtggtcccggtaaaaagctctaatgtggccgtggtggatggtgagaagggaatgatgagagtgtgtgtgccggagtgggggctgggggacttttgtcttgtctctggtgggaggaggaggggcacgtgctccacagatcctgctgctatgctggggtttcagcagagtcctcatcagggctggacaggcctgggatcagcctgggtattctcaaaacctcccttggataggaagaggacaactcagcaaaggtgctgagtggcctggagggtgcaatctggggccaagagacatttccatttgtagttagcgaacaggagttaattaaacaatttgcatctgttcgattttcttactatgccttagtggcttggctatgattgttcctgatgttgttgctgcaaacaggagcccacttggggatagattacatgacagaacaagtttaacattgacattttcaaaatcgatgctgagtggggcttggccacaggggcaaggaagggctgagatatcaggtagtcaattctctctcctgcctgggggatgccttcatagtttttctgttagtcatgactgagatgctgcaggggcctatgtgctttctgatttgaatttgcccccatggctctcactgtggaacatgtctaagtggggaagccactggacacaccagcctttgctttgcagctccccacttctcagaccacatgagcatgaacgtgggggatgaggaggcacaaaggatggaggggatcactggcccaggagggaaattctggcacctcacagtgtaggtggcagagggggtgccctggctcaggagggggcctgcagctttctagggacagtgagaaggaaagccagctcttcagatttcggccaacttgtccaaggggccccatcctcaagagaaccaccccagagctatgagtgcatcagaggctcctgtcttcagtgctttgccccctagaaacaggcggctggggtctcttctttttttttgagatggagtcttgctctgtcacccaggctggagtgcaatggtgcgatctcggctcactgcaacctctgcctcccaggttcaagtgattcttctgcctcagcctcccgagtagctgggattacaggcatgtgctaccacgcctggctaattttttgtatttttagtagaggtggggtttcaccattttggccaggctggtcttcaactcctgacctcaggtgatccacctgcctcagcctcccagagtgctgggattacaggcatgagtcaccatgccaggctgaggtctcttcttttatgtgtagcaaggagctcagttctttggagagagtgggcatgaaggtcagcctccctcatcctacagggagaggacccctttacgatgataatagggggttggaagaggcagctgtgcctggtcctgcatcttagcagcctttaggggtctaggcacagggccaggttggtggagattcagaatgtattttagccaaaaccccttttcagttcagaccagccctgggccctgggccctgggctgctgcaatactttggtcctgtgttgtctggggctggtgttggctgaggtcccaaagccttggggaaaactgggggcagaggggtggatctggagaggtcagtaaatgaggagggcatccagtccctggggtgtgtgtgtgtgtgtgtgtgtgtgtgtgtgtgtagagggatgcaagtgcctggtggagcatctttgtgccagttctctgtgttgtaacatggctggcctgtggtctgtgtgtgtgtatgttgattgggatgttcctgttttgtggttgtctgatcacttgtttttggccatgggcttctgtcagagtgtttatttttagaggctgccacttctggcctaagggctgatccttgggcatggtaggaacatttgtattttctgaaatatttgtggctttaagtatttatttgggggtattcctgcctgttatgtgtttattctaatttgtgtgtatgtgtgtgtgtgtgtgtttgtgatatgagggaggtgtagcataataaaaattacatactgtttgaaggaaattagctctgattttaaatcttggctttatcaggtagcattgttggcacataaatggtttcccctctcagaggctcagtttctcccttactgtgatgggtgtaatactgtctggctcggaggcgatggctagagaggatgtgcgtgtagagtgcctggcgaagtgttggcgtttgcgctgtgctcactgcacggtggtcactgttgttggtatttgtgtgtacatgttcatgccggtgctgtctgactgtggttcttggcattgtgtggcacctagtgtgtgctcatgcctgggtgtttctgatttgggtgatctcttactgtctttttgtctggctcggtgtgtgactgctggtgtctggctggagctggtgcagtctttgggagctggcttttttccttgctaacggagagcctggattagagtaaggggaggtgcgtgcgtgcgtgtgtgtgtgtgtgtgtgtgtgtgtgtgtgtgtgtgtgtgtctgtcggggctggtggctgggctgctgactgtacagggtgtgaaatcactgagttcctctgggcggggaagttcttcattcctgagtcagccctttggccccgagccacccagcgctcactttttccttccagagaaagtgttgctcaggggggtcctcagagctgtctgcagacaagaggaccctctcccccatgaagacatcttgtttttgtgttcacgatccctaagacgcttcccctcctgccctagtccctgaaccccctgcatcagcaccctatatgccccccatcctccagcataggaaaagcgtgtcccctctggcacagggactgttggcttggctgagccccaccttggcctgttcttcaggggcccccgggctggctcagagcagtgggatcaggatgctcgtctttgcagacctgctgtgatcctgcccggcataccttcccaggacccgcgtccctttcctggagtcttgagtggtatgggctgagcttgctggtggaggggtaggggtccatcaggagtgggcagtgctggggaggagctgggaggagcctctggaaatgtggcagtgggcagcatgaatgacattgtatctctgaatggttctatcacatcctttgcattgagctggagacaaatctagctgagggcaagcttgtcttagagagtcccagctctgccttcagcctccctgccaccaccaccttgggcatggtggggccctttgctgcaccctactgccctcctgggttctccccctgcttccgtgggcaaaggctatcctcggggcgactggccgtccatgctgatacctctatgggcattcaaggcaatggctactctcctggcattctgcctctaatccagagtgggaactccagacatcgaagcaggggtgagactttttgagatggggtggcggaggggactgaggatgctttggaaatggtcattcaggaattaatgatactcataatggtgatggttagggctcccagctgttgaactcccatcacgtgccaggaactggtctcagcatgtcatgtgtcaactcatttaaactcaaagcacagtgtatttaatgaatattggcaatttcagatggttcaaccagattctattattatccccattttatggaccaggaggctggctcagagagttattcatgcctctggtcaggaagctggtgaaatgccagagctaggcttgggactggagcgatttgcccccagcacttcctgctcagtgttgggctccactgcccggccctgaagctgagtgttggtgaggctctgccccaaagcctggggtagaggtctttctgtcagctccccttttccccacctcagggtggtgagaggaggttttaggatgcagggcatgggagctcttagcttctttctctggcagagtggatgatacccctgcctcccgctaatgtctgttgtctgttgtctcccctccggctctgtcccttgcagaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggtaagaggtattcagtcctgactccttctaccccttccttatttggtcttgctggggggaggtgcaggtccagccatgacccctaagcagatgttgctttcactggtgggaggaggctctcaggagcctatatgctagccagttatcccttcctgcattcattgtctgataggcaccaagccagacaccaagtttcaaagttcaatgtcaagcaattcctgccctcaagaaatttacagtctagtgagcggacagatacacagacagatgatttcattagagagtaatgtgtacggtgacagaggtgggaccaagatcccagagcctgggaaagcaaagcttaccacctagggcagtcagggaaagcttccaggaggtggtgactttggggttggagtacagactttctagacacagaggagactctgcaattgcctgtcgtgctgtctgtcctcagactttagttccttgggggagacgtggagaaggctggagggaggcctttgtagactcaaattccctcttaggtcccgctcctagaggccatgaaagagtccgagagggtatcctcaagcccttaggctctatctgctggggcggggaggccaaggttccccttctaagtcagttttcctgttagtctttgctgaggaccagccctgtatgggaagtaggtgctgagagacaaagctccttttcctatcagagagtgggcttctcttttgggagagaggaaagtgggacactcagaagagcttttggggagacaaaggcaagaaatgacagcatgtctggggccatgttgggagagacagctgcgaggttcccttcccactggtctaagcctatgcccattccacaagggtggctgaacttggcaggaaaacctgttgggtgactttattctggaggtggagcccagacaggggtggaccagagactgtggatttgggtggaccttgtgccagcccctcagctgacagggtggtgggagctcagcgaggaggagaggagcctgggcagctgtctctgtcctccaccccttttcctaaatttaggggaagctgagtcaccatgccagctgcagggagggaaggaaacaccctccctggagatggaccgtgggtttagggaagcagcttggggcaggccagctggctcaggacctggtgtggggacacaggctccctgctcctatacttcagagcagagcagagtccccagctccactattggtataatagcttgaaattggccattgcaggagtatttacaccatggaaattggcaatcagcctcacctcccatagagagctggcctagcagtaacaattccttttacctgagcatcggaacaaaggatgggcagttcttaacctcggatgaaacgctccatgggtggtccatatgggctttgacttctgccttctcccacatctgggcccctgagataaagatacccccctggctttgtcagcagagatccttttcttcttggtttttttgaggtgagagggatggggctttctgaattccctgggaatttaattcctctcccaatattttgcaaggttggagtggtggcctaaagattagtgacacgctagtctaatgaggggcaggatccaggagccttctctctgggggagcagaatacatttcctcccctacaagaacccttccatgcagctctcctggagcttgctcaagaggaggccataaccctaatggccctgggaggatgcccatcttgtagtggactgccttttagccctttctctcctaccagctttcgaaggcttgactgtcaacttccatattctgtagcctctcaggctttggctgccatgaagtcatagatagggaaggatactgttggcacaatgttcccattccctaaccctgttgccatttcctccatcaactgggagtgactcaagagaagggatgaaatgtatagaggggacacttatatttggctcccaggtctatgaagttgcctctttggttcaagccctgtcattatgacagaatttatgtcagcaggtcctgcatgagtaacttccttagtagcctttcagggtatctgcagtgcctgtgtagataaaggcagacagacaagatcaatgtgtggaaaagtctgggaggcagggaagatagatttcagcactacttctttctgctctgtctacatctctgccgtaagaagctggaacatacactttgacatgagtaacctaggaagctcagatctgtgggagaacctcttcatggccatgaacttgatctggtttctcctggctttcctcccccaggtctgccttttccccattggctgtcctccatacctcagtctcaagtccctggtttattccactttgatccaatcacccttgtgccttattccagcttaagttgtagaggagaaggtaggggcagttttctaatttgataaagggtagggaccagaaatttatagcatacatcacactttcctgtggagcattggaagcgttcctattagagccagggacaaaataaggatgtctgttatcaccacttgcatctaacattgtattggatgtcctagccagtgcaataagacaagaaaaagaaataagagtcagagttggagagtccaactgagttatcttatgtccctgattctgtggctggactgatctcagatgtctctagaggtggagatttcaatacatgttggaaatcagatatggatcttatccttaaggagtctagagtttaatagggggaaaaaagaactggaactttaaaatagtcttttgtaataagagagataaggagaaagctctgcaggagagaggtgaagcgattgctgtcagctagtgatggggaaggcagtgttaagtgtggttttaaactgagccttggaagatggaataggattttgaaagtaaacgggatcactgggcagagagggttcacagtgaagacaggagagcacagaaaatgtttggagaatggcaagtagattgagaacatatggtctgtgtgagtgacagtcgggataggtagcctggggtctgtctctggatgatcttaaataccggactaaggagcttgcatcttacctggcagcaatgtaggaagccattcctgtggtttcatggggggaacatgccatgaccagagctgaggttcaggatgatgtgtctggtgggtctgggcaggaaggacaataaatgggagagactttgagccaggagatgataggagcttattagatagcctaagtggtgcggggctggattagggtgctgaccataggaatgcaaatgaagagatgatgcagtggatactgtgggggtagaaccaatgcacttatgtgttgattggctggagcggatgagggagaaggatcatcaaaaatgattctgagctccatgaatagaaatagaatgatggttctgttaacaagcaggaaggcaggaggaggacgttgggtggaagatgaagccttggtgttagacatgttgagtttgaggggagagtggagcctccagggagagacatatggaaggcagctgaactttggaattgagtgtgaaagaaaaggaagagctacaggttttggaatcattctcacaaaggtgatggttaaagctttgggtgtatgtgagatctcaatgtcagagggcttggagagaaaagaacttaggatggaatggccatgaagggaggtagaggctgtaaaggggctgagagtgagtgttcgggtggtggcaggagaccaggacagcatgtcatcatagaagtcaagatggtaaagggtttcaaggaggaagggcaggagattagcagtgtcagcctgaagagatcatgaggaggactgagaaaaatccactgggcttgcaaattaggcagccctgtgtaaaacatcaaaggcatatttttagtgcgtgttggtgacagaaaccagactgtgggggattgaggatgagtggagaaggagtgaagacagcaagccaagtactcttttcagtggttttgtgataagagaggagagagtggtagctaaagaggatagtgagtgattgggaacttttttgtaaatataagagtcatgagaatgtttgtatgtagaagaggaggggagtaggttggacatggggggaggaaggatgagaaaaagaagagaaagaaagaagttgatagaataaggtctctaaggaggtaagaggggacaggcctaggagcccatgtaggtaaattaggctcaaccaggaggtgagatacctcttcatgaaattagaataaaggatagataaagatagagggaaatattgatgtcaagctttgggagcttgaagtgaaaactcttgtgtttttttttttttacattttgttctgaaaataggagatgagttgaaggctcattcaatcattcgattcaacatgaacttctaatgggtgctgcttgccagtctaggctttgtgaaaatggtggcaaataaagatccttgcccttacagcagagatggatactgagcaaataagcacatatacataggatatgtcagataggtgatacgtgccattgagataaagcagtgagaggtagggggtggctggctgcactttacatgggatgatcagggctgggcagcgagagatgagccccatggagcaacaagtgcagaggccccgaggcaggagtgtgcctggcatggctggagtagagtgatcaagggaggcatagcaggacacaagttcagagaggaaatgggaacagggacagcttacagagggtctttgaggtgattgtaagaatggtggcttttactccgtgtggcatgagaagccttaggaaggatttgggcccaagagtgacatcatctgacttgttctgaattgaccagggtgggcaggatggaaggagggagagcagttaggtggctgctgctattgatctgggcagtggccatggaaaggggagaagtgctcggattttagacatattttggaggtagagccaacaagattactgatagattacacatggaatgagagagaaagagaaaagtcagagacaacgcttaggtctggggcctgagcaactaaagaatggagttgctctttattgagatgggtaacaatttatgaagagcagtttcaggggaacactagaaacatgacttttggacacattaagtttgagatgaccatgaaacatctgcagtggttggataaatgagtcaggagtttaaggagaagaggctggaacttagagatatgggaattgttgacgtgtacataccagattaagcatagcactgggcaatgtcaccgaggggttgaggacaggtaaggagaggtcccaaggatggagtcctggaacctcccacattccaaggctacagacaggaggagggaaccagcataggaactggcatggagcagcttgtgaaggagaggaaaggtaacatagcttgaactctgggggccagggcaggggcaatgttggccactcctgtggcccctgtggtgtgaaggtgggttagaagtcaacaaggggcaaggaaaggataacatagcaggtccttctagtgcatctgagaaggttcatcttaaggacttttctggtgatgaccagaagctgggggccagagcagaaaagcacaaggggttccccaggaaagaggatcactcagatggctgtggtaaggagccagggtgtgagagagggtgacccttgggctcaggctgggtgtgttacctgggtccagggagaggcaggtgcccaggaaaagatgggtggtccagggacaggcctgctgcctatgggagcaggtgagggatgcgtgaattctcctggtcccacgatggcacctctgcttccaccctggggttagaagagagggaaacgctgtggtgctggccagcaggaggtccatctgcctcttggagaagcaggaccttggatccccctctcttcctgtctgataccttccccacctccctccagtgtgtgcccagataccagagtcagaacaccaactaatcttgattttctctttgtttttgttgtgttttgtcctgtttaatgccccgtcccctgcactctctgtgtttcccatgtccatctgttccctgtgctgttggtggggtgcctgccttgccccatatcctcccttccttcctgcctcccactccctgctggctcccctggggtggggggtgggcagcgtacaacgccaggctgcagggcatcggacacagtggcagcttcccgccccctcctctccaccggctccaatcttcctccctctctggtgggtggctctccttcccccttctccctttccagctctttggcccacttttgagcatcagtttcttttcactccttcttcatgtgctattccttccaaatctttcccaccttcttccttctctcctctgtcttttcctctccctcttctgttgttctctggtttccatctgtttctccttctccttccccatttctcactatcctctcttctgtctcctcacttacttctccatccctcctctctccagccctctctccctcctgtctgcatgagccagagctcacttctgcatgaacatgggcctcatgctagccttggccttgcctgctgggaacaatgcctggaataactagactaacattcagggtcccctgaggagatgcaggcctttgcaatgagggtgctcaggagggctctggacagtccagcactccggccaccctggccagactgcctgggctgcagggctaggtctcggcaggagccaggctgagctttgcatggggccaccagacacaacacagagtggtgccccagcccctgctgctctgtccactctagagcatggcacaccctggggacagcgtaccccctctggtcccactcctaatctctgatcccatggccaagagtcagaagccctgggttggggtcctggccctgcctgagaccacctctgtgaccttgggcaagtttcttaactgtttagagctcaatttcccagtctgagaagtggacagatgatagtcctgtcctgttgtgtattttgcacggtggtttgacatgccctggaccttgtggatgcttcactggggtcacagtaattcatttgagaatgatgccgtccactaacatctacccctggcctctgggacacgcaggcccttaggcgttgagccctggccagggaatcacctcttccttcccctgctcctctgacactggaggctgggtcagggaagatgccatgctcaggcctgccctacaccatgcccctgagcagctccaggaaaaggcctaggggaaatgggaactgttgattcccaatgtcagttatctggtgcctccatggtcccttcttctcccagtccagggatgatcaggagatggctctagcagactgctcccttcaaccgcccctccctcctttcttcttcctctgcccttctctcagcccagtggtggggagtgtagtgttcagctgggcctgggtaggggcaggttctgggatggtgggcctgcctcaaggggagctggcatggcttgccctagggctgctagtgtgatcgccgtgtggctttctggcaccctggcccagcaggtggcctcccggatcccctcgcttctggagccccaggcatgctgtcggacacccagccctgctacctggacctgaggaatccagtcttttggaaatcggaagactggaaagaagagctgggtctgtgagggtggcagtggccagtctggggggtgcagaggaggcacatcatgaagcctgacaccagggtactcgtcacgtgatccaggggtggtgggcagcagtgctttgccaaagtacatgtatcggtctgtgtcagggctacagctcccagaattgcagggtgtgcgagtgtgcgtgtgagtgtgtgtgcgtgtgtgtgtcagatgaaggggattaattgcctccagtctggctcatgctaggggagccttggagtgagctgttgtccagcacagcactgtcctggcagaagagtgacgcctccctgggaagggggctgctctggtgccctgctcctcaggtctgggggcctgtgtggaaccctggggctgggataactgctcatcctggcagggctgtggggaaggcctgatgcccgtgtatgaagcagcccttagagaacgcccagggctccttgaacatagggtgttagggtcctaaagatactttgttgtcataagggtaccccagccttctcagcctcctgggagcttctcttcctttcttcctctggccacacggcctcctgctggggtaggggctggccctagaggttctgagggtgacccagtggccccactatgtacccccatcatcccagtgtcctgctgccatttctgttaggctgtgtgtgtgtgtgtgtgtatgtacatgcaagcatgcacatgtgtgtctgtgcaaggcacctgcctctgcctaggtgggtgtaggagacagaggccctgagagagagaatggggccaaagactgagaaagtcctggggtggagggtggtggcgggagggagggaggtggggagagcaggcctatttttattatcagtcagactctgggacgtgagagagggtgttctctccatgacactggttgtcagcttgtgtccagacaccctagcttggctaaggaacaatggggctctcttctctcccctctgccacgccagtctcccctcccatagagcaagacaagagagagggaacatgtctctccaggcactccaggcggatctgggcttgccaagggggacaacagtgggacactgtgttcaaagaatgtgagtggccctgactggccattggtgccatggggccattggtgctctgcaggggaggggctggccccgtgggagtggaatgcagggtcttacccttccgcagagggaggcactgccctgcagctccttagctctttggaggtcattccctccatttccctgcctctggtcagaacatgctcccacgtgccattctggtggtgatggagagaggattgggaaggtgcagctcaccctcagatggctgactgcctcatgccaggatctcacattctctacggatgtcaggtgccccctgcaccccaagctgctgcaggcatctgtggcccctgaacatggagaaagctttgggaaggttgggcagaatgttctttgtttgtccaggagattcggtgcctcaaatgcaaacagatctattttttaatggcaaacgtcagatccccaagcagggaaactggccaccccttgaaaaggcagagggatctgccagaaagagctgctgggggcagaggagcccggaactgagaccagccctaatgcatttattttaaccttggggctgaactgagttccaaaccccaagagcgtctcccaaatgggcttcttctgtcacaattattgttagaaaatcaatggctatgtctgtttctctctaatgtttttgccaggaatgaaatcagtggcagtgttggtccaagctgcccaggagacctgagtgggatgggggctccggggagctaaggcctgggagcctggggttgctgcagggttgcagcaagctgcccacccttcccaaaaccacgcccttctttccttcaggtagatgctcctggcagcccctggctgggtctaatgggactcctatttttctgttctgcgaataagggctcttcaaggtgtggggcttgtttgctttaagtggaacagtttgtaagtggcagagtgaggtcagagtctagtttactgtccccatcctgggcgctattttcttagctgagatggcagcagggctgcccctgattaataaaaagcccaaagcggagactcagggcaccactcggtaccttctgcatttaatgtgcaaatgccagtcctgctgctctcctgatgcgccccccacccccgattatgggagcccctgattatgggagagtatgagggcgtgtctcagagtggctgtgcctatgtgagtgtaagtgtgtgtctgcccgtaggcttggcagccggcagcctgctgttcatgacaagtaggaaggcttcccaggtggcgctgtttatggcagcctttgtggctgtgccagactgggggtgctggggggcgtggctggggacatgcagtcctcactgtggatggcagaagatgtttctgtctgaatgagggtgatttctgcttggctgtactggcacattcctaggggctggcagtgtgtgtgcagtgtgtgtgcacacacgctgacccatgtgacctgaggcctttgttaagtcctagtggtggtgaaagcagggcggggaatctcttcccagaagagagtcaagaccagaagcccacgcttcaggctgggtcttggcctctgggacccaggaagtgagttttctaggattctgggagccagctcaatgaggcaatggattccgtgcctcagcccagctgtgggaagagggagtgggaaggaaggagggtgagattaacagcatccccaggcctgtggaatgggattgggatgggaagtacagaaaagcagatggagcacacgacttctctctgtctgctcttcagctgggagggacatggtgggatccgccgctatctttggggcagggaaaagggggcggggagctaagaggccagtataaggggagttggtaagaggttcagcggtacaccggatgaagttggggaaccccagagaaagccaaaaatatcccagaggccaactggggctggggacttcgtaacaaggcttagtcatgtctttgtttctccttgggagcaccatttgcaagatgatgcaatttagccctttccaagagttcttccccacaggcttgatgttgctggttggttgatgcagttgccttggagactgtcttttccctccacctcccctcccttgtctggaagctctggccctccgcctccaggggttggaagtagttgacatctgtttcttgtatcagtcctttgtgttcttggtctcagctctgtgtggagagattcctggtgaagtctgagccaatctaagcagatcccctctcctgcagagaaaacctggggtgtgaacagagttggacccaggagggctgaggggaagacaatgggggatgacaggcgagccccagcatggcctctgagctaggaggcactgccttctctgatgggattaggccgattgatcatttcttacacaaaaatgctcattgtcctctacaccctgctttcctcccaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagaggtgagtccttaagctgtatcttggggctatggagggtagtggtgcccactttaaatctccagaaacctgatggtcaacttggcactgatatcagtatactcagtgatttgtctccccctacgtcctcacccaaactctcttctctgacatgtggagtctggggcccattaaatagctctatgttcccacttcttgcattaatattgagattgaagtttcctttttgattcctagagagagtgccttaataaggtggtaagaatcctggggatgatataggtgaacacaatttcaaaactccaaactagatcctggagagtggcaaaattatttttgagccctttgcagatataaggtttttctcaggagatttaattttcattccaaaagatttgcatttctaagacatttcagtagttggaggcagtgagtctcaaacttcatcatgagtaacaaccaatggggagcttgttaaaactgtagcttcccaaatccacctccagagatttcagggtagtagatctggatgggacccaggaatctgcattttaaatgtgtgccctggaagattcagatgtaggtggtccatgggccacattgagggagcgagtgtactggcctataaaagccaggctaatgagtcattctggatagaagtggcttgtggatatcttttctctcctgcctgtggcaggacctgtctcctgccctgagcaccagtgaggagccaggctgacgaggggatgtgggggctggttaactcactgtcctcatacctcaggtcatctgaaggggaaatctctccttctcatggtttccctctttttctcccctgtgttctcccacagccccatttgcacagctacaaggaggccttcgaggagatggagggaacctccccgagcagcccaccacccagtgggggtaagaattccctgtgaagctcgtcttccctgtgtaccctccagcccctcagctcaaccctgcctgtgggagtgccccaggcctgagggttgggggtgacagtgccccaggtggggccagaacgtgctgctcctcactcccatggccccttctcttccattgcttgtggccattgtcttctccgtcgtccacactcacacatctaagggtgcagccgccccagttttagggtccagactgagtgaccatgggactctgggctcccacattatggagttttcttacttgttttgagtctttttaccgtccacactcaaaagaccctaccatcttagcgtgactctttgtgacttgactttgactttgtttctgacctccatttctgcctgcatccagacacctcttccattccaggcaacctatttagcttctaccaaggagagagggacccaggaccctcaggctgacagagcccccagctcatccatccttggcctccaggcagaggcatttagcccccagcccctatacacttactggggaggcagatccccaaaggacagagacacatccacctaaggccaagacccaaatgagccaaggcatggggcagtgttcctttttatagaagaagagacatgaagaggaactggaggaggtggttgtggggaaggaagtgatggattaataccaggccacgagggactcagtgtactcaggagaggcctgggtcagcacaaaaaggagacactggtgctgttcagggatcaggttggctgggcctggctcaagctatccactggccctggtgagaggagggagaactggagctggctgtgcattcccctaggggctggctgtcctgtactggagaggaatgtggcaatgtacgtggcccctgtgccaacagaacttgtgttggctgccatcttgggcatgaggaggctgaagctgtgactgattggtggccccaggaagccgtggctctcccttgagcagtactgtccaatggaaatatactatgagcacatttataatttaaaattctctagtagtcacattaaaaagcataacaggaaactggttacattaattttaataacatttttgttaaatccaaaatatcctttcaataggcaaataagtcaataaaaatattgagctattttacaatctcttataaaatttaagaagaaactggtgaaattcattttaatatgttttatttaaccccagtctaaaatattagcatttcaacgtataatcaatgtaaaaaagaacgggatgttttgtgttctttttcatactttaaaaccctgtgtgtgtttcacacttatggcatgtctctgttcacactggtcaccctgcaacggctctgcggccatgtgtggctcgtgactgctgtgctggacagggtgagcctagagcaggttacgtgagagccagctctgcagcctcttgtgactgcggggaacctctctcactttccatggtgacatctgcttccattcactgttagctgtaaatggccagggaaaggacatcaccttgccttgggtggaagccacctgggctgtgctagaactgggttttgccttcttctctccctcctcttggccagccatgggtacctcggtgagaagtcagaggttccatagacacacagggttagggagagaagacagaaggtggagaaacgtgtggaatttttctctcaggaagcaaaagacttgcctggctttagcgtcgcccactcatctgcctcagcagaagggcccaattgcccaggaactgggggaacgaggaattcaggagctggaggtgaacaagggaggaaccaagagagagctcctgccctgtctggtcctctcgtccgcttcacctcctcacgggcccacctgcgcctccgctgcaccagttggttaaacatgcgcgtacctgtgggctggggctgcttcgtggttattccatgaatgaccgtctctgaggccaggcatattatttcgtaattaatttcattcaaccgccattggtttgacaaacattaataagtgtttgataagcgtctatgagcaagacaccatgacagggaagagggggtgtggcggtggtagaaacagaatctgtgtgtgtctatgtgtgtgtgtgtgtgtttgtgtgtgtgtctatgtaaagacagagggaggatagacagagacatgaggcctagagctatcccatacctggaggtgtatgtttgtacccatttgtcccctatgctgtgtttgttctttggacatccaaggacagagtgagggtgaagggcaggggtgtgccactcatccggacccctgtgatatcttcctgttcccacgtgcatgtgggtgttcacctgcacaaacgagttatgtatgttgcttgcatggagagagagtgtattttttcattgttgtaagattcctgtaggtctgactgtcttttggggaaagcagcaggggcagggagggtcgtggagcatttgctgctggtggttcctgggcatctgagggccacagctaatctgttgaggccattcggcaggcagagtatccttggggctgtggtctctgcaggctcccaatgtcgttgataggagacacagagttcattttttaacttcttctcagagctgtgtcaggagacatggcagctgccacccaggtatctcgtgactgggcataacagccaccctgcagatcagctctgaatctggccaggttcttggctaatgggaaaaagccagcagccctttctgaccttgtgtgttacatgacacttgtaacccagatgggcggcctgggaggagcccaggcttcgcatagggagtgggtgctcttggccacagactataggcttctcctccttccaggacactgaggtttggggggacagagccccacattgagaagttctctcctcctgggcttttcaagggacatgcttggccgagggctggcctgaggtctcagggttggcgtggctctggcccattatctccttctgtctctgtcctttgcagggtgtgccatcctgaggcccaattttcttctgttctcttctgaatccatccaagtacatgttttaaatggactgtgtgtgtctgtgtgtgtgtgtgtgtgtgtgtgtgtgttgggtgagggtaggaagagggatgagagagtattatagagaaggtcagagacagctgcaaaagcctgcgtgtgtggtataagccattgcaaagtaaagggactgcagcgagaagctaagggcctaggggtggaaatgattctctcaaggttggggccagagccagggcaaggttgccatttcctgagtctttccctttatcctttaaactgttcaaatgtagagaaatacggaggcgggaaagggcagtggagccaaagcgctgggcctcagggtggttcctcggcaccgtctccagccccccagccctcactaagcgtgccctcacgtgcctggcgtgtctgccctcctgcccacctctcactccctgtgtctcccctcttcttcctggcacagtgcggtcccccccgggtctggccaagacacccctgtctgctctgggcctgaaacctcacaacccagcggacatcctgttgcaccccacaggaggtgagttgggaagagggaagatggggaggggggccagggggaggaggactcctgtggttctggacagaaacccgggtctcagaatctggtcagcagccagctttgtgcccacactgaggtcaggcctgggttggggctctctgtgtaggggttgggggtgacagatttccttgcagccttcctgtctgttgacttgtggagtttgcacaactcccagcctcctctagcttgaggctttggaggcctggtctcagtttccttggtggtgttgagatctctgctggaagccacacattctaggtgttcaggccctcgggtacacgtacatgggcgcacatacatgcacacatgggtacacacacatgtacacacacacacatagagtcagagaagcatgcccctgctgctgtgtgccagggcctctgctggcagcccagctggctctgctctgagcatccacgaagcatcacaggcattcacctggcatccacaaggcatcacctggcattcagagtggtctctaggtctgcctcttcaggcccagagaaccctaccagagaaacccatgactagcagtggccatcattgcctgccgtttcctcgatccccttgccctcagcccaggtcttctcctgactgtcaaaggacctgccacctccgggcttctgactctccctggcctgtgctcatcccccatccctactcccgatgctggctgcatcttactctgctgctgaggagagcagcccaagctctgaggaaggaaggaggatggctgctcggcctccctggggtcaaacagcctgtcctgttggcacggtagagggcagggccctgggcctgtctgggagaaggtgctcctctgagcagacaccaccccaggttcacacctcctacctcctcctcccatttcccagctcctctccttcttatggtggagggagacagggctccctgggcccttggtggccatgtggggccactgaactcagaaagctgctccctggactctggttttagggctgggtgggggctattggggtcaactttacttttttccttagttaccagaagacggatccagccaggtaggtgggcagtggcatgcatttgtgacccatgaagccacgcagctgggcatagcctcccactcagagtgtcggcatggccagggacactgagccacgggggatcagtagaagggggctgggggctgcctctcaccagccagcacactcctgcttgacacttggcccacagagccctgggcacaggggctgcgaggggctcaggctcctgagagccggggactcaactatgcctcggagccttggggtcctttgcagggtgggcctcggccttccccttggagtccttctgtggacagcgcaaatcggccctggcctcaccccagctttcccatctccgttttctccacagattctctttctcaagaaataatccctgttaatctctttctctctttttccttttttgctcttcctcatcttcaccacctgcccttctttcctgcctctccttcctcccacctctcttctcgtcttccctcagaggaagatgaggggaaggtggtggtcaggctgtcagaaggtaagtagcatttgctgtgacttcctgctctctgggtctggaaatggcttttcaaagcagggcttgaagaggctggctggaggcagctctctttcctcactgggactcaggcgaccaggcacatggccttcctgtcccccaacgcttggtgatgagataccaccctggacacctcctgagtcctgatgggggagcttgtagctgccaggcgctggctcaggcacagccagtgtctgggggctcctgcagtgtcaccttgttgaccaaaacgctcctcttgcaccttcctctcccagcgccatttgcaccagcctgcctggtgtgcagcagctcatagaggtagacagggagggactcagatcccctttcccgggacgtgctccacaggcatttctcagagaagagattctccacgttggcaccactgacgttttggcctgaatgacgcctttttttttgagatggagttttgctcttgttgtccaggctggagtgcagtggcacgatctcggctcactgcaacctctgcctcccaggttcaagcaattctcctgcctcagccccctgagtagctgggattacaggcatgcaccaccacgcccagcaatttttttttttttttgtatttttagtagagatggggtttcaccatgttggccaggctggtcttgagctcctgaccttaggcgatccacccaccttggcctcccaaagtgctgggattacaggtgtgagccactgtgcctggccctgaatgactctttgttgtgggtgctgccctgtgcactgtaggaggattagcagtgtccctggattctacctgctagatgccagtagctctcactcagtcatgacaatcgaaaatgtctccaacattgccagtgtcccctggggggataattctcctggcgcagagcccccatcttacagccacgatttgccctctggaagccctgcctggtttcctatcaacacagaaagtactaagtctgtctttcggggatctcagacaacttcgcgtgtttcaggaaatctatggactcaccgtgtatacaataatgcattgggattcccatgcacgtaattctgaaaagcagtttcaaggagttggcatgtctatgggtcccagaggaacccctgatttagatgagccctgcactgggcaccagggaagcagagagggggcataatcaggtgggaggccttggacacaccaggagcagaactcgagtgaggactcaaaccagcaggtgaaacaaagtgggtgccagcctgggcgggaggccagggtgtggttctgggcactggcatccccccctcaggaagatggggcaagatgggtgctgtgatcacttccagttctgatgggttaggtgttctgacttcccacctgggccctgggccgattggctggttttctcaggcctatttcccattttcctttgaccacaccaccttgattttccaccccctaagcggggatggcctgtgctcctctaaatctgctgtcacccaggtaggatgattggagtttcccagaagactttgccctctcctgaccagctggggtttgggcaacaacatcaggctgctcaggggctgcagaacagggcagcttccagagacagaacaggtgggccacagcatgcttccctctgctgggaacggcccctccttgctcccccgcagcctcatgcttggggaaagggctttctcccaagctggaggctgactgctggtcctggcaaggcaggagctgggagagagagtctagaattagctggagctcagagccaacgtttctgtgcttcagatgccggaccacgcaataggctctcagctctcctcgcagctggttgactttaacagaccagtggtatctcaaacactctccagtgggaagggccatggggtggattatccagcaagctggcagagcctggtgattgtgtctctcactttggggtgacttcaggggcgtgggcctcgacaggactgaactatctgccaattgcacctgctgagttactctcatcttacagggccccaagtgctctggccagagccacagagtttggaggggaaggttcttaggggttaactcagccacacccatcgttgtcacagatatgcagctgacatcagcactgtgggtggtgttgggggatctgcccaaggtcacagttaggaggtaatggagccagactggagttattggtctcctgtctcttcctcaagtggccatttcaaagtccttctcctgcctgcaggcaccgtgccctgggattccagcgtgggagttggaattgctgcccgtggcctggggagtggagcggggaaggggcagggagcaaagctgtgggcagccagttccttatttcctgactcatgtgccactgcccgggtcagactaaagctcattctttgctgaccctctgaggctctgcttgatttccttgctgatactttgatgggaaattcagaaaaaaatgccagtgaggcaaaaatggccagaggcaggattattcggcttggggaaaagaataatttgagggatgtctgctatgtcccaggcgctgtgcgaaacactttacattcattcattctttcatgcattgattcatttattcataatactttgtgcgctgactgtttgccaggctttgggaatataaggatgtgttaaggcagctggtgaggagagtgatgccaacagacatttcaatattaggcaaaagtgctgagctgaggtaggaataggatgtcatgggggctgggaggagggggcatgtggctcaatctaaaatgtttggaattctaacttttgagcttctagatctgggacctgggggtttccatattcccttctttctttcccacccacatgtcttgattttagttagggtgggtgtgccccttctctccaagcaaagagcctctttgggagacagaaaatgcacttcagggtgtggacaaggagctgacagtgccagaccggaggagcccaagtcaccctgtgctgcagctgctcttcaccgccagcagccacttggcagggtttgggctcctggaatgttctacatgaagcaccctccctgtccccacctctcccgccctgcccaactccctgtagcctctgatgcagctgctccaggattggagggaaggaggaaaacagcaggagaggtggtgcgagtgaggagtggaggaaggcagggatgggcggctaggagcagcggaggcagcagcagggctggttctgaacactgggcctggaattggcaggaaagaattaggaagaactttctttcctgcctcttctcacctgatcctagctgggcaggtgggtatcctcattcccactttgcagatgaggaaacggagtcccagaaagtctctagtaagtgcacgggtggtgggtgaggggagagcttgcaagtagaagtatattgtcctggggtgggagagagagaaagagccagggaataaacagaaaaaggaagcattttcactacggagatctgcatctgaaaacttgggaaaactaatgtttagccctgaagatgggttttaaacagttctggagatgaactcaggaaatcaaataacttctcaaaggtccttcccgctctgggttcatgaggagtagagattgtatggaagggcttcgttcatctccaccccatgatctgggactggaagggcaggtaggggtggcagtgggagggcagaccagctgaccaaggaagaggatgcactgggaaggagaaaggaggtgggggcccggtgagggcagggccaggtggggctgggtctgagtggccttggctaggttggccacccaatgcacaagggctgtttccaacattgtggtcagaatggatgctgctgcttctccctgggcgagccatcctgttccccaagttcagactcccagtgtcttgagaactcctctggtgttctgcagtttaggagctgaaggggccaatgggactgttgccttaagaacttggccatgctatcgagccatctcagggtttctaatacactgtcccatgggccctccatgcaatcttgccatcagactcccaggctgcagctcaggtgcctgtgtttaggccagaagcagttagtagacccagccttgcctaatggcaagtaagcacccgcaagccacaggcttggctgtgtcctgaccacaggacggggtggtgtggcccactttatctcagttttactgttgctagcaggggtacctgtacttctttaaaagggtggggcgtagggcaatgtgaattgcttacctaatgtgtgggtcaggggcctggtgggaaactgatggttcattccaatggagcaacctaggacagttgatggactcttaaaaggtctgggcagagcagtgagggatggtaaagcaccccgagtgctccctatcaggagcagggagccatcctcccaggccttaaggaaccaggagggagctggagggcagggctgctgactggagtgtggctagagggaggtgggtaggggatgtagccactggcaccttgcccttctctctccctccctctcataccctgccagtccctccttactagccaaaggccaaagctatcctgagccagagactaagggggtctggatgacatagtaaataaaagtctgccttcagggatgcagatcagggtagagagtagatcaggagcgacgtcagtgaattggggaagagcacacaccttcacagtgtcattcacataggtttcaacttgaacttcagggaatgagaaaaatggatgtgtgcctctgaggtcttactatgtgtctctggatggggctggagggtaaggatcatgcttctgtgactttgtggagcacatgcagattgagggcctgctgtgtgccaggtgctgtgtgagggctcggcacacagatcagctaggcaggctctgggagcccacgggcagccaaagagtggctttctctccctggctgggagagaggtggtgccgagagccgtggggacctgggtgtagccatgatgagtgcctggaagggtctgggaagagttttcagagagtgacctagggtggcaagagacgggaggggagagtggactctgatcttgggtgtcatttgcatggctgtgggtgagactccctctgatgttctcttctcccaagttgggttaccagttgcccaagactaaagacactcactgaaactattggcttcccgacttgcagagggttgtatgtgcagtgggtaagggcaggttggggccagactgcctgggttccttggctgactgtgccccttgccagctgtgacctgggcaaggtacttacatcccccgaatcctacttttcctgtataattgtttgctctttttatcactaggaatagccctatggagttggcttttctctgcctgatgggctgaagtgctggatagagccagctctgggtgtcctgtgagcctatgggccctgtctaggtcacccagagccagcttgtgagtctggagactttggtgctagtgttcactgccactaattatccatgtgtcctggcgcacggctccacctctctgggctgaggagataggttagatcaggggtcagcacactgtggcagctggtcagatcctgtccactgactattttggtaaagaaagtttgattgcaacccaaccatgcccattcactgtcctgttgtctatgtaagctgtcacaccacaacagcagagttgtgtagttgcaacagtgacagccttacccaccagcctaagatatttactattaagtctttacaaaaaagtgtactgggcctggtcaggggatatctgcattgtcttctagttccagcagagcctcgtgcttgggtggcacagaatccatgcctttggtatgaatttggcctgggccttctgcgaggaggtgggtggcctgggctggttgagggaggatttcgaggaggccttgctggcactgcctacatggattccagctttgggtgccgaggtgcctggttctacatcaccttgtgcctgctacctagaatagacctcccgtgcctgcctctttgcagacaaactgccccagccttgtccactgtcttgctgttgggtggagggggttctgtatggggacaaaagacagacgggcaggctgtggctggagctgtgtgcagactccattgcagcctctgggtcctgctctgtaaagggtcctgtgctgagggaccatcctcttccggggtctagagaggcctctggcctgggtgtaggatgtcagacctgagggccaccccagaagccactccacggaggccatgcccctatgcagcaaaggctggaagcaccctgctagcaccctggtgactaggctccttccaaattaaggttttctttgggctaaggggaggaaggttgcatttcagctagctggaccccaggcctgtcacccatgagggacctggaggagggacctggaggacctgactattttggtaaagaaagtttgatggcaacccagccatgcccatacactgtcctattgtctatgtaagctctcacaccacaacagcagagttgtatagttgcaacagtgacagcctgacccaacagcctaagatatttactattaagtctttacaaaaaagtgtactggccctggttaggggatctctgcattgtcttctggaggagacctggaggagggggctcttctccaactctgaccattgcagtcttggccagcaggggctgcaggggcctggcctcctgagggatgcacagactctggttcttcagtttctcaggctgatttcagtggatgccttagttgtgggcagtatggctctgtactcaggccaggttcctcctgggtaagacagggacagggtgggatttggaggtggtaggaatgacattcctcccggatcatggcccggggtaaacaagagcgttctgttgcttcttcctctttcaagcggagttcgtttgggagctggcctcagaggccgtagaggagttgggcaggtgccggtctgggagtcgggccatctggggacctagtcatttcccttgtcgggcctcagcatccatccttatctgtaaaatggccttttctagcgtgtgtcccccaccccctcttaggctgttttgaacaccaggtagtgccgtgtataatgaggtcctctgtaaactaaactgctcagtgctacaggaatgccagaggtgggcgatggaatgttgagttccgcctgggaatggggttccctgatgccagtctctagaggaatgctgagtgtgtcaggcagagaggggtgggtgtgtcttggcatcaaaggggctggtgagtctacagcagccccacagggcaagactcaccagtgcaggcctgttgctaggtggccaaggctgtttctggattctgggcagggggtggagctcacatgaactctggcactatcctgggatacaggcaaggcagggatggacctctgggcccactgtagggccccagactctagtggcacgaggagaacctggaagggcctgggtgctgagcaagatcattgaagaaagagagcagccaaagggggtgccagctatggacagcctcctagtccttggagggaagagtctctgatggccatgttctgaggcggggcctgggatccatttcagggccccctcctctgagcaaggccctggtgaaaggtcactgcagggcagggtgggtctgggcaggcaggagccctgcctgtcctttgggggctattcctatgttcccaggcaggagtccaggaagctgtgttccaggggaggttgggggggacctgcactgcacccctgtgcatctgtgctcagtgtctctgtcctcttgccccttccagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacaggtaagccgggaaggggcagtgggtgggggatgggaatccgggcctgggactgggacgggatgggtgaggcctcctggatctgttgcctatggcgtggacaggcagaaagcatacccagatggcggtaccttgcaaaccagttcatcaaggtgcattgagggcacatgtcctgcgcgctgaatcctgtggggagcccagtgacctataattcccaggccgcattcaattccgcccatccaaaactgtgctggaaggagtgaagggtaccacggtgaatgtggcaaagtccttccccaagttgaaaatctaccaacagtaatgacttatgtagtgggctcatcctaggtacctggcactttgctaagtgctttatgcagttatttaatcctcgcagcaatcctaggaggtgagcactattattgttcccacttttcagaagaggaacctgaggcataaaggtgccacagctaagcagtggcagaaatcagattcaggtggaagcgtgtgattccagagcccgcatctctatcctctgccccagacctgcatcatggcgccctccctgcacaggatgagagtcagatgggcccaaagcccacacatgagtgaagggcttggagctcagaacaaggggccattatttctggctagggatgcagcgaggatttctgagggctggaggcatttgtgaagggtgtagaggaagtagcaggatgttgaaagatgaagaaagagagacagggcattccagaaggacagcccagcagggacagaggactgggctgtggccatgttgggagtgtgaggctgagggcatgtggcctgccattaggggatgcctgggtggatggatggctggcatccatatttctgagtgcatcacacagagatgaaagcccagaggtgggtgacagtccctgctgacaggcttagtggaggggtgcagcaaggagctgcttgactggggtagtgggggtgaaggtggaggggacaaagagatgggatgacggcataggaaaggagggttgcaatcagctcaggcaaggcatcgagtgccaggcaaaggaggaggacctaggaggtgtcgcccccaggaggggagactctgccctgaccatcccttcttcgccgtgcccactgccctccctagcctgggatgtcacagagcctgcaaattcccctgccaggcccagtgggtccagtttgctgcacagtctacattggctcaatgctgagcctcccctgcaagtgggggcaccatgggatgactaggggagcagatgagcagaggcaactgtcttctggattctaagccaagcattccccttccccagcctcttaacaggcagcagcctgcgttgctcaggaggcctgactctggccgagggttgcatttcctattttaaaggaaaggggattttcctaagttgtcccagccacccattgttgatgttcagtgagccctggcattaggaagttgttcattgtttctcactcaaatccctcctgctgaagtgttggccctttccaggaagctagcctttctcccctgggattagccttccagaactccattttagtgtctccttctctcaccctgctcagcctggctctgtctcccactcctcagaatccagtttattctggattataccaggaggtggccttctgctttggccccttctgggatgcaaggtagactttgccctagcctggcccctgaccttctccttgcccttggctcttgcctggcccaagagcacacccccaaccaaaacctcatatcaccccgtgaacctgagcttatccagcctggcccagggagggccagcccacaacaagatccttccagcctgcagctccaggttttggcccattggctaagtaaggacctctccccatggggggttcctggtgcacagcctgcctgctccctccctacatactagtttatgtaaggcccctgtcaacctttgtttctctcaccatagttggatagaaatttgggtctagaaggagtcagggtcacctaatccagtcctgtcattttccacatggaaaaactttaataagcaaaaaaactcactggccatcacattgtactgctgtgctttcatctgtcactccatgcagacctagacttaactttacaagggaacctttgactgtggcaattaccccaggtatagtctcctctgaactgagttgtttcagagtcagaattggtagtgacctctgagctcatctcatctaacctcccaatgcaggaaattccctctacagcattcaggccaataggtctgtcagcctctgcttaaatgctcctaatgacaggagcctcattaccatgcaagacagctttctccattggtggccacatccccagtggctggagagcagaccttacaatgacctcaaatcccctgatgtgaaaccttcccctgtgattccttgtctttgcttttttggagccatctaggagtgaaagcccaattctagcactctctgtcaatgtttaaggatgatgatatcacacttgaggaaactgagtcaagacagggctactcccagtaggaacaggagccaggaaactccattaggaatttctgtgatgctggaggctataacatgacagccacctccagtttcgataggagagggctcttcactttgacatggctcaggagtgagcatggtgcagtggggaagacgtgggctttggaatcagacacagctaagttgaaaccctggtcttttataagcagtgtggtactaagcctactgcttaacctccctgagcctcagtttcttcttctgatggttctgtaaggtaacgtataaaaccctgatgtccttccgcactgccagtgggaccattcttactgttgttcatggttggagggagggcagacagcctgctgtaaatccacccttcattcagttctgtccactgacatcgcaacctgccatctctctgcagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccaggtgggcctctcccccttccattttcacctctcctgctgatgaagtaagtagaagagtgaaatatctatcccagtgtctattctgacattctcttggcagacgaccctgggtgaatcactgacttctgggacttagtttctttatccgtataaagagagttggaggtatccttacgatacgtgtgctgtggttgtggatgctgagatgaggatgtggatacagatgaggatgataaaaatcataatgaatagtattactgttatgattatcatcgtcctcatagccattaccactcattgagcacatgctgtgtgccaggctctgagctgagtactgtgtcatttaagcttcttggccacttagtaaagtaggtattaatattattaaccccagtttacaaactgaggcttagaggctctgtcacttgtctagtatcatacagtcaagaaatggcagagccaaggcttccaatccaggccacgccaccccaaaactaatggtcttcaagcatcactggagttgtctttatcatgtgtccatatcttgggggtcatatttagcatgaccttgaaaacctgccttccaaacctggatctccatacctttgccagccccacagtgccacatcactcctcgtagacccaacttcatcgaaactcatgcaggtttgtgcagtgaattcttcacttatcgccagaacttgccacctttgcctctacttagaaagctcattgtctaaacacaaaggccaactttgaacttgactgtgtgcacagtggccctggatgtttgaggcagatttagaatgttttgggcagcctcagatgggccccagctccctagattctcccggcgtcactctcaggtcctgccctgagcctgccaagccaggacacctagaatgaccctgcactgcctgtttcctgccgcccaccggggacatctggttcccagcccctctccttgaaggatgcaaaacttctagtagctgggacacttcctgtttcccaccatcttccctgcttaaaatagcctttggagtcaacacaggaaggcacgtgggactgcagccgcctctgacagctcgttaaacaggccacggcagcagtggggcctggggcttcagacagagaaaggcagcctgcagcagttgcatggcccagctgcctaacccagagaccttccttagcacacggctgccaggaaagggagctgacctctcccctcacactcgcccggagacagatcccagaagcataagggagtgtaaatcataggttgaaattgactaagcactggagacacaacttgtgtctcctgatctgctctcttaactttgcagtgtctttcatgccaacttctgtctctgaagacaggagaggaaaaatgtggaatcctcatctttttctgttctccctccctttttgtgttttctttggtgccaaaagctgaaggaagaggttgagagtgagggccgcacatcctgatgcttagacaggaagatacagtttagctggtcctaaactgactgctagggcctcttaccaaggtcaccatctgtgtgacttgggcaagtcacttctcatccctgaattcctccttttatgtaaaattaggcagttggactgtgtcctgtctgagctccctccagaatctaatgttctatgacaaattcccaaggtctgcagagtctgggcatgggtgtgtgtgggggtgctgtctgcctgagaagtggggtgcctgacatgcagtagatggcctctagattctaggccagccatcacctgtttgatccaaagagaagtgattttttttttgttctatgtgatgcagaacataggccttccctgtggaaagtgaggagaggcctggggaaaagggggaagaaatggatctttctgccctcatcttcatggtgggtatgctgaagttgagaaactgaacctgtggagaaaggttctagaagcaagtgttttaggccatgggagaaaagctgtaggaaggctttagtcacagtcttctagggaaagggggacacggggtggaggaaggctttcagtgggctctgtgggaatgcagtgccaggccctccaccaggaggtggctcagccacccagatggcgggcaggggataggggatggatgaggaggccgaaggtcccttccactgtgttcgcatggtgttcgaggacatcagcttttgatgtcagtttcctggggctgccataacaaaggaccatgtgcttagtggcttataaatgacagaaatatgttctctcacagttctggaggctagaagtccaaaatcaaggtgttggcaaggttggctccttcctgatgttctaggggagaatctgtcccaggcctctctcccagtttcttgtggctgccagcatccttggtgtcccttggcatgtagacgcatcaccccagtctctgcctgcaccttccatggtgctctcccctgtgtgtatctctgtctcctctccttgtaaggacaccaggcatacaggcatactggattaaggctcaccctaatcctgtgtgacctcatcttaatttgtctacatctgcaaagaccctatttccaaataaggtcaaattcacaagcactgggggccaggactttgatgtatgttttgggtgaacacaatttaacccataacactttcttcccttctcctgctttagacaacagcccggagacgcgggctaaagtgaagtttgtccaggacacttctaagtattggtacaagcctgagatctccagggagcagggtgagtgctgggctctgtggtgcatcagaggccatagctggctgaggcctgctgtgtcttccctgggcaaggaacagaggcaaattcagtcctctttgtagcagggggtcatcacagagggggctggggttgaagctggacagtaggaagcacttcctgcagtgaagtgtgggaacacagaagcagtagttgtagacacctcttggaagggttcttaaaaacagcaaagccttggttttcctgggcaaagtaaaaggtctgctaagataatatgaaaccttagctctctgtctgcctgatgtgggaggtttttgcattttacagggagagagaacaaagttgggaataggggaatgattctcaggggaaggctgggtgtgggacaggggtcagcaacggcagcccatgggtcaaatctggatgctgcctgcttttgtaaatgaagttttactggggcgcccccacacctgctggcttgcatcctccctgtgctgctgtcctgctgcagtggcagagtggagtagttgtagcagaggctgcatggcctgcgaagcctgaaatatttactctccggccatttacagagtaagtttgccagccaggtgtggtggtgcacacctataatcccagcacttcaggaggccaaggcagggggatcacttggggccaggagttcgagaccagccagggcaacatagtgagatcctgaatctacaaaaaacaaaaagaaaatgagccaggcaaaatggcacacactgaatagtggcctgtggtcccagctactggagaggctgaggtgggaggatcacttgagcccaggaggttgaggctgcagtgagccatgattgtgccactgcatgccagcctgagtgacagagtgaggcccggtctcacaaaaacaaacataaaaacccaacagaataagtttgccaacctgagtacaggaagacccgtaggagtagttaaattttaactttaaagaaaatttgtctcacctaagaaagaacgaaggtcggtaggctcaatgagacttaagtaaaactagcgccaccgaggtcttgcttcctcctctctccttgtcccttccccatgcagccatcgcgctcctcaaggaccaggagccgggggccttcatcatccgcgacagtcactccttccgaggcgcgtacgggctggccatgaaggtgtcttcgccacctccaaccatcatgcagcagaataaaaaaggtaacctcatctcccagaatggggctcaggaccaggtgagctttacagtcgctaaacctggaggtgctggagggacccagggtgctgggcaggaccttaactcccatcaggctcttcggaagagggtgtcttgggcttggtgatggttgaggtcagagattgggaaagcaggacgattgggtgcctgccatgtgtttcctgaggggtgggagagcagcagtgggctctgcagtccatggggctccagccacgttctctcttcagtcatttctcccatcttggccccgcacactgcggaagttttgaagcagtcttgggaggtggtgggaggaagccatgggcagggactgagccttatttctttctctttgtcccaggagacatgacccatgagctggtcaggcattttctgatagagactggccccagaggagtcaagctcaagggctgccccaatgagccaaacttcggtgagctgtccccctgcccccatctctacagtctggcctgagtcttggtcctgtcctgggttcctccaggggtctgaccccaagttctttctgacaggctctgccagtcacccttgtcataaattcagcagagaaaatgaatgaaagcttctctccctccgcagtgcggctcctaactctgccaaactgcagtctgtgtttgtccgacccagctgggacttgttatcattataactggagtaacaatggtaaaatcagctgccttaattgaccacctaccatgtgaatgtcacagtctcagcaccttctatcacatctggcctcacaaccatcctgtttggtaggggtcatcctccctaatagggaggaattgacacatgaaaaaacgagagtcatcaaagttacatttacctgagaaccaacaggtgagaagtgactgagctgggattggatcccacaattctctgatccttctgccctgttctcagaggagccccagtaactggggtgcattaggagcgatgttaggaggaactttctgcaaaggaaagttgttaggtaactttatgactgcgagagtgaaccttgggaatcttctctgttggatcttgttcaacaagagggtgtgaattttcagctttggtggtgggttgaggtagaggtaataaagaagtggaagattgtgtgtatcggtgtaagggtagaggtggaggtttcccttctggcttccagtatcactgcccatgacatgccgtctgcctccctacaggatcgctgtctgccctggtctaccagcactccatcatcccattggccctgccttgcaagctggtcattccaaaccgaggtaggaacgtgagactcctggctcaccacccacacccttgagctggcccttgtcatgtcttgatcctgccagccactccggacatgggccagggctggaggacacatgtcattttgccagtctggagaaactcaaaactactctccttttcttcctattaaaaaagaagaaaaaatttatgaaaaagcttgactccaggagcatacataaatggacttgccagattgttcaggaaaactctccgtatgaagaaattcatatggaatcctcagaccacgtcgtcccagggatgacaggagacagaagtaggggacaggagacatgtcctggaggatgagatgggcatctggggaagagagtggggaggcagactgaggtgttgaggggttggtctggatggagaggagagagcagcctcaggaaagagaaggcggtgcctaaatgtcgccagactttctaatctgtgtgctgggagggtgttccctgactaaggggatgctgagctgttagggaagagcaagtcctgttttgattgtgggaagttggaatggactccaagagcatgaggacatgcaggatgagaatttgagtgagacggcagggctagggaaggagtgtttagcttctctcatggaggcgcatcagccctggagcgtggcaggtgggcacctagaactcctcccagcataggcctctactgcccagccctcagcaacacagggcccacctgagggtcactggcctcacccgcagtgcaaggtctcggaacggtctgggctgccttctccccactctgtctgttcaacaataggaccttcagaagcgctcctaggctgtggccctaggatttttttctagtctttcttggagctcctggggctatgcccacacataacaccgccagtatttttggacaatttctacttatccaattcagttcattgaattattaatggtaatggaccaatattattagcttataagttcaaatacaacttaaatagcactattaaccaatgacacaattcagacatgaattgaattatattcctatggaattcaccattgtagttcagcaattaaaaaactgtttaatatttagattgtataaacctgttgttttcaaagtatgggcctagaccggcagtgtcagcatatcccagggacttgttaaaaaatgcaaatattggctgggcatggtggttcatgcctataatttcagaattttgggaggctgaggtggaaggattgctcgaagtgaggcattcaagaccagcctgtagaatatcagaagaccctgtttttacaaaacagtaaaaaaattatccaggcatggtggctcatgcctgtagtcccagctacgctggaggctaatgtgggataatctgctagagcatgggagtttgaggctgcagtgagctgtgatcatgccactgcactccagcctgggtgacagagcaggattctgtttcaaaaaaaaaaaaaaaattatgtaccatgtacaatgtgatgttttgataaatgcatacattgtgggttacatcaatatgctaatatatccatcactcaattcttattaatattgaaattagagttatgctggatcaatggtttaatgaattaggggaattaggggatttattgacctacacaaagatatatcaatgcaaaacaataacagcaatgccaattgtcacttgaaggcttgctttatgttaagcactggctaagctgtacatggagtcgctcaaaaacccagtgacgtgggtaccatgatcatcgtctttgttttatagatacttagtaagtgctggggtgagggtttgagcccagttctgctggactccagagctcacaaccagtgtgctggctgcttagagcaatcatcaaacgttcagactgagcctaactcagggctgactgccagggtctggtatgaaaagcagcgttccttctgccaaagagttgcagagctcaccttcagcccagccaaacttgtgcttctttccagctctagggttttaattcctactgaatttttgtcttagaccccacagatgaatcgaaagatagctccggccctgccaactcaactgcagacctgctgaaacaaggggcaggtgagtggtcacctgaaactgtacccatgcccaggcctctctttctgccttcctgccctgacccctcctgcacgtgcaggctggaggtctctccaggcccaaatgtctctgggaagatcacatttctatgtgcagatgccttggctcaaggctagcctgaaatttatctgctaccttctccctgaagaatggatctgggttaatgtcctcacccacgccagctcccatgactcccccttgggttggtttcttccagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagtaagactcccctgcctgctcctcggtggggttctccttcctgtgactcatctattcatccgtgtacccacacatttaccacttgattgattccttgcacccaactgctcatctaccttctcatccatctatcttgcatctacctcccatctacccagctacttatccatccatccatccatgcacccatccatgcacccatccatgcacccatccatccatccatccatccatccatgcacctatccatccatccatccatccatccatccatccatccatgcatccatccatgcacctatccatccatccatccatgcatccatccatgcatccatccatccatccatccatccatccatgcatccatccatccatccatccatccatccatccatccatccatgcatccatccatccatccatccatccatccatccatccatgcatccatccatccatccatccatccatgcatccatccatccatccatccatccatccatgcatccatccatgcacctatccatccatccatccatgcatccatccatccatccatccatccatgcatccatccatccatccatccatccatccatccatgcatccatccatccatccatccatccatccatccatgcctccatccctgcatttattcatccctcatctatcccttaccacccgtttttcccttcatccatctgtatctccattcatctatccatccacccattcatccatccttctatgagaatttgccagcattgggtatacggctgtaaatacaactgataaaaaggacctgctttctaggagcagagcccgtccacttggactctctcctaacagtgtccctggcctctttgcttcttcttccagcccctccccacatttcctattcctcagtgccagtttcttccttccccagcccctagcatttgggatgattctatggcacatctgtctctgtacattgcttgggtcaccagtgtcaacagctcaggccatcttgctcataagagagaagttgtgtggacctgcgatagccacagatggtggaaaggtggcctgacctgctggtggaaggaggggaaaagcagccccttcagcactcattctctgtttatctgatgtctgtgctgcaggctctttttcagacgccactaccctctcaacactgtcaccttctgtgacctggatccacaggaaagaaagtaagtctcttgtacacagcttctctcccacacagctttctaacactgacgtctgtgtgggtgcatgcatgtgcatgtgtgtgtgtgtgtgtgtgcatgtgcatacattctccattcagctggaaggtctgcccatgtgtgagtaatcgtgttgggcatcttttgagtctttcccactatagatatggagaccctcccagggactcagtgcccactgctaccccctctgccatgccctgaccttgaatctgcttctcctctccatgatggggagagcccctcaggaggcaggctgcagtgttctctcgaccttgaatgcatctgtgtgatcttgggcagctcctgtccctggggaatgggggaatgggggaatgaggggggaatggggggcagctcctctccccagaccttcctgcagagggtctgggcatgggtggggctgggctctagggagaaagtacgatgatttaccctgagcccactttctctccacaggtggatgaaaacagagggtggtgcccctgctaagtaagtgtgacttcttacccctgcccagcaggctggcctttgtacttcacagtgagggaagcacggggcacatttagaaaccagggctgggggtagggaaagagcagcaaaaacctttgtgccaaggtcactcagcttccgagtgaagcttgaccaggcttccaggccttttgccttgtcctgcctcgaggccagaggcccagcgtctggtccagctgccttcactctcccagggttagaagcagcagggatggcaggaagtggacagaaaacagtcttattagaagcaatggaaatgggtcagagattgcttacatgatcttttctgccccaattctagctgcctttatttctgctcttgcttttttggtgggctttcctgtgagtcttgtggccgagcaaatcagccttatcagaatgtgggagcccagaaagtctgaattctggggatggccctgggaccttcgggtggattcctccatccagcagacatgtcctaggggcctccaagggactcagatcctgcctgggtctctgaccctgccctcaggaggcccattggcacagcagataagacagatgtctaaatagcactaagatgcttctgtgattttcaaactgtattccaaggatcctagcatccttggattgtacctgatgtacagaagagagggaaagctctgctgctccttgcagttgtctatcagcagtaactagggttttttcacaatcacaaaaccaaacaaaatataggcataacctggggtctgaagctgacatgagactatcaccatgatctgtcatctacttttcactttgtcaggattattccaacagccctattatcctcactgattgactttataataggtaaatgtcgtgcttttggattgctgtttatagctgtaaaatactgctttcacctttatatatgcagacttcatataaggttgctttagaaaaacaaaacgttcagtgttaaaaaaatgacagttgcaagggagggagaggcagcaagagagttcagcttacgtctggggagctcatgcaggagaacacatcagcacctcagagaggtggaaagagcagatatttaaggacgggtcttcaaagacaggttcaatttggacaggtcaaaatgagaatgggagtaggaggggctatttcaggggaggggcctcatggccaccagcctgcaagctccccaagggaagggccatgtctgacacatggggaggtggtatatatttgttgagtgaagaaatgagagaatggaggctggaagagcagaggcaggaggaggctagtgagaatgcctcagtccgaatgaatggactgactagtctatcacatggtcagtgatggtagcttaggagaggccatgtgggatggtggggttcagccttgtccaggcttcatagggtcatcagtgctttgagttcctgcatttcccgtgtctctgctggccaaggcagcaggctggaacttcctgtttgaaggggcttgtgctcactcaccacagggccctgcgagggaagaaggtcagggacagaagggaactgggcccccaagcctggaaatccctcttttcctccttcaggagctggttttgagttgagcctcctgctgaagaagctttgatgggtggggcagaggccacagggagaggccaagcagggcagtgggctaacagggaatcatgacagggacgaggtgaggccagccagggatctcatgtgcaaaattcaaggagatgttagatcttgggatcttgcaagcgcttcctcctgcccttgcgggctgaggcttcttgcctggatctattccttgtggcagatgacaggactgggctattgcgggagcctggaagccacagctgaaagaaatatcaggggagggcaggctcggtgctccagtcaggtgcagttgccgggtctccatcctggtagacacccgcagccagggctggcatgcttcctccctctgccaggatcacccccacccctgctcatggtctgagccagctgggaaagggaggtgctgggggatgccctgtggaccccagctcccccaccacctgggcattaccccaggcctttggccctgttgctcctggcccctgaaacaagactggaggagcagagctgtaggaaatgctggattatgtgtgtgtgtgtgtgtgtgtgtgtggtgtgtgtatatgttgtgtttgcgtgttgtgtgtggtgtgtatatgttgtgtatgtgtgtggtctgtatatgtatgtatgcatggtttgtgtgtgtgtggtgtatgtgtgtgtggtggtgtgtggtgtgtatgtgtggtggtatgtgtggtgtgtgcagtggtgtgtgtgtggtgtatgcatgtggtgatgtgtgtgatggtgtgtatgtgtgtggtgatatgtgtgttgtgtgtgtgtgatgtgtgtgggtgtgatggtgtgtatgtgtgtggtgtgtgtggtgtgtggtggtgtgtgttgtgtgtgtggtgtgtgtggtggtgtgtgtggtgtgtggtggtgtgtgtggtgtgtgtggtgtgtgtggtgtgtgtggtggtgtgtgtggtgtgtgtgtggtgtgtgtggtgtgtgtggtggtgtgtgtgatggtgtgtatgtgtgtggtgcatgtgtgtggtggtttgtacacacaggcacacagggaccagcagaatccccctttgctaacttcagctgccgtggtcctgcggtagggagaggggttttcataggaatctccagctgtcctcatttccccatctcgctctaattagcaacatgctggctgggaggggacctgagctcacattctgttctctgccctcatatttttaactctgttttgcgaagagaatgctgggtcactccagtcctgcgggtgggggtggggaacgggtgtggggtccaccttcccttttattttctggcttccaaggttcttgagcccaggaagaataagtgtgtgtgtgtggaggggtgtgagctacttgacctttgtctccctgaccttgtggtgtctgaggaggctgagccgtttgcaggcagacagcactttcctgattggcatatgtgttgtgtgtaagaacagtcagtaggggtagggctgggatgggcggggagaggcctgtctaggaatgttcccattttattttggtctcctccccacccctcactatccagccttgtcaatcctctgcagctcccctcgcaccccttcaaaggggatttctgcccacccttaaacaaggtgggacactgtctctaggacttggcttgtggtcaggggagtgcacagaggattctcttctgcacctctctgagtccctgatgctgaggcctgctggagggatggggaagagaggttggcctgagaccagcttgctcacctgggctgctgtccacctcctggggttccacttgcccttccctcatgcccgttgccctctcccgcctgcaggctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcacctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagtt

SEQ ID NO: 38452 - DNA, 27488 bp, Homo sapiens
agcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggtacggccaagcgccggcgcggggcagcgctgatccggctcggggcaagggggtgagaagggaggagcgcaggggaggtctgcagagtctgctaacaggtccttcctcctattacaaagaaactgggagttgggtgagacaaggccaaagagaaaaaggaaccctcaccccccagcatcagaccccagggctctgggactctgagcgcgtggacccgttttcccggggtgggcggatctccacctcccactggctctttggcgtcatgtgctcctgctgaggtgtggtatcgctcccaggtgtctgccagtgagcaaacttcttaatctccatttagtggaggcggctagcttgaagaggttggttcccagtcgctattttgagtgactttcttgagatcttggagaaagctgaactgtagagtccagccctccaagagcgcaccaaggcggagctcataatagtaatgacagcagttcaacgaataccttcgggcgcggtggctcacgcttgtaatcccagcactttgggaggccgaggcgggtgcattacctgaggtcaggagttcgagaccagcctgaccaacatggtgaaaccgcgtctctactaaaaacaaacaaacaaacaaaaaaacaaaaattagccgggcgtagtggcgcgcacctgtaatcccagctactcaggaggctgaggcaggagaatagcttgaacccgggaggtggaagttgcagtgagccaggattgcgccactgcactccagcctgggcaacagagcgagactccgaatcaaaaaaagaaagaaagaaagaaagagttgtgggggcattgcagatgctattttccccaattctctccaatgctctcaagcactcttgtggataaagaagttgaattcagagccacacagcagcagaaccaggactcttattttctttagcacactggggctttgtaaagagtgactttgttaatgtcctgtctgggttctgagagctgcgtggattcctggggttcagcgaaggctgcaaaacccgggagccggcagctttgtcctctttagggtctggcttcaggccagcctcgggtcttattgtgaggctgcacttgaaactcctttccagagcagccctcgcagttcagcaagtaacacaggactaatgggagctgtaacctttctcctaccagctccccagacagagggcaattcatgacatagttgaaaggtgagtgacgtatgcatctttgcttcaggaaggaagccaagaatcctaaatattccatgttttgggccaggcgcggtggctcacttctgtaatcccagcactttgggaggccgaggcgggtggatcacaaggtcaggagattgagaccatcctggctaacagggtgaaaccccttctctactaaaaaatacaaaaaattagccgggcttggtggtgggcgcctgtagtcccagctactcgggagactgaggcaggagaatggcgtgaacccgggaggcggagcttgcagagctccactgtggcagagatctcgccactgcactccagtctgagcgacagagtgagactaagtctcaaaaaaaaaaaaaatccatgtttcgtatagtaggctctgaaaagtggtagagtttttgtaggccccagaggcaaagggcactggaattttactacttagattcaaaaagcagtttttgagctcatattacaatagatgacaagaagagctggcctttgtaccagacactatgataaattctttattttcgttcatcacacactcccagaaagtgtgatcaaaagaagccaacactggcttacagtcctaggttgtgactagactaaacagaggttgtgacacgtgccagggtgccagcatagaggatgcgacacgtgccagggtgccagcatagaggatgcagtgctggaagctggctggggccgtcagggacaacatcagagagaaagtaacagcttgagctgaaaactggaaaacgattcagaacttgctgggcaagtaaattgggagaagaactttctagagagggaataagctgggcaaagacactcggcttgtgaggatggggtatgctaggggaaaggctggcatagtcaatgccagaggggtccaatcttttggcttccctgggccacattggaagaagaattgtcttgggccacacataaaatacactaacactaacaacagctgatgagcaaaaacaaaaacaaaaacaaaaaaaatctcataatgttttaagaaagtttatgaatttgtgttgggcctcattcaaagctgtcctgggccacgggttggacaagcttactctaaggtatttaccaaaaggaactgggacataaataggatgaatgttctttgcagcattgagtgttgaatgttcattatgatgttattcacagtagccaaaaggtggaaacaactaagtgtccattgatggatgagtagataagcaaaatgtggtatatacacacaatggaatattattcagccatgaaaaggaatgaagttctgatatgtgctacaacatggatggccctggaaaacataatactaattgaaataagctagacacaaaaggacaaatattgcataattccaattatatgaaatgtctagtggataaatttatagagacaaagtggattagatgttactgggggctgggggaaggggaaaacgaggagttattgcttaattggtacagagtttctgtttggggtgatgaaaaggttttgcaaatagtggtgatggttgcacaacactgtgaatgtactttactgccactgaattgcacacttcaaaatggttaaaatcacatttaaaaaattccattctctgttgatggacactcgggctgttactactttttcagcattttgattaaagctgcaataaacattgatacacaaatgtctgtttgagttcctgttttcagttctttggggtctatacgtaggagtgtgctaggtattttatgttttatatatattttactgcaattaaaaaataaatatataaaagactggcctgtgtgaagacctcgggaggtaagaatggctggagcaacagctggatcatgaagggctgggcacgcccttgtttaggagttggttttatcctgaaagcaggaaccatggagggattttgaatgagggggtcataaagttagatttgcattttagagcgatgtaaactgccattaccaggaagaatattagacagaatattcacctgctagtcccaaggatttgggtcagggcaggcctctgtctgtgcagaaacaaagtctggtaaaagggcagttacggaaagggcttatactaagcatatttttctagtgtagctgaacaactcaaccatgataacctgctggaagtgatgcaagaaatatcttgaacgacctaaagtaccggccatatttttttcttatgtctggaaatctcaaaagcacatgctcacttctataattgtaatcatttgatcagtgtgtactgtaaggattgaaatgccaatatgttttgcttccttggtagctgagagataacctgcaaaaacatgttgttcttgttctggaaatggctctttctattacctttatttctccatttatctttttttctaggaagtacctgtagaccaggaatactgggccagaagaaaaaaatactgtctagtttagcaaattgcagaatggacagcactgaatgttggaacataaaatttttaaaaggtggggggctggaactggcagagtataagtggcactgtgtgttgctcagctgaactccatgccctgtgaacaatataagcaacagtcctgctatttccactgacaagagcccgttgcctaccagatgccaggccctgtgcttcctcctgcctttgaggtcttcatgtaaaatagattcttgtcatctgcttggggcatgtttaatgaaagtgatcaggctttctagagattgagatgaaaatataattaacatctttgatttctgtgccatcaaagagctcaaactgttctccagatatatgttggatgcttgagtggttatgaaatcctttgaaattaagtgacagactcagtcctgtgtgctgatgtttaggacagacagacacacacactcaaactcacacacaccaggcttatggggaagaaatcaaagatgacaacagtgtctaattgaagctcctccagggtctggcttcctgccataatggttcacacatatcctgtgttttgaaaacggcaggttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcaggtaaggaaagggcaggtcgtagcccttgtgtgaatgaatagtcatgcaattttgagaaagcataaactctagagggaatgctgagaaacatatcaataatgaaccgttgattgcatgtgtaccatatacagaatgaagtcctcaacattatgaagatctaaaagaaggagaaagaaggaagcagcttcagaaacttgtgttgtggagatgacagacatgaaagtgctatgtagaaacccatgagaacaaaagcatattgacatgtcagcaagagaaaaataacagcacccaaagatcaagcacaaaaatggggtgggagtggtgggggcgagtgtcctagcagaggtgaaactcgatctacgtattctcatagaactttttcttcttggcttagaaaaactgggcaccttccaagtctgagttaggaaaggagttgcaaatggctatgtgacccgtaagatttagttctaatgaaaggaagttccaaaatagaaaagaacaactctagctagaagagtgatccagccagcggctgcccaggggtcagtgtcagaatgaggctggggatgtaacccaggaggatgttctgtacacaagcccttccctcaacatcagaagggctgcaatgaagcaattcttctaggaaaactagttttgcctccaagaagtcatgtctagagttgatttcttatctgattatgggaaaattagagttggtccagttatattcttgttatagtttctgcatttggaataaagatgcagtgtgaatgtagtttatagcctatcataaaaaaatagcatcacctcaaaaaatgtagttatctgaacaacgtctaaagacccagaaaagttcacaaaatgcaatactgatgtaatttctacattttagagttttaaacttgataatatacttttttgaatttggtggcttttcagattagaaaagtggtacatattcattgttgaaaatttgggaaataccaagaaaaaaaaaaaaaagaaacaaaaactatctgtgataactaattaatattgcagcatattttctttcggtctctatgcctactacttaaaaactaaactgaaataatacaaaaaatcctttaatattgtttatatacttaaattgatatgttgagtattttttcatattgttaaaaaatctttaaggataccatttttcatgttggcataatatttcattttgtgggtgtcctctaatgcattttaatatgccccatgattaaacattttgattgtcttaatttttttccaggtattaagaagaatgtgatgaatatcttggcataaatctttgtttatatcatttgttgttttcttagggaaaaaattctagcagtggttttgcttgaaataagaatatggatcctgtaggcttttgatacaccttgctaaattgtttgcagaatggttttaccaattccattttaaccattatgttaaaaaacattttgccatttttatgggcaaaaatgataatttcttgttaatttaatttgtatttttccctgaatgaggtaagcttttaaatacttatattgcaatctgtatttcatgtttgtccatgtcttgatttgtgtttatttgccatggttagatatttacccatattttcttacagttaatttttttgtttaatttttaattcatttgaaattgtgttgaaacttttttcacagtcccatatgggcatttggtccatgcccaaaagactaaacaagggcatgcttgcaaattgcaaaatgaaaaggcttagacatgctacggtagtatacagactcttcgagcaaagattccaagaatcttctggattcaggtttcttttgacagcccaacctattctcttatgagggagctgtaacctcagcccacagtttcctaaagatttcggatgagttcttggggcgctggggtcgtgatcacaggcagtacacctgttttcatggtcgaagatgttacttgattttctcacatgccttgcctgctattaataagatacacagaattagggactttggctatggattattcagacaaacagcctcaaacctcaaaccatctcaagccatgcctacattatctttgtcaaagggtcaaaggttataggagcatttggaattttattttaattcttcacttgcactttttgggacagtgtgcaggtggggtgctggggccaagatacagcagaggccaatcagaactcaggagaaatgtggcaggagcaggaagaaggcagaacaaattctactcgttgaaaggcctcaagttctgggtgattatgaacctgaaccccaggatctagaaatagatgttgcaatggaaatcagtgtcagattagcagggcagatgtttaaatggcccaagatagatgcaaatgctttgactttgtaaaaataattattgccaattgaagccccaaggagtcaaagcagccttcctgtctatatcctccactgtgtgtgccctcccaccctcctataaaagcaactaagggaagccctgggctgccaaatggcaagttgagactgagagggtgccttggtgggctgtaagggtttgactggagaaaggagggtgattttttttttttttctcataggcaccagcaaagagacatctaacaaggagatgaccttcaaggctgtctccatacctagatatttggtaatgctggcatttcacaagatgcttctgaaattagcatttcagacattaaactgcacacacacacacacagatgctaagccccccacatatattcagttctagaactggtggatttgattttttgggaaaagtaaaaaattatttggagctaaagcctgtgaataagaaaacgataggatcttttttttttttggttaaaaaatgaggttaggcttaaaagtagaaataagtagatatgattaatactaggttagaatgattacttcccaaggtgactgctctgaaaggtaatatccatttgggtgtataaatttgggtatgtttattttattcattttatttatttttcatcttgatccagaaaagagtaaggcagacactcctggtctttgtaaatggtctcattacttcataggccttgggtgcatatttcagccctctgattctcaggagttaatttagaatgggtggggtgacagtgtgtgaaaaggtatcaagtcatatactacagcagtgtacttttctgcatgagtgttacgcttcaataaaaagtttttaaaaatttatgaaaactttgaatacaccaatctactgcttaatgtaacccagacactgttagtaatgacttctcattttagatataaagcaataaaataaaattatatacaattatataggatactatactcaatatattttacaatataaaaatccatttatacattattattagagaatggatgcttttgttggattaaatgtttgatttatggagtaactatacaaagatagcttgaaataacttggttgggggaccctgggtcattactacctactgagcatatcccagtcctaagaattgtttggggacttcttacggattgttcctaatcctcacaacaaagttctgcttctacccccattttattgatgaagaaactgagtctcagaataagaaactatcaccaaggccatggagctagtcatttgtggaaatggaatgctcacccaagtagatttacttgatccactaagctttctcaaacttccagcatttgcataacaccacgatgatagtaggccaaaccataaaccacctgtactcttgtttacttaatatttctctttaaattgattcagcttataaactaatcttaaacacatttatttaaaaaagaaactttatgtagttacctatataatttgccaagtatacggctttgtatggctacctatataatttatatatatgggtttatatataaatttatgtggctacctataaaccttatatggctacctgtatacaaactttatatggctacctatataatttgccagaaagtaaccaacactcaatatgctaaaacattactaaattctagctagaagctgttgcctacagaggtctctggacctaaggtgtgttctttctttgttaaaagaggagattatcaagtgttgctaaaaggtaaagatttattaccactaaactgaaatttctctctgtgcaattcactgttatttaatgctatacccaggtgccatctacagttatcttgaatgccagcagtggtaatggtcttgcattttgtgaaacactggcctacaccatagcatttattttcctctccatagctgtgaaattcatataacgccaaacagccctgcacaggactatgtgctggggagtgggaacttcaaatcctacaaagttataacttgcaatcaaatccagtagattattattgttattattaaataaatataatattattgttaatgattgttatatatatagttattatctgtaatgttttaggctttatagaacattttcatattgttgctgtactatactggcaaagcatagccaggcctgtgaataaagatttctggtcgctattcagctgggtgaactagattttgcagtaattctaagtttactttatactgatacattagttttcttctggagaactcagtacatttttaaatatattatttcatttcatcctccctgcattccttccaggtagggagacacagttgtacaaaacttgatttttaaaatgaggaaagcaatgcttaaaggggtgctttcattttcatttggccttacacaggtttggagtcaggaccaggactaaaattacatcttctgataattaagaaatgacagtaatgttacagctaggagcagcttttctgatatagctggcacatattagggtgcatggattttcaaagccatgtctgccctttgctcctgctacccctgcagagtgcacggcctggagatagagggcagggactgtggcgaggccaccgcccagtggataaccagcttcctgaagtcacagccctaccgcctggtgcacttcgagcctcacatgcgaccgagacgtcctcatcaaatagcagacttgttccgacccaaggaccaggtgagaggttctgctgcctccatgggtagaaagcagtcacccccagatcagggggctcaggtggcatctctgatgacctcggctctgttgttttctggggcagccctctggtagctcagatcacaagcagtaggcagaaataaagcccttcccttggaagcattgtttgtttctttgtttgggggactcttgaatttttgcccttgagcatctaccttcctatttgtgtaagcattctgatgccagtagggtttcaaaactgttctgcaccagtgtctttttttcattccattctgtaattgcacatggagtccagaatttttacagtttgcagttgtatgtcagattccaattgtgcaagttggcatgggtatggagatacacagactcaaatgatcagccttaatggcataaagctctaaggattcatcataaaagcagggtttgtagtaccatatactgcttttaccatggccataaaaaaaataaattatgctgtagtccttactgctaaggaggctgaggtgggaggattgcttgagtccagagagttgaggctgcagtgatctgtgatggcaccattgcactacagcccaggtgacaaggagtctctgtctcaaaatatataaataaagaaacaagcaaatgcataaattatggtcaacataaatattaatttgtaagttgcataaaataagtattcatggaattagtgaacatttaaatcaaacataatgaggtcatcaaactcaaccaccttattaaacatttgagaaatgggaggcttagaaaggttcagtgatgtccccaagggcacatgccttgtggcagcttaggattgattctgagtccttgttcccttcattccaccatgcagtttctgctatctgcaaggctattgaaaacttctgagtcactgtgacttctattaaaagaacaagagaactactttgaaagattgtgtgtggggtggggtggagcatggaggctatgtctaggaactaggcacacctaaccactgaaaagttggtgtgccatgtgttataacaatgtctatttccttatcagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggtaacactatgcccctttggatctttccttggatttgacttcttttttaaggtatgagagtctttgacattggattagattattctgaagggtgcattatttatcaactctgtaatacataacaatttgatttttagatttattcagcacttaataagtgcagacttctgtgtggaggatacaaatgttgatgggtcagagactgtcatcaaggaggcagttcagtatctaaggcttctaaggagaattctgagttgacaggttcgttgttgagtcacattttcttgcatagactacatgatctgtgtgggccatggaacaaagaaagtgtgtgctcctgtcttgttaaaggatggtcttactgtttagtagacggctctcttggagaagacaggcatttactgcaaggctgctgggtgagggttgggagaggttgttgcccctaagcttcatggcactaccctgaaatgcttgcagtgccaccttccatctgccctcagatgtttgcgtggtgacttagcttgaacagccctgaggcttggtttctgggattccacaggattctggcagcaaatttacctttgtaataaatggcctttggctatttaacttgattctctccctgggcttccatgaaggcagaggttggtggcctagaggcatggtgagtggccaccagctgtggatactcaacagaaaccctgacccacagctaggaattcaggagctctggttgtgcctcaaatttatgttgagaagggagaggtaaaggggaccatatagtggttcttacgtctgcccatttcctccataacagggaaaaatggaatcaaagcaattgagttttaaccttttatcctcagaggagccaattatattcttcacttttgctgtacggaggcaaaactatgctgaaagagaaataatctaagaatttgattcccacattcaaaccagaagatgtgacggctggtttcagcttctgcactggcttctgcatgactttgagcagccccgctaagtcccatttaccttgcctgaacaatgagatgatcatatttctgcctagggttaccttaagggtctgttgaagggtcagtttggataatgtaatttatgagatgtataaaagcaatatcaatcgatggaggataataaaagtacgcccaaatccactgctaatgcttcatataaaatactcattgctccaaacttccaagggtagcgtttcttctaaagatggtggagaacttcctagtgtgaggcgggtggactgtgtgcatgtcccccaaggtcctgggttgggcatctctcagtgcttctttgtgacaagaaatttctgcctgtcctgctcctgtgcaccatgggccagcctgacttagacaacaggaaaataatcagtgtttggttgcctttgaccatctccttgatattcatcttccaccagctatggctaggagagccatttctcctgagaacgttccttctcaggaaaagagaaatgagtggggagggttttgaatgaatacttgtgttgcgcttaagtatgttgtctcttctatgcctcacggcagcccagcgggataaagctatcattcctatcttacaggagagaagagagaggcttggggaggtgaggtggcctgccctaggctataccacagcaaggaggggctgggttttgaaccccaattgtacaaggccagaggaaccctgagaattctagggcatatgtatggggctgggacagctggattctaatccacctgcttccgcaagtgaccgtacaagcctggacaggtcaccaaactcgccgaggcatctgcttcttgcagttgtaaaacacgggcagtttcaatgactccctcgcctgatgggagctgtgagaatcaaggtcgatgacaatttgtggaaaagttctaggacattaagtaccacagggaggtaaggaagagtttcattcctgggagtttggctcaggtaccagctttttccctatgatcgactttaagctttctttctcccctgtgtgatttgtgcaccgagggtcatgctgaagccatttccaccccaaaattctgtgacagtaagattcggatgacaggagaagaggagatggcccagagtagaacttcagatctcggagatttctttcaattgagtcttactctaaaaacccgtatctctctctctatctctgagtgttccctagttgagaacattctgtatgtgaagctgggcggtaacacaatggtggctgagccggccttgtttttagtaattcacccatcatcgagtgggttgctgcccctgtgtggcatgcgctgtgaatagacacatgagaacaagggttgaagaaatgcacttgcttctcctaaggagctcagtgtggtcagatagtgaaaagtcacagcacagtgagatatggccaggagggtggcgagcagccagacgtggggacgtgactaacacctgcattgtggggtgagctgaagcatggggcacccagggctctggtctcaaaccctttctcatttgtctgcactcacttttctgatctgttctttctttccttttttttttttatttaatcatctgtttttaagaccttctctgccctgaggacccctaactatatccttctgccagagctttcccctgcttctccatatctccatgtggatgtctaatccaacgtcaggatgtctgaaattgagggtcaggtatccaccccaaagcctgctgtgctgtctcgcccatctcagcacacaacagctctgacttccgctggctcaggccccaaactgcgaaccaccccttgttcttctctttctctcacatcctaggttcctacagttgacagatcttggtggctgggccttcccccccactcccctctctgcccggatgcagtcaccactggtgctgcagcagcctggcttcactggcctccttgccccacccttgacccagccctgcaccatccatgggctgttctcagcacatccatcaaggtaaccctgttgatgtaagtcacatcatgtgatttgtctgctcaaagccctctcatggttctccacctttcttcaagtaaaagatgggatccttatggattgcctggaaggcccaacatgacctgcaccccgccagctcccagccccttctcctctcactcccctctgctctcttactctgccccagccatactggccttttttctgggccccagctgtgtcctctgcctggcatatcttccctcacaggcctcatggctcactccagtgcctctttcagtcccctgctgcgggcttcactgaccccgctcacccagccccccccacagcacacaccccacctaacaagccgtgtgtactcaggtatcagtgtattgtctgtttcccctatgcaagctccttgaggacaggggctgctgtatctccagcccctaggagagcccctggtacatagaaggtgtgcactaattatctgttaaatgaatgacctggacaaagtattgtccaggagaaaggggggcactgagggaggggtacatacacagggctatgaaggtatgagagaatggccatcttgcagtgctggggctcaggagaggaggggagctgagagcacaggtacttggtgtcaggttttggggagtctgggaagaatttttggccagggagtgactgaatccgatttgcatgatacacatttgcctctgccaggagcctggagaaggattagcgcaggcggggccagggtgcagctgggagagcaggctagcatggaggaaggccgaggacctgcatggaagtttctggaaagcagacccactcctcatctcggaagctaccttctcagcaactgtggcttttcgctgcctcccttcatcatcggcactccccacacacatttcttacacctcacttctccctgaagccacagtagagacaaccaccctacctgccacagtcagtgaccgtttctcagtcaccaccaccccgctctgaggacacatggacactacttactgaaacgtttctcctttagctgtactgcccttgcttctctgctgtttgtcctcatcccttacttccaaaagttctggccttgacccttttctctcccctccttggtgatcacactgtctcctgcagcatcgccctctgtcacctgacataggtccctcaaatgtccacccaggactccctctggagtgctgcaccacagttccaactctttgttggttgacagagaaactcagacttatgtgctcccaccccagcccctacaccctcaccccacctccctaaactcattctttctttcttttttgaaacagagtcttgctctgtcacctaggccagagtgcgctggcatgatctcagctcactgcaacctccgcctcccggattcaagcgattctcctgcctcagcctcttgagtagctgggattacaggcagacgccaccatgcctggctagtttttgtatttttagtatagacagggttttgccatgttggccaggctggtctcgaactcctaacctcaggtgatccacccgccttggcctcccaaagtgctgggataacaggcatgagccactgcgcctggcccccaaactccttctgttgacttcacagtttctatccagggcagcatgtttttttctttcacccaggctcagagcgtgacagtcggccctggctcctccctctgctgtgttcctcccagccccagccatgtcggctcccctttctatccttagccaccagccagatcctacgtttgttactttaagtttggaccactgagtgctccctcctgaatgttgccacagccaagcctcctagagctgatcagcgtgatctctcccgctctaaaagtttgtaacaaatcatcagtgttgctgacttgctcagaagcctttagtggctctccatgtcacaaaggtccaaacttcccactcaatcattacattcctctgtaaccttgccacagtctgcttttccagcctttattaccaactgtattagtttattttcatagtgctatgaagaaatacccgagactgggtaatttataaagaaaaagaggcttaatggactcacagttccacatggctgtggagccctcacaatcatggcagaaggtgaaggagaagcaaaggcacgtcttacatggtggcaggcaagagagtgcgtgcaggggaactgccctttataaaaccatcagatctcatgagatttattcactatcacaaaaaaagcatgggaaagacccgcccccatgattcaattacctccaactgggtccctcccatgacacatggggattatgggagctacaattcaagatgagatttgggtggagacacagccaaaccatatcacgaacgaaagctccaaactgcaaactggtgtctcctggtcactgagaatcttactcccttccctacttaaaactcttgacattctctaaaagcctggattaaaagccccctcccctgggaagcctgctctgattgctggacctcaaagcgctccctcccttctctgaagctaccgtgtgctctgagcctctcccataccaggcttgtcctgtttgaactggtcacctccaggtgctgtaggaagactttcctgggctcatcagtgcttatgactcaatctccagtagttttttttttggaatagaaggggctctggaagtatttctttaattaataataacttaatttcctaagtggaacccttatttctctccttttataccctttttatgtgtttttttgtgaccatagtgcccccttgtggagaaatgttcacaggacaggctgtggctgtgctaatccgctgtgcccagttttctggactgttgaaaatatgtgcttgagatccattttatgatttacgatagaacaaaacccctgtgtcatatatatcaagaataacacacactattggagttaaaattctgagctcatgatcatccaaggacaaggcagtttgctttttaactccaggtctttgccttccgccctcgtgtggtgggcaattctctccgagggtaagaaggtcaggactataatcaaatgtcctttgcctcctcagcgcccttccttcttattgctgtcccctctgcctggagtccccttacccttcttttgtgcctctcaaactctctgcccttttagactcagcacccatcttacctattccttataaaacttcctgtaaccagaccagcctggagagtcatgcctctgaatccccagagtaagcattgccagcacagttaaaccaacacatgacgtgctgccttggagtgctttttgtgaatatttctggcatttaaaaataaaatatttatctttagaattccatgtatggatggcctatcttggctgctggattggagggccttggtccactaatgcggtttgtcgtggaaactaggctccactgacccagcccacagctcccctggctgcagtgcttcgtaaatacttcagcaaaaatcaaagaggaatgaggctgctggtcctgctcctgatgtgtccgtatctggctaggggagacatgcacatactcagtgacttaaggctcttgatccatataacttcaggcaggcactaagggatctgatataatctgaagtaatgaacaatgcccccatctgtccccctccccactttcacccaccccattcactttgtgcaccccaccccccaccaccagtcaaagtgggatcatcagggagcctccctgagcgaggcgagtttccatgacatttttacaagtgagaggagagggaaatctcatctcaggggaatcaactggcatatcaaagccagagagagggaacgccaaggtgtgtgggtatcacttggcagagcagggctgggggagaacagaaggctgccatcactgatgtgggtgacatcgttaggtgcgagggctcctgggaaatctctacacacgtgtcaggggcagggcccagagatgctcatgggaatttgtgctttgtcccctaggattcttgggatgagcttcttattggtgacgtggaactgaaaagggtgatggcttgttccaggtaaggtgctttcctgtccctgtggggtggaggtggggataagttcgctctgctctgtcccccttatgatgctctgtgtgtgtgtccagatgcattttaaccacagtggacccagacaccggtgtcatgagcaggaaggaaccgctggaaacactgaagaggtaggactgggcagacggggctcatcctcgggtttaggtgccgggaacggaagcaatatttgttgcttaatgtttataagaggaagcagtgaaaacaccacacacatagtcttgaaactcaagagggtcccattaacgagataatttgggaaacattccctggtgttttggacaccaacatgtctgcttaaacaagtacttttatttttcatttagaaatcataattcaaataaatcaatgtttaaaaattgcttatgcattttgacaaattttattacgggctaagtattagatgataccaaaaaatgtactaggtgtcctaatggcattgtggttgtataagaaatgtcaatatattttagagaagctgattgaaatatgtgtgtaggagtgaagtgatgtgacatctggaacttgccatatattattttagcaaaaagaaaaaaaggataaatgagtacattttaaaaatgtgtcacaatcttcataaatagaatctgggtgataattacgtggggtttattgcactattctacttttatgtttactttaaaatttcttaaggaaaaattttaggtgaaagacacagtaccgagaatcattttaaattgtatataaagatagtcaagatgctgtgttgattttacaaagttgattataaaatagcactatttactttttcatttttatttgattttactttttaaaaaacatataaatgcacatgagtagataaaaggctgaaaggatataaaacaaaatggagatactcttttggtatagtcatagaattatggaaaagggttattctcatatgcagtctctaaactttctataattactctgcattactttcgtgaaaacaacaataacagtttagcatacaagcacttcagagctgatatctgccaaatttgggacccaggaaattgctgaaactctgaaaatgaactaagggtgcttctcttcattggtccctttgacattgaatgctgagtcacaggccaggtgtcaggtctcttctctacagcccctgagacccttccttggctttgtgtaagacccttccttggctttggtcctgacttggcctccccaggtgtatcttgtagaagggagggccctgggaaccttgaggaaggaatgcagttgagatgtgactatcttgtatccaaaccatcatgaacgagcgcatgacagagaggttgctctaggctttgtggagcaggactcattccctgtaacgtgaggttgtctgcctccccttccttccacctctcaccaacctcatggcctttttgggggccaatgattcagtcatctttgatcaacaaccaatccctccctgacaattctactgtcccagatctggccccatctctgggcaagctgaagccctgggctggagggctgtcatccccgctgtcacctcacccctgagcatgaggctgtggcctgacctctctggccagcacctgtcatcctataggagataagtcccagagtgtgggccaggctgcagcaaggttagcaggtggccatgagggcctaggccacctggcagagagacagtggtcagcagggaagtcaaacagggtgggtggagggaattacggagaagggggtttgtggtactcaaggaatccttaggtggatagcaagcagctggtctctacctggctccaacagcgttgggtgtgatttgcatcaacattcaaagagggggctacagaccagcctaagggaatcccaacattttgagagatgtttctcaatactcaaaacattaacaacttttctgtaaaaagctaatattgtggagcatttaagattggtatatttcattccatgtaactttcacctcaaaaaaaaaagcaaataatggtttttactctaggtaataatattcaagctgaactgttcagagttgaaatgtactggtgtctgcaacttacttggaaatgcaaaaagacaatacagtggattgatggatagatacatgtgtgataaagaaaacatagtcaagggcaggcacgatggctcatgcctgtaatcccagcactttgggaggctgaggctggtggataacttgaggtcaggagttcgagaccagcctggccaacatagtgaaactctgtttctactaaaaatacaaaacttagctgggcatggtggtggtcacttgtatttgcagctactcgggtggctgaggtaggagaatcctttgaatccgagaggtggaggttgtagtgagctgagattgtgccactgcactccaatttggatgacagagtgagactctgtctcacaaaaacaaacaaacaaacaaaaaaacaaatatatatagtcaagtgttaagctcagaattcaagcagcgggtaaatgggtgtttgctgtaaaattatttcaccatttgcctgcttgagaattttcatagtaaaattttggggggaaatgtcactatatgtgacagaacattgatgagaggaccagggttatagctattctttgaaatgcgctcactcaccatcagaacaaaccagaattcagtcttcctgttttccatggccacagaggagctactaggggcagaaagcagggtgggccagcgggaagatcccgggctgggagtcaggagacctggatgtgcagcacaccgactgctgtgctcctacccctgcccgcactcagaccctgagtgttcttccctataaaataaaggaggcaggacagaaatagatgattctgtgtaaatcagccaagtggtttggggaattggctgtcatccttttttgtccatcttgttctttctcttccccctgtgtgttgctcggtgtggggcatccttccctctggatttagaaggtttatgctcttgcagaaacagcctccgcaaagcacttcacgtgtttgggcttgttctctgcatcttcagtgccccccttcctccattgggagcctgtgtttatagaaggaggataattgaccctaaacacagagtgagggtgggaaggcggggggcgcaaggagccagcacacccccctgatcttccgcaggctttgtgaagcccaacaatctggccctaattgcttctaataccccaggagacagtgcggccagcctaggtgtcttctcctatctcttactgagatttaaattgccatggatgtgtaatttatgttcttcccaagacaggtggtcataaatcgggaagagaaaggcctggccacatcccataaatcatgggaagggaagcaaacagtggtgtccacagcctctctgctattgggcaggttgctcagagctacaccactttctgcctctgggcactcatggtgcccatggctggggttgcttctggaatgccagcgctcagctgggagacctctgtgcctgaccagccctgcctcctgatgttagtcacccacaggcagagcccgcggtggtacagcagtgggaggaaaagaaatacagaggcatagggaagcctttgtctgtaaaatgctcacagcgggaggcacagtggaggcatgtctgctaacaggaagatatgaaaatggaatttttcttttctttcttaagggaaagtgacgtacacactgatccccatggttgaaggaatggctggagtctgccgttgttgcttccatgacattttgcccctaatggaaagaatatagcacagttactgcatgggtactcaaaaaaaaaaacgttttgctggatgcacgaatactgtgacagtaatgacatttgccagcagccacttgtgtcaggctgtgctctgctgagctaaacacagaatatatagcagtggtaactccatgggaggaggcagactctccaccctagtctggctctgtcacctcctaattgtgtgacattggcaagtcgcttaggctcttcaagtcacagtttctttattggtataaactggacttgtaatacctcttctggtagactggaataaggcaagatataggatttttatagatgataaaatactgtacacagtgaccatgtaagctgcggtcattgagagtcactgtttataaacttgacaccttctgagaggaggagaagcctgaccacacttcttcccatactcagaggctgctttaaatgaaacctaacacgaacttgcccagcggccagcctctggaggttcagtgtggcacctctcccaggaacgttcacgatgccgtctaattcttcaatttaatttaatttaatttaatttatttatttattgagacagagtcttactctgtcacccaggctggagcacagtggagcaatctcagctctctgcaacctccgcctcctgggttcaagcaatcctcatgcctcagtctcccaagtagctgggattacaggcatgcgcctctacgcctggctaatttttgtatttttagtagagacagggtttcaccatgttgaccagtctggtctcaaagtcctgacctcaggtgacgtgtctgccttggcttcccaaagtattgggattaacaatgctgtttaattcttaacctggccatagagataggcagtcatgaggcctcaggaatggcttctgccgctggtgacttatggtcccatgaacgccagtggtgggatcgggcagtgaccagatactctgcctggagtcatggcctggacgttgaccagtgaatgcgtaaaccaggcagggtaaacaaggatcagccctctgtggtgcacagcactttaacggtaacaaactgtttccatttacattgcaccttgtaaataatagagacctcggttttaagctaaataaagtgtcttgggcttcctgctcattagaatagttatgtttcatgttcatttaaggagaaagtgcactaaggaagattttaaatgagttttaatttattaataccaacaggaatacatatatgaaaagtcacatatttaaaaaatcgtagaagacccatgtatgaaagaatactgtttcagagtgttgaacttagtgtgcgcacgaattcatagactgcttgcaatacctcttagtgccacaaggcgccgctagtgacctcgttgagtcttcccacagcctggaggcgggcttccgcagcagtagcaagaggaggtggtgcaggaggcggtgagagcccgcagcaaaaccaggcagctgtaggaaagccctggcaggccggcccaccgagaaccccttttccactcccatagctcttcccgcttctactcctagacagcggagtggaccgccacctgtgagccggtgaccacacctgcactttcacaaagcagctccctcaccccgacctgtgcagtttagggaggctgtgccgagaggggcagccgctctttacggtcctctgctcctcattacctggtgggggagtgagtgtgtctgtgcttggttggcaggaagggataggtgaaaaatgtaagtggctagaaattggtgtaggtgactaaattgtgagacccctcggttcttctcaggcctgtgggtgtactcaggaggatgtcgacgaccagggttacatcctgggtgggaagagtccactagactctgaagtcagccaggcctgggctctggccccagctggatcctttagatctgtgatctcaggcaagtctgttactccccctgagacttaactgtaaaatgaagaaaaggcaaattcccacataagcaggttgtaaggattaaaaaagagaacatgtgtaaagttccttataaactatccatgtgtgatgcgcagaactccaactctcaatttctccccaagataatgagagtctggactcttagactgcagagcttggcagcaacggaaacacccatacaagcagctgatgtgtcccctgttcctgaagaggtcaccctctgacagatagatctcagaatgtcatgaatgttgcatgctgaaagaggagagccaggctaggagagatgcctggtttgtcaggtccaagggcattgcagaaacctgattacagagagaggaaatactcttggcaaggcagggaagcctgcatcagcagcttgttattttcattcatccattcatttgttcattcattgttcaaccaacattatttttgagtggttacagtgtatgtgtgaggcactgttccaggccatgagaatgcaacagagaacaaagtggacacagtgctgcctacaggatgtttacagtctggggaaggagctgcaggtctccagaaggtggttctagatttgactctctgttttctccttaacaatttctgatttgaagaacaacattagaaccaagttgttgcagtcactttttcacttttttttaaagcaaggcagaataaaatgaatgatttatctaaaatgttttaaatataaaaatgatgtaaaattagggttagattaaataaaaaactgaaggttaacttcttcccagtggggaaggtgggggaatcttgccatgtgagtcccacacatctgctcatgtaccctctccctgcgtcttctttaattttctgctggacaaaaatattcatatttatactgcctctgacagacggttttactcatgagcatactaatccagccagcaaacaatggtgggtcacaggtgatgtaggaggcccggcattgggcgtgagcagtacaagggcattaatcacagttcctgttctccagggactctgccttgtagaacagacaaacttgtgccctgacattacaggacaagatgtgtgagtattggaggggcaaagagaattgaggagggggaattactcgtagctgggggaacctgggcttccttcctgggagatgtggtgtttgatttgggccttgaggcaggtacaattctaaagcatggggacctggaggaggagcatcccacaggaatcacagaggacttaccgagtcagtacaatgcaaagcaaggtgaaatccagcagagagctgcagaggcacaggtaaggagcagatggcaacaggtctgaaaaagcaggctggggccaggtagagccctacataccaggctgaatagttggaatgttattctttaggcactggagagccacggaaggtttgtgagcctaggaatgataagaccagaacacaattaaaacagtgatatagtgcagtgtcaacaatgaattgaaaacaggtagagaatgaggaaaagaggttggttaagaagttattatgatagtctgagcatgctggaagcaagatcgtgacagtcggaatgaggaaaagcaagccaagtcaaatgatgttgtacaggaagaaccttggaactcggcagctgcggacaggctgtgggaagagaggacagtggtgtaaaggatgggctcccagcccaagtgacggctaggatggtggttcaggtgacagacatggaggagacaggaggaaagatgcctagggcaaaggaagatgataaagtatgtctagacacattgagtatctaattttttttttttttgagacggagtcttgctccattgcccaggctggagcgcagtggcacaatctccgctcactgcaagctccgcctcccaagttgatgccattctcccacctcagcctcccgagtagctgggactacaggcacctgccaccactcctggctaattttttgtatttttagtagagatgaggtttcaccgtgttagtcaggatggtcttgatctccatcctggttgtgatctgccagcctcggcctcccaaagtgctgggattacaggcatgagccaccacacctggccaagtatctaacgtcttaatgccgaaagggggaacatgaaggtagagaaaagatgtggggatgtggccattgcttatgcttctgtcgttgtttgctgggcaggctgttcactgccccactccaggaggcgctgttctgttgagctttgacgggatggtgccctctcgagctgtgcgtgcggaggccctgtgtgggatggaagccacgtgctggttgagctcttgcatccgcttggctgtgactcatcatgatcttttcctattgcagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatatcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttg

SEQ ID NO: 38453 - DNA, 638958 bp, Homo sapiens
cgtttttgttgaaagagtcattaacagttaggagttgatggcagtttcaataacaggtcattgccgagaaaaggtaagttttaactttatattgtacatgaaatttaaacttgaacatgttcggcagagtttcctacattttggtgtgaacatataaacatttctacaaaatatgacgcttttacctgtgattaaaacattggctggtttcctttgatgtagaaaagaatgttcttttcatatttgcagctgtcaaattccaatgtcttttactaaaatgttataataataagatgatttgctaagattttgtactaaaatgttaaagacagaataagttataaagttttagtttgaagtgcatttaaaaataactactagaaataatgtgagactttgcacctttaaccaactgttttataaaaatatgtattgttcaacatccagataaggaaagagaaaagggtataacaatgagaaatagcttgaatttcagtgtgaaagatactcactttaaagcattgtattaatgttagcactaaaaacccttaaaaaggttactatgtagctaattaaaaagcaaggagcttttaaaatgtaaaggaatactgtctatcatgacacttgaaattttttttctaaatttcatttaagatatagggtgaaatgagtgtaagtttctaattcataagcaaacttttatatttaaaaaagaagtcacagctgatttcattgaaggttactctgagaggagaggcaaattagaggtatacttttgttatttatgtaattatataattttccttctttgaaatattccaaaataataaaccttagaaatgaaaaggatttgttagtcctaaactgacatgtaattttcttttatattgacttcttgcttttacagaatgtctttgtgtgctgtaacatatgtgcagaaaacatcaaaatattgctaatctcagagacaaatacctaaaataaatctgactgtagatttttgaaagaattttaataacagcccaagatatgatccattcttccctaatattatttttattgtgctgctggatgggagaagtgatggcccccacaacacctattttttgtgttattaaaaaatggttacagggttgataagtggcaacaattttcttttcttttattgtcttctattgaaagacacacataaatgttttttgacatggtcaatttagtaggaaattattaggcatagtagtacactccattttaagacctcttcaattgtcaatactgaagctagctacttgttgactattaaaatgatcacagaaaaatagagattaggacttggtgttcaatacattttttattgttagcatgtaagaagaccctggtaatatatatttgctttgatattgtgattagattttcaatttgttgcatttcctcacaatggaaagcattatttaaatctgtcttcaatatcgtggttctgaacctctgcatctatagaagctgtataattctgataattttggttgatatgttattactttctttcattttattataaaagaatatcaaatgaataaacacatgcaatacttacaccttagcaagaatgaatatgcagataaacatctggcattgaggaaaagtccatgaaaattttttaaattgtttaatgcttttaaaaaagaaattcactgtaaaaatgagtgtttcttgcagaaactgttaaattaaaatacacatattttatggaatatgtgtaaaattaagaatgaattgaagagagcttgatatgaatttagaaagatcaatgagtaaagatgataggtaaattaaaataccttcagaattgtttgtaaagagcagtaaggtacaaaccaaattttaagacagttaattgcaaataagttactatagaattctattactttatatgttttaagtggatgagtcagaaacaagttttgatgaaatgaaaataatacggaagattttatttggaaagtcatattaaagctaatttgctcaaagaatgtcgtgcttttccacttagggccagcattcagtaagattcagaaaggagaaactctttccttgatattcctcctgttgctcctttttattattctcttctggagcggcctgctctgctcctaatttagagtcccatagacttggtacctagaaagatagacccttccattcactggctccttccattcaactgaacttttaaaatgtactcatcccattttccagcacttagggaatctaataaaaataatccacgcttataggagaaggctacagagctttgacttcctagccaggcctccctttctccccccagtggaattttaatatgtttcctcagcagacagggcccaaaggattagctaaatgttggatctcaagtgaggagactgatgccatggtaaatggttgggggaagactttagagggagagtgttttgttaaccattggtcctgcctgtggcatttaaacacagaatttctggaagtgtctcatatgaaggatccatcccagtgatgtatccatttctttaagatagtcctgaagaaataaacacctttcttgcagcaggtaaaaaaaaaaaaatattgcactacattttcaggcaattttgatattcccatacacttagaaattatttaacataattagtttttaatagatgtattttaaaagtcattgaacactctgaatttaattctttggatactaaaagcatattttttacactgtacaataaatgctacataattagactttaaaatgcccttgtaagtattctaaatttgagcttagagtgtgcaaaacttctttgttggcaaacgatagaaaatgagttcaaactagcctaggcaaaagagatattcttttatgtgtgaaaagtctaaggatagcaaagtcaggaatggctggatccaggagctcacacaggattatcaggagtaggtctcatttttttcattcctcagctcttcttttcactatgctgtaagcagtctctagtggaagctctcacgaaattgtcaagctcctactgagttgatcctttcagcaaactgtggggaaagaatgcttttccccagtcaccacagcaaagtgtcagatttagatctgatgggactgaattggatcacatgaccatagctgaacaattactgaacttgggtgcagacagcatgcgtgaccatgcctagctcacaggcccactcctgcactgggggcagctacagctgcagcacttgggctctctgctaaaaagaggggtctcctgatgtagaaattaaaatgctttccccagaagaaaggacaaaagcctcaaaattctactacggagtcacgtatggtcacattttaaacagtcattatttcccaacttcttcaaattccataattgtacaaaaatacagttttaattgaaaggcggatctgattgaaacatgagtttgaattaaactaaattttaaaatatttttcaacagctactgtatgtttgacaactcctcacaacatttgccttctaaaagcttataatccagagtgactattattttaataattatgatgcaaatacaatttgtcaagtaccataagaagatacagagaatgctctattagagttcagaaattcatccagcatttttgcattcctgttatttgccgagccataaactagagaattttgtaagtgttgtatcatctgatcacatactttcagggagttctggacagttttggaggaaagttttgtggtagttttcagggaaatctagcactgggaagatgagaaacattgcaagggacaggaaggaaatatgtcaaggcacaaaaacacggcgtgtcagagaattccaaagtagtgtgaattctccagttttgttagacagaagtatagtaataagaggtaggccagaaagatagtgtgagatcataaatagagtagacctggatataagtaacagcagggtttttgagcaggggagatacgtaattggatgtccacacttttacatcttgatgggttgtctgtctagggtcaggatgtatttgtttcttccatttatctcactgtgaagtgacattttctttgcagaagagtttgaagtcagtggagatatttctgtaaggacaggcactgacttacctgttcaggtgcctgaggttcttattcaagttatggttataacaatcttttttttcatttgatgaaggccttttgtttgttttgtttgcttttaatttaagaatagatgatatagtgagatggttcaaaatcaatataaaaccaaaacacaatgtttttagataagctatttcttatatttttatttctatctatcccatttatccccatcttaatccaacgtaaccacttttcatgtttaatatatatatttatacttcacagtttatgtaaaaaccatatatatatgcacatctatgtgtgtatgtatataacataactgcacgcacctctccactttgctttttttcttttagaaatatagattagagatattttataacaaaactaaggaactaattctcttttttacagctgtatactattccactatatggaaatatcatacttaatttaaccagcctcctgtaaaaagagtgatggatgttttcaagtttttctaattcaatgaatgtccatgtaattgtttctatttgaaaatctatctatctatctatctatctatctatctatctatctatctatctacctatctatctatcatctatctatctatcatctatctatctacctatctatctatcacacatttccagaaataacatttatgagacaaaggataaaataattttgatagttgttgccaaactatccttcatgttatttgtaactttttgaacttccaccagcacttaatgagaatgcttgcagaagcttcattgctttttcaagggattgtgttgccaagctttgcaggttttgccagtctctaacaactgcatctcaacacagttttattgatatttctgctattatggttaaaattgatcttctttttaaaagattaaaggtcgatttgctttccttgtaagaaaatgtattctttctcagctgtataactaaagaccaaaacattagtgactttagtgacactcaagccttggagtgagatgtcaaaggaagcaaagaactagagatagcatatatgaaatgctgtattccttttcttttttttttttttttttttgagacggagtctcactctgtcacccaagctggagtgcagtggtgcaatctcggctcactgcaagctcggcctcccgggttcatgccagtctcctgcctcagcctcctgagtagctgggactacaggtgcctgccaccaagcccagctaatttttttttgtatttttagtagagtcggggtttcacggtgttagccaggatggtgtcgatctcctgacctcgtgatctgcccaccttgacctcccaaagtgctgggattacaggcgtgagagcgcgcccagcctaaatgctgtattccttttctaaagcttgaaatagacagtagcttaaaagggggataaaatatgaatgttcaagtgaaggaggagaaaaggaatgaaaataaaggaacccaacaaggtctcagaggagactaagacagatgggtataatcactggctcaagtagatgaattaaccttaaacagaagagagagcactttaatgagcgtgaatgcagatgaattggatataagtaagattcagtgaggagaggaatttgagggaatacatgcttcatagtttctatctttgcctaaatggtgggaaagttcatctgatgaaagcattttctgcatgtcaaaaactagacagaatatcttattttaaaacttatccttgtcagtaacacacaatacaattgtggattttgcaacttattttttatcttttgctggttattagtccaattccattcaactccataaataattttgaactctaagtatactatgttgtcctaaggattgctggagatacaaagaaatagatatgctacttagccaatgaaaactgtttagtaggtaagaggtacacaaagataagtatctaaatatcaattatacatataagtccagtgccatagaaatattatagaatataccattgacagaatcccaaaggtcttcattttgccaaatctaatagccatttatgtatctttatattattcactgtctgagctgcatttgatgctatcgaaccctccttccctcttgaaactctcttttcatttgacttctggaatacttttttcttccagttttcctccaaactacctgaatgctctttctgtatcctttgctaacactttctcatcatctagctctctaaatgttggaatgtcctgagatcagtctttggatttctacttgtcttctaggtttattcctttgcggttttatttagtttcatgaccttaaatgttatctatatactaattatatttcaagaccaaatcttttctcttagcagtaaaactataaatccaattgcccattcatcatctccacttgagtgtctcatagagacatcaaagtgagtatacagtactcaaagcaaatctcctaattactgcccacctgtcccccaacccagcctgcttctttcctttttgcctccaccttagttaatgacaccatattaatctctcttttcaggacaagagtctaagaattatccttgattctactctttccctactacttcctacccaaagtttcatctagtttatcagcaataagtagagcctgtaaaatataaacttacttttcattatactgttcacgtgacttttctcaataatggcccttaaggtgttatatcttttttttttcagtctaatacttcttttattttttatttttttggttgtcaatacaatgacttttctaaaaaaatcttgccaagtgaatacagcacaacatgacacttggatgaacatcaaactttagataaaacacacacaccaatttactctctgctttcaagttagaataacaagaagcatatgaaacaatgttgatttgtacatgtttgaattaattcaagaaggttgaagaggtggcaatgtttacaaccttttagtcagactttttgttgggcccccggctccaggtgactcctgtgctgtaatttgttattaagtatactttgagggcatgaaaaccgttaagtctcccaatccttaaaaatattactgaagaaaaagatatggaaagagaaaatgtaataaataaaaactccttttatattacattttgtttacaatttgtcttctttcaaattgttgctattatgtacttgaatccttttttgaggttctattgatatacttttatacttataagtgatgattggaaatcttaggctcttattgaataactttgtatttcacgggaatgaattagatattaagcaagaggtataggtacatcagaatatcttgaattcaatcacttctttccacttccactgctgttattgcagaattctcctgactctcctccctgcttctatcttccccacaatagtcattgtccaaggagtagacagagtggccattttaagagttcaaccatgcaaactcttttaatataatattccaaatgactattatacttcaaattagattcaatctcctttcatgatttgcaaggacctcgttatctcattactctgcttttgttttccttcatattagtttggctatggaatttattatttatttttcagtgtttagtggctattttcaccttagaatgtgtggtccatgggagtattgacctcgcctgtctttttactgctaaatacctagaacctagaacaaatggtaggtgtatgataatatcaataaatatttgtttagtgaaaggataaatgccataaagattgactttgggctgtagaatcaaggaagacaatctggagatgtgtgaattttcctggtctaaaatatagggtaatttaggagaagagaagctagaaatatatttcaaataaaagacactatatgtactatatatatggtacagttttagtaagttggcagtgatgaaaggttgggtttgaattctgtatccattatatgcttctgaaaaatggaacaaataacccaccagctgaaaacatattgccataaactgatgagaaagagcaactacctctaagtatttaaattttaagcaattttactaaaaccatggtattaaaattgactaattttatgttcactttaaatccatttcctaaaagagtcaaaacagaacatctctttaaaagagctatggaaggtagaatgctcaggaaattggatgctgagtcaagggaaacttccgtttctgttcatttatctttctgctttagttaatttcatgttagaattttaaagactagaaactgagcaatggaacccaaattcagctctctgctaaatgcactggggaaatcaagtaatctgagcttctgtataatatcacctattcatactttgatggttctcctaaagtagaacattaaaggaaaaaatgtatggtgattacctcagtggtgtctcaagcactgtggtaagtactatagttgttaccaaaactagacaatattaacttattctcaagatgtttacagttgcttgagaaattcatcaatataaattattagagtgagattcttaataattatcatcatagctatgacttactctgtgtagattatgggacaagaattttgcatgcataattgcatttggtatccacaaaaatcatgtaaaggaatttgtatccccattttaaagataaggaagctaaggttaagagattaaatatgcaaatttacaaagcttctcggtaggctgggtcatgagttgtacatagatctgggtaatgcaaagtccatgttattttcagtatgccatgcgataattttgaagcctgttaagtgttagcagttaagcaatgctgaactttattcatgaggccctagagtctaaaaggctctaaaagaatcctactttgtttgatgtctaaagcaatgccatctgtaggaaacctgttgtttcttctctgcaaatattgcctatgcagaagtgttgtaaaacttgtgaggaagaaaacgttcttttgccttggtttttgccatactgcaggtgtctttcctctttctctttttctggtctcctctggattctatgtctccccctggctcttaattctcaaaaattccttcttagatccacctatccaatacggtagcaactagcacaagtgactattgagcacttgaagaagggctagtatgaattaagtgtaaaataaacaccagattttgaagacatagtacaaataacgaaaatgtaaaataattaatattttggcatttaatcatgctccattgattatatttcgaagtattgggttaaataaaattattaaaattaatttcacttatctcatttaacttttccaatgtggctacaggaaatttttaaactacatgtgtgtggctcatattatatttctaatggatgccacggctctaaaccatcttctttttggtctctcttttgacgttcttataatttcaatttcattcctcaaatacggtccttaaatttctatctttagccttggtgtctctgtcaaaattgttccttatttctaattgtcacttgatacttcctctatgatatcccatcagcaggttaaactgattatgtcccacattaaatccatggcctctcccaagggttatttttgccttccttccaatttcgattacatctctactcctgaagtcatattattaagggacatgatatcatccatatcatgtattccataccacttattccatacatccaatcaattgccatactcaagcagcatttattcctttctttccgtttgcacgtatcatcatggtcactattggtcatctattgagtcttgtctagattatggcaaaagagtctcaggcttttatattgctatttctcttgcctctttattttgcttcttataaatgtattttaaggctttagggtgatagttgggtttgagttaactaatgcaagtaataatgtctatcatctatttatattctatttagaattttaaaagtcgttttgcatatgttattttacttggtaattctagaaagccagtgacaaagtgggagcttttagtagacttcgtagaaaaaggcagtgaagcatggagaaattgaattgcgggaggacacagaagggctaggacacatttcaggtataaccattaaaacatactttttctcaaattttagtacggaacttttttctttcttacagagatagtagtggtattaaaagcacaagctgggaagtcagaaaaaataaaactcaactctgggccctaccacttgctagatcctgtatgatattttgggcaagttacttaatctttctgagtctgcattggctcatctgtaaaatggtgagtttcctcccaaggaaaaaatataaaatgatgtatgtaaagatgtttaccctgcatgaggcacatagtaaatcactttaaaaaggttaaacgcggtggtaagagtagcagtagtaattgttttatcaggtcttgaatcaaagagtgacttttttttcttcactatgatgtaaaaatcatgctatgataattttggtttatttcaattctaagtattatgataaaattatgaaactcatcaaaagcaatttcttgctattagtttcattttctcaatacagctgtgtgggggagtatagtatagctgtgtgggcaaagggaagaagagataactcttttcttgtttgtttaccaatttttagttgatatggtagttttccttcaagcagctcaagatgtaccctcaccaaaaataccctttaattatgaagaattaatatttatcacataaaacaattcaaaaacaggtaggcagccactgactcttatgcctgaaattaaaatgaagcaaagaaaaacagcaaacacgaggagagaaaagaaagtagaattctcttcatgcacttttattttaaatctaaatttttgcatggagtggtaaggtagtaaggtagatagtccacaagacagatctactagggtcctagaaaaataattctgagaagggaacatataaaaggaaactaggaagtcctgagagtatagattgctaacccagtaaagaagtcttttgtctttttttttcttcctttcttttgtttaattttcctttgaggaaaccaactcaggattctatatatgtaggttgaatgaatatcccaactcagtcctaattttgaaagcaattggtgttagcgcatccacttaatgagaacaaggtgcagcagaggggaacccacgtgctgacaaaatgctgggaagacaaccagctatggtgctgtccacagaaagcttgctgtatcctatggccagctggcattgagctttaggtttgaagtctggcattagcaaaggggattagcaagtgggcagtaggttcagggtgggaaaccagcttgacaaaaaacctggagaccagtcagcatggcagatgtgtagagcatacacaccctggagcagggatgggggaaggtgaaatgcagtgatctgacttctcctgaccatgatgagctgtatggtgcatacatttggcagctttagatgtggagaggtatgcaggaaacacaggaatccaacaacacttgggatttggagtcacagtcattctaatcttggtggcaaacttgaacatgctggaaatgctcatggcctgggggagttcaagacaggggatttcagacagtgctgaatgaatataccaatttcagtactaattctgaaaccagttggtattagggcattgaattaatgagagcaaggcatgggaccaagtgtctataatgtcctaagtacaatacagagcaacaacactgacaaatacagtgtctgactttaaggagcccacagtcaatttgggcagaagagacacacagctcaaatagagaacagaaaccaatataaggcaggatataattatctgccaaaatataatagaaacagtagaggaggcagagaaaagagagggaggaaaaggggaacttgcttagcaagagcaaagagcacagcacaatatcctactcgttgtaactaagatcatgttgagaaaattgtaagaataaatgaagtaatgtgaatgtctgacgatcctctttctaaagcagtagtacaaatgcaaatgcaaatgcagtctcctggttctgctcttcatttgcgatcttaccagcttagatttaaaaataatgaaatactgaaaataatattgacttaataggcagcacaatcaccattcaacccatacatcagaggagcaatgttcctaggggtgattgacactacgagccacagtcgggaatgcctgcaggccagttgggatatctatacaagataagtgggtaggagaggacctgtagacaagagaacgtctatatgatgccttgtctataggatgtagaagctgtccacccgcagctgtctcttaccatacacacctggatcagtttgccacattttatgaattttcaagagaagacatatagacatacttttctgtttttttttaaaagtaacaaccctcatttttcaattggaaattgattcaaaacattccaaaacattgttcaggcccaacaacatatgtctgtgggttgaatttggttggcagtctgccgattttccacctcttcttgaatttatagctgctcctaaaaaagcaggagcagagggtaatgattagagagaactggagtcctccaaataacttctgtatatgcaataaatcccaataaatgtttagagactgactggagcattagattattctgtgaaaaaagcatccatttatgtatagcttcttcatttaggtccttgttgtgtctgtctagcttgcatgactgggctcattttcctaaattgaaagaacaaactttcttctgctgccaaccctccccaaagcatttttttaaaaaaaatcattaaaagatgtctctaaaagtttaacttgactaagtcataacaaatacatttgtctttgcatcaactgttatttttgaatcgcatgatgtaggtagggtatggatcagaatgtgtggaagtactgttgtaagggagatgaaagagaggtttgcataccttgtgttgtgatagtaacagtggcaaccatttaaatacacatacatgtgtgcatgctcacacacacacaaaaacacacacaagaaccccaccagtaagtgcacaagatggggaaatgtagctggggcttggttgcataacccatttcatcacgttttctcctttaatagattagattctctgtctcagacgtagttataacaaaggatataagtaaataaaacaagacagagaagaaaaatgttcaatgatttttaaattaaatggataattctcccaactatttaatactctaaatatttatgcattttttactttaatgtgtccaagcaaaaatcctatatttcactttgtgaagcacctaaatttagacagaaatttggctacactaattcaaattacagtagcactcaattaactggaacctattagttatatcacatatgtaaccatctcctcctctgcctctcaccttgaggggagaagcctgggaactatactttgaggaagaaaaagcaaactaaacttgtttaagtggagtatctagtcccccagatagctcctatattaagattcctgaaaaggcagttgaatcacttcaagagactaaaggcatcaagagaaccttcagttattcatcctagaaagaagaggatacattttaaggtgtacatatacaatatacaattaacatagtatattgtatctcttatcttcaaagaaaaggattgaaaaactcagtaaaaaatttcagtttaagtaatgtgaactggcaaatattttttcactattttgatcatctgggcttcttgaaaggaagcctgaggatacataattttgtggatttttttttctcacaccaaacttcctttggtctttatcaaggagagctattttctttcttttttttttttttgtccctcagacaattacttgaaccacctcagggctaaatcatccaccgctggaacaagaaatagaaaaccatcaagacactgggaccaacttcacagtaataagagtacatgctaagccattctatccagaacctactgcaaaagcaatggaactgaaattggatgggcattcccatacacttttttttttttaactttaagttcagggatatatgtgaagatttgttacctagataaacttgtgtcatgggggtttgttgtacagattatttaatcgcccaggtattaagcctagtacccattagttatttttccttatcctctccctcttcccaccctccaaactccagtaggccccaatatgtattgttctcctctatgtgtccatgacttctcatcatttagctcccacttataagtgagaacatgcagtatttggttttctgttcctgtgttagtttgctaaagataatggcctccagttccatccatgaacctgcaaaggacatgatctcattcttgttatgactgtatagtattccatagtgtatatgtaccacattttcttatccagtctattgttgatgggcatttagattaactctatgtctttgatactgtgaatagttgcctcaatgaatatacacatgcataaagggatgatttatattcctttgggtatatacctagtaatgggattgctgggtcaaatggtatttctgtccttagttctttgagaaatctccatactgtcttttacaatggttaaactaatttgtactcccaccaacagtgtacaagcattccttttatgaactattttttaagtgttgaaattgatgttattttactcacacttaccaagttcatgatataaataagcaaagaaaaagtaaaaagcactcttgcactcaaagttgtgtatagacccagattgcctaggagctctttggggatttcttttatgcaaaagaatttattttccagcaatatttatgactggatgttggtctggttgacaaagtaccatattttaattagtcttaagtagaatatttacagcatcattttcatgcacctatgtgtctatttatctatttacttacctgcttagctacctactcatttatctctcactattttcaactattgcccatacccctacccctcaccagcatattctaaagtgaactttcattcccaggaaaattaattagagcagtaatatgaacaaaatgaagatagcagcaatgggctgtaaaataagaagacaccatagtaacaagtaactatttcacaataatgcgcgtataaaattaaagaataacttacataaacctttataaaaataactttttacaaaagggtgcagctgaatcccttaggggttatgaccaaatatgcaatttctcagcctctccctcattctccttaaatgggaatatctgtggaaggttcagctaagtctgcatatttaataagctccacacattgaccattgagaattactactttatagctctctttctctttactaccagaagcatgtgcacatctggaactggttatttctgacccttactctcaggtgaaacattaacttaatacagacaatctttaattctagtggaatggggttttgtggattcaacaataaattataatgagtgatctcatcttttggtctgggcttgtgatgtacaaatcaagtgcattcccaccttatttacaagtcccagcacttcagtgggtcacctcttcctcactggacatttgctttctccttgaccgcaacttcctttgctggtaacctggtcattcattgcctcactctcttgctagggttgaggttctacctttctattgccaatctcctttgtggataattgagctagacctgaacaaatagccggaattgagaactgtgccacctagcaaaaaacctcctagttgataacaatctgcaaatctgaacttctcagtattccccaccctgtcagattatcaatgactgtttctgctcacttgttgtataactcttcctattcaacttgtatccccagttgccaatatttacctagattgtgaccacagatctatgtaattgcttgacactgtcagcatctttcaaactgaacctttcgtcaccacgtgtggctaggagagctctccagaaactggtcacttcagatgaaaagccagttcccggttctttcaggagagataacaggtccttccaatttatatatgtataggggtgtgtgtgtgtgtgtgtgtgtgtgtgtgtgtgtgtgtgtataatatatatataatatatatgtaactttatttccatatggaatatatatatatctcacaccaaacacaaacattatttccagatgaatcatagttctaaaaataaataaagttgaaacaactcatttagaggaaatcatgggaatagtctttgttgccttgaaattaagcaagggtctcttaagagggcaataaaagcactaatcgtaaaaggatataaataataagttaaacaatattaaaattaaggacctcttcattaaaacatgccattaagagagtgaaaaagcaacccacaagtgggaaatgataactattgcaacatatatattaaaaatagacttgtggttataatacataaataactcctataaatcagtaagaaaaagacaaacaatctgatcttaaaaacaagcaaaagtattgcacaggcacttcacaaaagaatattgcatagcaatcatctttacaaataaaagtttgagtgaaataagcccatcaagaaaaaatagaccctttaggttttcattgatataaagttcagaaataggcaaaacttagaagacagaagaatgattagctttagtggggtgaggtgggtagtgagtggaacagagctgtgcggggattctggagtgctgataatattgtgtttcttggtttggctgtaattacaagaatgtgttcagtttgtgacagttcattgaactttatatgcaaacataggcatgcacacacacacacatacacacaagctatttaaaatgtattttactcataaataattgagcaagagagaactgatttttaaatgcattaaaggagatactctgaaaacttttattttaatgatatagttattgtccttcacaacaatagactatgacattagtgtcccatcattagacatgcccttttggcactgaaattcaatctaataaattcagagtttggagatgagcattagggaaagactaatagatacaacagcaaatttgctaaataaaacaaatgtcaaccatatctgactgttgtcaattactgattactgttaattactgtcaagtactaattatgcaatatgcaacttccacatatttgaaccctgggcaggccaagatagtgatagcctggcataactgcaaccaatgggtgattagatttaatctgcctgataaaaagactttgcgactgggtcaagcactttaagaaggaaagacagtagaacaagaaatcccaggaaactgagacaatcgcaggttaaaatttcctttttgcacttgatactctcccaacaaagattagagaagtagcctgtcccagtgagggtctgagactccatttgtttccccagtgttttctaacgctgtggctgctgagcaacttgttctagagctgatgttttctctttaagtgacatttcatcatcaatgccctaagatagtcaccctgttttcccttaattgatagttgtacgcaagaggcggaaaatcgctcagcatttcttgctagattaggtcaaaactgacagaggaaacagagagaagattgcattacttatgccccttatggctctcatctgtatctaagaagattgccattttataaaatttcttatgctccctaaatgtaattacaatggcgcaggcattttcttcctatttgcttttcaattttttactacctgcctgatcatcagagggaaattcagaagcagttccactaatcttaactttattttccttatgtctctttaattagatgcaattgcaccctaggaaccttttcttcaaatgctttatttagttattccttttaagtctttacctttcttttcatttgattgttgaccagaagcattgaacatgtacctagatgttcagagtgaagtacctaaaattctggaatattttttccgtatcacagggtgcccttttcataagattaatgtttacaaatagatactgtaatatttattctgttttaaagttaattaagaagcatcccacgagcatgttatatatttattttgtggcctcaggggtcaaggattcttacttgtggatttcttttcatcaagtatcttagaaaggggttataccttaaacaaaatcatcaatttccccaggatctataagacaaaatcccaattctttaataaaaataaccaggttctcctaaggcagccttaatcaaccatagctttcccacttagccaccaacactgtatcatcttgtgtggatgttcactcccctttccttaaatcttgtgatctcagcctgcactgctcttgatatcccctctctgcctttcagagtcctgtttatcatacagcatccaggcctcacatcacctccaccctaaaatcatctccagtcccattctccactgcactctaatcagacttcatggtaggcaagcctgcttgtgcttaactccactgcagggtgcttaataactttgcagaacctgtgggatgtggcaaagtctatgtctcagagtagaggctcaataaatatttgaagtgtaaaatgagctgctttgctcccaacaggatggagtttgaaaggttaagagctaagaaagatcatggttgcctaccacacacttattctacttttaaaaaatattttacttgacattttcaccatttaagatggccatgtgcagtgataataactgtattacaatttaccatgctgcagacttgtcagactttgtcagcaaatgcagcaaatactccagattccctgctataagttaaataaatgcaaaaacttattatcacatttcctatatataacacctgcccaaagacaatgttacccaatggggtggctatggtcacattcctttactgtgatcttcctttctcattatatttgacatttttgaaactgagttttattgcactctctcagcttacagagtggtcggggaaattagacttaatagagatgtaaaagccacagggagaaaacaaaaggaaagtgaaatggaaggaaactgaaattaaaatgctattttggtaaatggctgctgtggtggagacaacaaacaattgcaatgcgagttaattactgacctgtcaggaaagtgtgacgcgaaggttgtggcacacattactggagctaccaggaccacaactcatttccacaggggaacagacttgttctaccacagatcaacataagatctttccaggggatagaaatgaatttctcggagaaatactatttatctgtggagttgtcatgagctcttagcagacctggagaaacagctcctctaatacatgtagagcagggaatggggttgtgtcaccagagaaagtttgtgcatgtttaggcagaggggaccttcgctcctcgtggtggaccttcgctcctcgtggtggatgtgctaaatatacagctcccttgccatggagtgaaaactcaggctaacactcatgaaatgggaattccctgggtgtatggccatttcttgcctctgagattttactcacaaaactctcagtggcaacctatgtcttccagaagcatccttcttttagggaaaaatatcaagtacctatccaaatctgaaactcaaggaagactattctcaaagcaaaaatccctgaaaattctaagattgtgataaatttgatctttttttaatgagaagaagatacagggcttttgggaaatagaaatatgatatttttaaccctaaaatattatatgaatctccaagcatactttaatattagcctcagaacacagaagaaacattgttttctttctgcctctaacttataataaaatatccatagtttatttactctaagaaatattagcaaaggtgagttacacatttttaaagtaagaaaattggtcaaagacattttcttctttgccaggctacatacactggcataaactaggttccatatttgtttttcatttatacattcaacaaacatttaagtctctattgttttgtcaggaagcagaggaacatttataaatgattaaacagaaagacttgcatgatacatacctaacgtggctacactatgatcattttatctgccagattttctttacatttcttgttaccttttctttccatacacaatgtccacttgatttgtgggtctatggcgaaatcaaggatgctggggggtgtgggccctgagtgccatcctagagttattctgaacagaatgtgacaccaggggatggtgttcagtatacccaagcctacattttctctactcagcagcataaagattatatcatagtgcctatccagtttttcccagctcaaaaattacttaatatatttttacttttaatgctgttgatgtgaaagagatgtcaaaaatacacattctaactcaaaagggcaggctgctgagctttagtgtagttaacagaatgcaacaaataattgggagagcagctatgaaatttatgattagatgaaatatcatgttcactcctatttgcagtatgagtaggaaaatcaagcccagaagcccaggacaccatcgaaccacgtagtttgagcagagccaaagttcgtgttgctcttatgaagtgcattctcattactgcttcctgtttttaaacaggattgaaaggagaactagtgcaatatcacaaggtattcttgctcttctgttggtacacgtaaaatcaggaagtctagagaatagtgaagccagtcttaagtgatttacatttcaatttctaactcagggatatttatttggagagtttagtaaaatcaatggatatctcaaacacatgcaaaatgagccagttcttcaatattttcattagtcattcaccagtgctctgtatgcctcctgtaagaacataaaaacacaaggcatcaaagttttctctaacaaaatttaatagtaacaataatgatgatgacatgagtgggtaacgtgttctaggaagaacaaggggaatactgaagaggcacatagatcaagcaaaacctaaacttaatatgatttgaagttaataagcctgatattactaaattacatagaaataagcataagcaaatattattgattttacaatctaccaaatctagaaaattgaaggtcagtgaggaatgaaaacatgggtggaacaacagaatataatttaagattcctgtgaatatttttggaataataatgcagaaagactcacaaaactggagttcctcgttctctttgagagaacaccctgaaattaatacagatattcctggaagaacaaccactcctaggttctggaagccaagtcaagttggactctggggtatgagggtttcttttgagtcgatgttgagcaggctttgcaatggagtttcttccctagaaccttatttcataaaggctaaaaaataagaccaccatggaagggatattgcatcatacagctctaggaggcaccattttccagaatgcaatgttaatgtcccatccccagtcacaaatcctaccacctctgaatttatgtaagggcataaatagagtggactgatcaatgctcttctactctaagatagttctttcatgtagccagaagagtttccagtttgagattcagttaaatgcttccttgagagttaagggaaagtctgactgatataacattgtgttagctagtctaatcatacccctcccatatacatctaagtgattcagaggtaagaaagaatggatgatggaaatttttataaattttgacactgtagttagattaagcctaagtgaatgctgcagtgggtgctctggcagctgaaatatgaaaaggattatagggtgtctactagagaaaaaactgttgggatgtaggcagggggaaactggggagttgaaagggaataaagaaagggctctaagtgggaccccaaaacaacttgcaaaatatggcctagaaacagccctgtctaattggaatgagaggttcctaacgggatgaatcagaggaaatcgtctctgaacccacaggtacagcagtcacaggtcccacagccactggcacagctgtcatcatcctgttagatttccatcctcaactgtcctccttctgtccggcagcagggctctgcttccctctcaattcatctccattctcaattcatccacaaaaaaacattgtgtgttatgtacatccaggacaacacacattctcttcctcagagtgtctagaataccagcccctctggtactggttgggttagaagggatgggactctcagtcaatcattcagccagatgaaagataagcgagatgatcagatatccccacagagaggtcaaatgctaccttctctatgaaatccattgtttctttctttcttcgaacttccctggtactttatgtcccttcatgacatatgtcaatacctaccttataatatcccaggtatctgcacacctttgcattgccaaatcctttgccagaaatgtccaacctgcactgacttagctctgatgtaatctgatcttctcttgcagacttcctctctctccacctcccacttccacctgagtttaatgccattgctcctctccccacctgggcactgccctattctcagttaattattgattgtttctctattgccctcaccaaactctggggcacttgataaagattatctctagtctctaaaatggtgcctgccacttaggagaatctcagtaaaggtcgaaggggtatatgtatgttttctgttgatagaaatctttaagacgaggttttgtgtcatttttctctatcttcccagagcaatatagtggtctgcaaaattagaaatccccaaatatttaacaatagaagaacaattatgaaatagcatcaagtcaatgaccttgcagagcaaagtacgtgggaagcagaataaagagaacaaacttagtggagggggtgtcaacaaaatgtaacaacagggtgagatggaaaaggaagtgagggctggaggagagacagtgagcaaattgagagaaataacattaacattgtggtagagagagagatccgcctgatggaaagatctaagaaagcaaaatcttgaaagtattttctgcagcttgtccccatgaaaacagaggtggggaagccagataaaaggctttgtaatgaatccagccttttgacagtagcatatcactaggcaaattatggtttgattgtgaaatcaatataggaatgcaaattttgatttgacactgaaatttgtccagcttctgaggaagcaacatgtcctataaatggtgtacggttgggctatgtaaacaccgtggctagatgctcttggccagaagagagtggcttcagcctgagtgatttcatccaccaatattacaaacacactgtccttagagtttgaatctattgaataatgtgggaaatcaacccttgaaggcactcagaggagaaaatatttttctagaaaaatatatgattttcttcttaatacatacttcaaatttttatttcatacttattgaaaaaaactcttgcattctcaattagataattttgaataatacattactcatgtaagcatataaaaaggaaaataagagcaaaataaattggctaagcaattgctaaaacaacttttctataaacatcttcgtgatttattactgaagaatcataaagtgcaagtgtttaaagtatacaatttgttcatttttaacatgtgtaaatgcctatgaaaccaacaccacaatcaaggtaacagacatacccatcattgccaaaactttgctcaatgtgatccatacttgcctctatcctttccctaaggaattactgatcagctttctgttagcataccttagttggcatttttgagaatattatataaatgaaattatataataaatcttcttcttcttcttcttcttcttcttcttcttcttcttcttcttcttcttcttcttcttcttcttcctcctcctcctcctcctcctcctcctcttcctcctcctcctcctcctcctcctcctattcctcttctttttttttcggtttctttcactcagcggaatagatttgcaattcatctatgtggttttatgcatcaatagtctgttcctttttatggtttattgttttcattgcataaattaaaatgtgtctatctgttcacctgttgatagacatatgggtcttcttttgggaataaaatacctgctcctccacctctttctgcctgcctgttttactggaaaaattatgagtctctctgatcctcatttttttcttataaaaatatgggtttaatggctattttataggagttttttgagaatcaaccattgagcacattgcttagcacatagtagatactaagtattagcttcttttctaatttgtcatttaattgccttactggtatttattgtaaagtaacaattttcctcctatcaaaatatttccttttctgttcgtcttagtgtctgcctgcttggccattagaatgaatgattctagcctcattgtccaacaaacattggggtggctatacacttgcctccttaaaacatgattcttcttttggattatattcgctcccataactgactagtcacagttttgttcactgtacacagtgctcggagcccgctataggatgtctattaggttagacttggagacaagaatcagacaagaagagggctgtttccagaaaatgagaagatgtgtttgtattgcaaccattctgtttgtaatgaggtgctgtgttcacttgaggaacttttggggagggacatttgaagaggattatggatgaggggctcagctaaagctctaccagtccaccctctggtgctgccacagtttagttctctttgttttcttcctccaaattctattttttctcattgctgctcctttaaagtgtgtccatactaaattttcttgcctaaatcagactccttctattaaaataaatggtgctgatttttttcttcatattctttataaatacgatgtccaactaagctagcaaatctagttcagttggcagatggcagtggatgaaggaattttaatttccccctgtgagtattgtgagtgggggtaggggctctggggtctgttttgctctgacaccaattttactcacttaaatttgtctttattcatagagatttttgttcaccaagaatgggtgctgatggtagcatgtaggggtaaagtgggtaatagaccagtgaagttgtggattaaaaagcatatatcctcaagacagttggtgggcaacaccatttctatataaggaaaactgtatctcattactgttaggagtttgttaatggaattaagaaacacagtctatcgttgtgctacctataaacttctgaagtcctctgttatgtatagtgctatccacatgtaaaggtcccaactgacaaaataacttacaaaggaactacttttttcttcactagtcagagaggtgaagactcttgtttatcaacttttaatatcctaatgattactagggacactccatcaagagttttcatggaaaattgtatgtttagaataacataatacattttatattttatcaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctgtaagtcaaataccccaaatatcccaagttccttgtcatacagaattttgtaaaaggaaaaaaaaaagctaattagtcttgttttatttgttttcctaatgtgcatgagaaaactgtttttgtaatgcattttatcttgcatacttacagtcatgataatatccccagttgcaagagaagagctgggcttaatccagagtgataaagtggatttggagctagactgaagagcacctttgactcattttaagggcctctactatcatgcttcagtgtcataaaaataatgaggttatgctagcatgtggtgtttgtacttccaaatacagtacatcactttgaaaagccagaggctaaaattagctaagaatgaattgagaaaaaaaaaaatctcaaaaaaaaaaatgtgaaaatctcttccttaaaatctcccaataatatacgatactggaaattatgatttgatttggagtgggcttaaaggattgaaatgctgtggctatttaaggtttggagaggaagccattttgtctcgataatgtgtcattaggaagatttgaaataaaatagttagagatgaactctactgccaattgtgtcgctggccctgcacgcatcctgagccactaaacccactgattgcgatgagtctcctctggttaattttcttccataatggtggtaacttgcagctgaggccataggatgttacaaaattatttatgcaatgttagccactcttttggaccccagatctattttgtttctcacagtgagagcaagagggaggagaaataggttagctggggacaggctgagttccagtcaccctgcagaaacatgtgagctattaattgagtgttctgttaatatcataggggcctatgaaatattcagcttcctaactgagttattaaatgagataaacttgctgagtagcatgttaccaattgtatttattccccatttttcactcaaaaaattaacccacagcaatctcaggaacatgagaaatatgtgattttaatcattctttcctcaggtgttgtagacaaatttagcatgaggaagccagtgattatatttggagagtgagaactacatccttagataaagtaactaatgagatatgcatttttctttatttactttctcatttaaaagtattgtctcctgggaggtacaacactgccagcctgactttgcttttaaaccagctaaaatgttcatcaactatgaacttgagacagtggttagagtaaattattggaatctctataatgtattatcagtaagaactgtacctttgaaaaagtttaaaagttaagtatatttaatgatgcctaacatattttattggctgtgtttaacaaaaggcactatgccgcagttgtttttgacaagcatgaaaacatcacagcatgagactgcaaaaggaattatggagagaaattacaagtgatccatctctcaatgaattatccacctcaatagcctgcagaactcagctaccaattaacacctactttattacatgttgggatgtacttaataactttcatgtgtttatgcactattaccttgactgatgcctcttgtacaattaggcataattggcatatcaatatgcaaaagttaaaaggattaaccctcttaaaactaatgagcatttctgtatccagctgctaaatgagacaaaattagcatttttcacttttgggcaggattttatcatgcagtttctcattgttgatattaccttgttacataactttagtttggggggttgtatgctggactgctagagaataagagttttccaaagttaaattagctataattatcccagcttttgtttccgcattcttagcctgggcaatatgtattcctcgataaggaacaaaaataaaagttacttttggttatgtgtgctcagtgcataattatataaaaggggtattttagtgaggatgtgtcatttcaccgagaaaacttggctcagagatactgtattgaaagcttgccatggcactaattttctttctgtctcagttcttttcatctcttttttccatgcacaattttctgactagatactgacagaatgtaaagtattttggcatatttattcaaacaagcctgttaaagttatctgctcaagctaaactaagaacttgatttttcagaagttgggtggtggggtgaggtcaagggggagattttgaatttagaggtgggaagagatgggtactaaaaatgtgggcacatattcaaatgcagtagggtttgttgtaacagaggcacatacatgtagtctgtacagaaaaaaatcaaaagtatttagagatcatacatatgtcatgcatcctacttaatatatatggcatatgcatactacttgttcactagtataacaattatgcaaatccagtatgacttactggactatataataacacaaggatctgatattacattcatcatgacttaattcattacaaaaatgataaaatattctagagtcaaaccaattctgtaattttctcacaaattcataaattcctctcgtaaattttgttcaattaaaatgtttttaatatgactcttaacttagaacacaatacaaaattctcctgtatatgtcgtaaaagctttgattcttagttatcttaaatgaggaatgctatgaaatgccaatataaacatttatccaaccctcagctatgcaaacgtaggtgaatttacttgctaagttagaaattttgataacctaaatgttgcaggaaagcatctcagtaaaacagatatgaatcctccattagtattttattggtgatgtgcatcgttttctttagacatcaaataatcattctaaaatttggttaataaaatcaatgccttttcaaaattcaaagaagttactttttgacgtgggaaatgttggagaggtgggcagtttcgagagggggaagtggtttgcaagaaaatcgcccatctgtaagagagatctggagagctccctttggtggggaaagaacagtctttggtctcagtgatttgttgtcccgtcctgagcaccagagtgagacctcttaaaggtagacagcttatttaccagaatgtgctaaacagaaaatcagacagctgagggccaatagatgggggcaagtgaactgtgcctgtttaagggctaaaaagaccaatgtgcattgcagcaaatagctattgcaaaaggtttaatgtggctttgatgttatttataagagagatgctcctgcctaatacacagtttagaatagatattaatgaggagtttaaatagcccgaatcaggaaactgcagacatatgatttgcaggcaagagtagtttcggcatttaatgctggtgtcttaagcaacaacgtgtatgaatattcaccgtttccatcttgtaaacgccacagaacggcattacttcattcatggccatcatgaacaggaaaatattttttattggtgttcagataaagacttaggtggagccatttttaaacattaacatacaagattccttttacttccattaacagattgtttgttcagtttttaaatatattatcagaaaaaagaggaaacaattttcttttgtttcttacttctgtgattataggatacttgccaaagttgtggctagccaaaaaggcagacataaaaattgctactaaaaatataaaccttctgtttagtagagtttttaagaaatattatgagattgtagggcttgtccatgtttacttcaaatcaagcttatagttaggtttgaggctttgtttgtataaattgtcctgaagtggatcctgatatttaattaaaatgacactaaatcacattgaattgataagacttggcatctcaaacaaaggtaattgcccgtattggttttgtgcaaaaatagcgctgcttggaaaatgtgcagccaacacagactgtcaactccatttatagatcaatatgtgaaaaccattgatcaggcaggcatgtgtaacagtaacactttgcatttatttgttgtttttataccacattaaggcttacaggattataggattcctaaatattttgacttcctcataaatatatgatctgttgcatgttaattaaatgagagtctgcagccatttctaaaattgtttttagtttgatgatttccttttattgctgtggatcgtatgatctgaaaatggattagtttccttctgcataaagattattaaagcttattttaatgtgtcctatttagtgtaagatgtgtctgtatttttgctttgaaaaacatagatacagacaattattttctcgtagcgagtggctgatcttttttcattaactgggcattctcagcgctcagggtagaattatttcctgacatattttgcacaccctgtagataacgggtcttcttgacttccctgatagaatttgttttctttcttttccttttatctagctctgtagtacaggcatctgaccaaacattatgtagaaaataaactgatcatctcaattaaattctagacacacacaaatataatttaaattctatttttctgattcaagaacaagccttatgaactgttcttatacactgcattcttcagttaaatctctcttatctcatcaatgtaaggacagtgttttgttcctaatctttattggactattgtggatgacatttgtaagccattttggtttataaggaaaagctggaggacagtggagtgagactctccaaagatccaggcctctgatatgactacacaataatgtgtcttccactgcaattttctttaccactgggagggcaattttgttgagattttttaatattttctatatacattaggagtgctgctttcaagacagtgctttctatacaatattaaaataataaaagaaacaagattttaaaaacagcaacaaacaaataagcatgaaattcgaaggtttcctaaggtattttgcagacatgctgtagaacagatgaaaaagtttgttagctagaattttgacttttacacaatatgcccctgggagaagaagattcaaaaaccactggagatttctttccttgtccatgccaccctttgccatctcatgctgtgaaaatctttaactctatttaccaagcacaaattggacttgccaaaaggttcagaaagtttatgacgacagtgaagagtccatacttcaaagaaagagctagggctctcacaaccacatatgtggctgcaccgtttccatcttaacctgagcatagctaaatttgtttataatctcctactgatagaacatggtgctgaatgtacatgagatacatttttttaaaagttagtcctctgattactaatttgaatccaaaactctaaccttgttagcatctggacttatttccataataacaaccccttcagaacctacaaagtaatgaataattgacaacaaatgaaatgttttgatagttgtcggcacaaagcatgtttaatgttttgtgttgcttcctagctaattatgtagatgacacatttgtcagaccttgactgccattagaaacgtgtttccagaggggagaaaaacaggctattcatagagtaattagctagaatgctcaatgacctgtgagagattcaaatcgctgccagttcagacattgttttgttacagagcagaggggtaattaaaattccaaattacagtcctatgatggagcatttgtttgttgacagtatactcttactctagtttgttaatttttttttaaattgcttctaatccattttatagctttaggagttccgtctttgaatttgctgacaactaatattatggtaaattgtacttcagctgagtactgcgtgcctcacaatttcaagggaccacaaggttggtgggataaaatagctccttctcaagactgacagatcaggtgctgtcagcgagaatgcctctaacatggaacatcttgtcaaatactgcttccaattctatatgagggggaaatgaactagtggaaaatacaaaggtagagaggaaagcaacaatgaacaactagaacggagcaagaagctgttctcccaataagaaatgattgattaagtgttctgttaccgagtaggagagaagagtgagagctgaggatgatttgggaaatggtgttgagattgtggtgctgagttcaaggcagaagatgcggccgtctgtaggagggctcacctagatcacccaaaggatggcatgtttcacagtaacacctttcatctcaggtcaataacaaaccatggaatgacagatatcattcatgagatgtttcaaggaaatattgggatagtttacaaatctagagggctaaaatagtctaaaaaattcagttccagtggaacatgtatttaggttgctgaaagtgagaatatagttttattaaaaagatctgacagaagtcacacggtgtttgatgcaggcgaactgacagaggcatccagtgagcgctgattatcccgaagtcactgtcagctaggattgattttcactttctccgtttatgtaacggttcctgtaatacagctgaccccgaatcacgttaccttgtcatttctctgcatggatcaagaagagatgagctgaaaatagctagacactgaccttgaacttaccagaaaagtgagaagtgacagtggggtttttctgtagttcatgtacagagacgaaggcacactgttcctctgtcgagttcactgcagcagcacaagggggcagagcagtactagagattacaggtaacacagcttctgcaacagcatggaaagactctgaaatacggagttagagccagaggtctcatttttacatcttagtttagacataaaggagaattactgatgaatcaaaatctcaggtcccctgatgttcataatcagtaatctaaaagtgtaccttctaattaaaaaaggttacctaatacgctgtgtgccagcaactatgcttttccactaaatttttgcagcatctcttatttaattcttataatactcttcactcttaaaataactttggaaccatagtcaatattattaagagaggtttaatttatggcaaactcccaaggtgatatgtgtcactttacatacaattgtatcagcagatgggaatattctttacatatttaccagatgttaacacccaaaaattaaaactggagagtgtttaatggcagtgtgcactcacgaacaggtaaaaggcaagctagaaaatggtgtttaccatttaatttacatttatttatgcctgtatgtcttcccattttaatatctgcctcaattttcaaaaatgtattttaatagatcatcattataaccttgattaacctaaaacacagtatgtcaaatattatcctttgcttgctagcacttagttaagctaaatcattgctgtactgatgctgaatgtttctgataaatggcactttaaaatcttggcaagtgaagcagagaactgaagcaggttgagaaacagaacagcaaacactgactcaattatcccccaggttgtaagtgccttatgtaatggcacggtagcatctttgcttgtgtgatggcacaataacatttttgcaggcctccataataactagactcttccttgtatacagtagattctatgtatgtgtacaggtagtatatgtatatatacacacacatttctttatttatatagatatatagaatatatacatatctatatacagatatatagaaatatatggagagatgtatttgtatataatttatatttggacctatttttatgttccaggagaaaataataacatatatatttacaagctgaaatatcaagattgcctcaaggttcttcttctgtaaatataactcaggacaagctgacaataagatcagagaaacaagtagacttccaatatgtttcaaggacagaataaataagagatcattctattgccaagaatgtggcagaaaatattcagaatatctgtgtcatcacagaaatctatagtacctagtttttgccctttggcagaagaaaagcacaagtcctctgacttagaaagatttgctatttggaggaggcgatataagtgggggcggcggtgtgtttatagctataaaatttgtgtgtctaaaaatgacaccttcgaaggcaagcctgaggaacagatgcattccttgagaatcacacaattactttgcctttctgctcctcagagagtgcaggagacctcttgcatggcctctcctaggtggaaggaaacccatccctaaacggttgattagcctctgcttcggaggtcaaggcagacataaaggtgttgtctgctaatacacttccccagagttttattttttgtttcattctttttctttccactgccttcagtgtgcaaggcttttaataagggacttcagtccctgatgtgttcagattcggtttattgttaccatctgtttaattatcctctcaggtttgtgttaggaagcattaaagtattttatccagcctttgaatccccatgttcctaaagagatgtgggtaaagtacgtgtcagttttcaaagagcatattaaaaactgataagcagaaccatctccaaacaataacatgtaaggcaaatacattttttttacattaatgcatgttacaactaattagcaaatgtacagcaatgtggcaatctcacggaaatgatgccatcttctctatatgaaatctcatatgcttctcctttgaggtgatggatttttatgattcctattcacttccaatgcactgacaataggtttattgggggaagagatatggaatttgatttgcaataggacatatagttgtcatatgtcaagcagatttatggatgtgctgaagttaaagataaatcacatacccagagaaaaaggacagaatgtttggggaaaaatgaaaaaacccaggggaaattcagttacttgatttttttctcctcttcctcttgaatttcctcctcattattattattagatttcatgtcatcattattattactacattgcatgcttttttttttctggagaaaaagcagcatgttgcttccagtaagcactatagtcactgttatatctggtgcagttttccatgtgcaaaaaccattgataacaaaaattacatgggctgacacagacgtgttatcagtttatgtccaaattattttatatatcactattttagtgaaatttttggaaattataaaacaaaattaagtataaatgtgtaagtatcaaaatgttttagatgtcagaaaccctgaaaatcaaacggaaataaatcatgcttttacttcctaaatcaaggaagccaaatgattaatcattattcttttttatgtatcccttacgaggtgatttcaataaactttttttctgagattccaagatgttattagatttaaaatgtatttgaaagtgttgagaaatggtagttttgttttgtgtaagtacctttccacagtaccataaacataaatgaccaaagtactgatctctttttattcctttgtgaagaaaccagtgctgttcttgccttatgctcttacattatctctgtgaaggaagaatagtgatgacaccaactttcctccactacttttggacactaaacctgctttctttcccacagggtaaaataaagctgctgtcttcatatttccaatgagaagggacatgtgtctccttgcattgaattgtcttagatcatatcatgtagcacaaagtgacccaatataggaagacaggaaaacaaagtgacagttttgtttgctctaatgtaaacgccaacatcaaaacatggggcaaatcctagaggcccactgccagaacacacaaattaaatagcaagagctgatattctgtacttaaaaaaatgtattcaagggatattctgtaatcagcagtgaaaggttaatgaacaaataagcttagctcaggttagacaaactgagtgtaactaccactgtttttaaagccatgagaaagtgaatctggctgatacttgataatacatcacacactgtggtcttacctattgattacaggctgacaatgggtaacctttcatggcaacttcctcttttaccatgaattattgacagtattaatgccaataacacatcatcaaataggaaagaaatttacattcctggatgtactatccttaacctccatgcctttaacgtcaagaaagaaaagaaaagaagaaagaaagaaagagagaaagaaagaaagaaagaaagaaagaaagaaagaaagaaagaaggaaggaaggaaaaaaagaaagaaaacaaaggaagaaaaagaaagaaagaaagaaagaaaaaaaatatcttctttcttgtcttgaaaatgctaatgaattacctttgacttttagacaggttattcatgtgacatcccgattattctcatccacaacacaatctgggtaacacagccctacatttaagggaatcttgctgttgttattttcaccctagtgtcctctaatagtttatagatcctaggaaattttactctagtggtgtgtcctaaggtctctgcattaataattcctgctcgttgagtggtcaccatctcaatcctgcccctgtgtgtgtccctctaagagtccccaaagtgggaaataggagaacacgtttcatctattcatttcatctatttatttatttatttgtacatttttattggcactaacagtatgtcagagactcctttgaaggctggggacataaaccaaaaagtttctctgtcctctaggaggttacattcaagtgaggtagaatctttacctggaatagcccagactctgctgttagctacctagacatcctcattgccactgccaccaccacctcttcaaactagtattagtgtcaagtacgttgcattttaccacaaatactttacactatgcttaaaaatggcctgtaaaaaagagacgttcacctcctgtaggatgaatttctgtgtgttgtatatctcaaatgacaagctttgattttttaaaacttcaaattataagaattccacctgattttaacctactttaaactcccttgcgcactttgacctatttcctatgtcttgtgtttggtgtacccaagctattgaagtactttctttggtaacaagtcaagctgctagtattcttatctggttagatttataatgcctcttttattcatcattctttctttttccttcttccttagtcttttttgaatttatgataaacttttcactgatgttgaaataataatttttatgaatacgaatgaaagtgttaatatatttgatgtctataactatttttgtttcaacacgaaaactgaacacagacataatttaaacttctacagagcattcaaaattttcaagttcttgacttaaaaattttactttgatctttgctactagggtctgactgagcattgtccttcaagtagccataatttatggggttgattgtggtttgtacatgatctaattataacttgccaaagcagtttttatcattagtgttattcttatctattctttattcttatcatgccattgtagcctttaaagtacttgctggccattttactaacgtgcaccccatcaaagcaaaggtaattacattaaccaggagacaaaataggctctactgagacctcacaattccttatttttcttacatatggataatgggacagcagtcttgctatgagaatggcccaggaaacccagattggattcagtatgcatttaagaccatggtttctcactttttgactgttaacctgagcttgccaccactcatgctgccctttctaactctgagccccctatctcccatctgactgctttgatgaaaccttgttccccaaggtcaccaacatgtacctagaaccctggttgctttttttcacctatgcttcagaggcctgtttcagacttttcctcatcaaaaacaatgacaacttcatgtttagtattcacactctagggtgaaaatgatgggtctaaacaggggttaccatcaagtggtggctccacccaggcaatatgaccagaggtactttttatttggttggaatggtgtttttaatagtttgaatttgaaagcctttcattagagttgtggtgttttcctgcaggttgcattacctgcttggccctaaggacatttgacttggtattcttaaagctgttctattgactggctgttcacagatgaggacataatgtggtaagtcagaaaataacaactgttggtcataaatttgaaaacttagaagttgacagccataaagcataaacttagaagtgtagtctttatcacatttcactggtagtgaaagtagcttatattacatagctaaacaggaattttgttattcagattttctcatttggacttaatttcaattatttatgtatttattattttagagacaggttctggctgtgttgcttgggctggagggtagtggtgcagtggcatgtttgtagctcactgcagccttgaactcctgggtgcaagtgcaagcaatcctcctgtttcagcctccccagtagctaggactacaggtgcacaccatcaatcctggctgtttttcaagtttttttgtagaaacggggtcttgctgtgttgctcagggtagtctagaactcccagcctcaagcaatcctcccaccttggccttccaaagtgctgggattacaggcctcagccaccatgactggtcctaatttcaattttagtctcttaaattattataaattaagaaacatcttgctgcctttcaagtaacactaaaaagtaaccatggttttctgtggaaaaggtgttctcttgtcatcaagttttaaatactctgtttattctgggttatctaagatttaactttaatcattctgaaaacttgaagagacgctactttgtatttaagtgaagccgtgcacttgtaaatcttatcataaagaatcacacaaggcccttacaatattatacaaaatttaaatcaacttcgatttaactagtcatctaattatcatcatttactttacattctcactaattaatttggagacttttaaactttgttagaatttttatttccttttccattgacatgtaacatccattaagaaatgaaacaacataaaatgaactctacaaacagtctccactcacttcttcatagccaaaatgtcttttttgggagcatctctgctttaccaaatagaagccttaatggatagagaagcaggttcacatgaggaagataatgctacatggccaagggcctctttagaatttctcgacttgcaactggcatgttgaattccacctaaagatgtattttattttgcctagacagtgctttctcctctttgctttctaattgagctgacatattgacattctgagatttcacatgaaaatttgtatttgtgacatgtctcaaaaaatcagaaattctggcatctggggctggttccccaagaagcaggcaataactagctgaagctaagtatctcttgcctcctctagatggggcaaattctccctagttcaaaacagtccagccaggcccccttcatggggtgtttttacctatctggcatttgagttggtgatgctggctttagcatatctattccaactttatttgtatgtcccctgaggaccataagaaactgagttgtcatgcagataactgcaaaactcctgtctcctttcagtataacttttccgagttgcctcctaggtaggaagaagcttttgaaataggagaaaatagttatttcatgtattcaggtggttatttgcataaatgaaactttggaacacattatcctttgctgattcccaaagacactaatgcccctgggacacacccagggcactgatttgaattgccaatgacaaatcaaagtgtcagtcatgggtagatatggaaagcatttgtgggccctccaggttcaatcagaactgtcagtggccctccaggttcaatcagaactgaagtgggccctccaggttcaatcagaactatcagtggccagtgtcgtagaggtagtaatgcttttgtttgttagttatgagcatgatacaggttcaataatctgaccagtaacattgcactctagccaggattagaaatatttttaggaagtcaaagccagatgtaaattatcccctcaagtaaatcttcatgatgcagattctataaaaattgtagaaaattgctattatcattatgccacctgtttgtataaagtccttttgtcaggcctggctctgtaccttcgagctgctctgtgtgcctcactctgccatttgaccatcacttttcagcaaatgagcttccaacacccacctacattctgaaccattatattttaaaccaccctgaactcttattcaacctgttcttgattgattgcagcttctgattcttagggaaaatcacctctgcgttttattattcttcctgtaacaatgtctgctgacttccatcctcagctacaattcacagtgagctcttacattacaataatacaaatgtttaccatgtggggacatctatatgtactcggcattatgctaagtgctataacttgatgagagactactttgtatttaagtgaagcagtgcacctgtaaagaagatttggttaatcccacaccactgccaccaacaaatacatgattggactgagatgtgactttaaagatacctgataccaaccaaaactcaagctttcgacatgctggggcacactctgtgttactgaccctaagccctgaaactctccctactgcatgcatttgtggatacattctgccatgttcaatgtggctaagagaatgagtgggaatcagatgtgtattctccgttatgcctattaaaattctattcaacttcagagagccaactaaaactcaaccccctgcctagttttctctgactgacctttctctcatctgaactcctataataattattcctttgattgattctgtaattgttcaccttgcacaactttagtgcatttctttctgctttattttaaaaacttatttatcctcattattattagtcagcattttatgtgttcatattatagatcccctgttacaatgaagactccgtgaagtcagacactttctctaacctcaacagaaccttgatgaaaataagcatttaatttttttcaacctaaggtactttaaaaggtttagaatattaggtggctagtaacatctaataatattctaatttctggagaaaacattcctgaagacacagagagggcaaaaacacaagaatagcaacaacaaaaaaatagaatttagagatacctcatagtcataaagctaaaggagctgaattaaagaagaaaaataatagttcagctatgcttcacctcatgaacatggagtgacctcaggatatcactattgtattcattgaggctgaaattggcagcttatcttttctactgcctgccttgtggttcagagtttatgatgtgcaaacccaccaaatactaggcaagcatccctgtgctacacaggtgttgttttctaaaatagccagaattctgttgctcttcgtctttgctcctctttctatatccatttagagactggaagtcacaggaaacaacacggcaggaagagtgggggactggcagtaaaataaggcatcctggagagtatagtaaccacaattatattgctaaagatggagctggagttacagaaagcaccagtagaaaggcaggctggggatttaattttttatgtatactaactacacccttacatcgacaaccaggctgggaaagttggagatgattccacctgtgtctagcaaaactatgctagtagtcttgttgatgaaaaatttgataaagaataatgcttatcaaactgcctcaagctgtacctaaccctaagaaaggaatccgtccacccctatgaataatgaattcagtccaggaatggtcacatgaccttctgtaaccattaaaggttccatttggctctatgtagcagaaaagtggacatagtgatttaaataaataaatctgtagtgggtttttttctctttttctttttaaatgtttgtataacaataattcagagcagttgctgtgcttggctaaacacattatcaaagacacaggtttatcatttttctccactcaccatctttagaatgtagttttttttttcctattgcctctcttctcatggccagcagatggctgctttatccttagcatttcagctacattccaggcaggaaagaagacaagcattaagggaagaaggcatgtgcaagatgaacctgctctcttttaaatagcttccatggaaagcccattcagcaatctctacttacatctcgttgttcaaaagggtatcaaatgttcacgtttagcttcaaggaagactgggagatgtgatttttaatcaggacacttcgctgctgcaaacaaaataacactggatagagattaaggctaatataagatcagagtgaattaagagtgaggtgagagtagggacactcctcagatcacacagggctttgcagtcgactacaaggagtttagattttattatttgatgcacaatcagaggccacgaaaggattttaagcacataagtctctctgttgggtaaagcataggttaggagaggaagagagaaaatggggacactattaaggagcctgtccatcctattctctattcaataaatcgtggtggcttgtgctagattggttgagtgggtatagatggaacaaaacaattaaaggacattgtcaatatagaactgaaaagagttgcagaggggttcgatgtaggtagaaagaaagtaggagtcttctgagagtcaagatggagaaactgggtggatgatagtgccaatcactgagacaggaagaaccaaatatcacagggatctggtgaggtgagatgtcaagtgggtcatattcggttgtgagaagcttgagatttcagtgcacaccgaagtgaaagtgtcatagggacaatcaattacgtgagtttggagctcagagaatagatatgccttggagatataattttgatgtcaacaaccaacagatggtatttaatgctacagaaatagccaagatcccattgagacaaagcgtagaaatataagagggctcgaacctttaaggagcctacaaagaagttaaaagactgattggaaaagggggagtgaaccagacgatgtcagttgacatccatgaatttcaataaagaaggggtgcccaagaagactcaaataaaaaatatatatacatacacacaaacacttaggtaactatggattcagtttctttgaagacaaaaatacttcaaaggaattgaaaatgagtcaaaactagtagatgtaaatattggtatatatgacctaaaaatattttaaaaaacccgagatgtttgtttcatgtacaagtattttggatataatttataatcatatacaaatatgcacagttatacaagtagtatttataattatatatttaaatgtatgttttgataaaaactaagcaattttagagattgttatatattgtaaatgttttttcgtctcctataaaagaaaaactgaaaatttattttgtacttttaactttcccataaacatatcaatcctggttcaagggagggaatatctcattgcaacatcagaaaggataggaaaatgtctggaaaatgataactggcttcaacatgcaaaataaatgttcaaagatagaatcaaagggcaaacatcaaggtaaatataaagaagctacacacagataataaagataatccacaaaacttaaaaaaaacctctaattttatctggagtaaattgagtggatattttgaactttatttttcatttacagtttgccccaggataaaatgataagctctattaatcagaaaaggttaatggcatattatatctttggtagattgataacagtctctggaccaagttgtttgtaacttctgttcaagagtacaatagtacctcagcagcaaatcacatgaaaatgtcaaccgtatgttagattttacccacttaaagaaaaaaatcccacaagaaacgttataggataatggaatgtgcaaaattaatcgcttttcaaggggtcgttccgagttttattctccttggttgaattccctccccaatttgcccctcagatatgcattctcttattgaacgatgtgattgtggcgactgtactggtgcccactttgagtcaacgtcgcatttatcaaacagttccctctcacccaaatattcccagtgtagtcactgctagcaatcctcctttatttgtactctccgtttgtacctggtggattatatattatattaattcataataccagctctgccaggctccctacagttacaattattaaagctgtaactgaaacgttatctctcatattgatcttcaaccagaagttcttgtcccgaagcttttgtttcacattaagacactaatgatcaccttcaccaaatgagcagcttaatagtcacaaaaagctaaatgaaaagactttgatcaccacctttgagagcactgtgttccaacatctctcccatccataattggcaaacactaactgagcttttaattttttttaaaaaaagaaacatacaaaatactctaaagaaacttattttttcagaaaaattttctccttttttgttgtgtttgccaagtatgcttagccctacctattctatttgttttccaggtcatataaagcatctgtgtgcctataggttatttctttatatgtgatttttaacaatttattcattttcttttcataagaactgagatgagttatgaattcagttgaagtgatagaaattatgcagcacttttgagtgcctatttgatttacttgttaaaagaattggtacagattaatcagtatggtctcccccatatctggagggacaatggagctactcaatggttctttcatattcacatttcctcctggaaaaagtagaataatgactctataatgaagtctttatacaaacacaatgtatcccgaaaaaatattaacaatatttttgtaattgatcaaatgggaagaaaattctctttgggtattaattagacatatcaacgttattcactccactgctaaaaaagtaacaacactacagagactttttatatccaagttttaaatcaactttatattgtagactattaattttcccaatgaacctgcagatgcataatctgaaagtggacactctgtagtggtggactatgcatacatagaaagaaaaccacagagggttaaaaaatagcaagcctgagtttttatgggtcattagctctttaatgcacctcaagggctcctaaaccaatgaactgagagtcttgggaagactctagcctgacccgagtgaaagaaatgaggaagagcacaagtattagcagtgctcgatgctattaaaatattaaccaaagactaatttgaaaatgtattaaccacatagtaagttaaggcccatcacagatcaaatgctaagttttgggacaggaagaaattggcgtaagtaactggcaaatattcagggtggaaagattggaagggagaaaagctatcatggaaaatgacctgatagccttttgaggccttgtggttgtcagagatccctgtgataatgatctgcatccattggtgcttcttccctgaggaggcaaatgcctgaaaaacagaagctccaatatttctatgggtgtggagcaggtatccgcatagcacagtgaagaaaagtagtggggatactcaccactctcattctcagccacagatcttggggtgactaacgctctctgaagtcatcttcagaagccactataactcttttaaagttgcttccttgaacttagaaatgggtgcaatattttgggggaggcctctctaactgctgcaaaccaccaatatctctaaggctattaatgatgatcatcttgaaaacccaacctagtagcagatgtggtttcaatggaaaaagaaagagtcaaatccatgtcagagaatcagaagagacagtggatgttgtctatttgagtaatataaaaaataaagtgatataattgaatagtataatatacataatacttgaaagaaattagtatgttatacattgaaaataaaatacgtatgtctgtctagagactatttttttaaagacggacagatttcaagggaatcattccacggttatgcttgaacacaaatgagttactatatcttcaaagattccttcagatcaacaattggtcatgtgaggaagagagatgacttaattcccttaagcaaaatacttcaggaggcttttgtcacatggttctaaggatttacaaaaattatttaatattgatggaaaatattaaatgagcaattatataagaaaacttttatattattcacctatatcaatgaaacattttactcagttttagttgcagttttcaaaaacaattgagaaaagtatttaataagaaaataaatctaactactttgttaatttaggttatttgcatcatgttattaaaaaagtggaattgatattcatatgcagaagacatgctatgaataaattaataattatatatcctaaataagcttgagttttgggcagctagttaaattattacatgatagcagaggatgtatcttctttcttttgtcttctctgtcatttaatattaagtagtaaaaaaaaactagtaaataagactaagaataatcatgtactgctcaggtcttttttggttgtaaacgtagaaaccccatttgaactagtttagaaaagaaaaaagagtatttgcttttataacacatattcatgatctactgataaaccatccccaactgtgtatttaacttacaaatctgcagtttgggcaggattcacaaggcaaggctcatctcattggctggggcagctccacttaggcctgaaagatttactttgaagacagttctctcacatgattgaaagctaatgctattgtttcctgaaagctcagctggggccgagggttgcagattggagggggctctctttccttccacatgggcctttccatggcctccttcagcttccttatggcatagggactacgttccaggagccagtgttccaagaggaccagaaagaagttgtataaccctttatgtacaagttttggaagtcttaaggagtcactttcttggcagttacagccctgccatatctaagggaaaggaacatagattctcacagtgaggagtattgtgaatgacttggaaaataaaatatgcgacataactgaaatttagatatgctcttttctctatctgtgcacctttgcctctcttttatatgctgtcttctttttcctctgttaagacagtctttctccattaagtgggtaagatgagagccggctgttcacatgcttagagtactctgtcgtagaattaaaaggaattcttctccatcagcttgagggggaataagggcttaaaaggcaaagttagaatttggacagtactcgtcagaaacataattaggaaaaatagtccccactctcaccaagtatgggttacattcaggtcagacaacataaagaacatccactaaaagttttgacaacagaaaagggtcttttgcattttgctgcctacctttcactttcgattgcatactcatttgtttattcactcaagtatctgtacttacactctctgacagggagtgttctacatcagtgattctcaaagggtgatctagggatcccttggggttcctcatcctttcagggggtccaagaggtcaaatctattttcataataattctaacatatgatttgcttttttcactctgatttttataagggtgtacagtgaagccttccagagcctacatgacatgtatcacaatagtgaagagatttcctgctgtcttctcttaagccagacattaaagacatttgcaaaaacacaaaccattgcctctcttgtcactgaatttttctttattttagaaaatagttattttattaaaaatatgctatttgtgttaataagcaatgcatttatttactgtatctacttaatatgtgttattaaaattactcaaatttagtttctaacaagctaaatgttgatagttgtaacccacattaacaaggtctttaaggaattaaaaaaatttttaagaatataatgtcctgtgaaaaatgtttgagaacctgtgtgtaacttgaaatgtgatatccaacaaagcaaacgaagcctctgctttctgagtacagaagagatgccagcctacttcaaggaggattacaagatttattatgccgcaccataattatctatcaatggtcaaggtcctccacaaaactctaagtttctagagggcagagactatatattattttcagaaaaaacttcaaaaattatagttattttttcaatgagaaatacaaaagtattcaattttaggcattcatgaactccattgaaggatgaaatttttcttattaatttacttctaaggtggcaataaaaattgagaagttatcagttttaaagaactcattaaaatctaaggcttatcagaaattgatattggctaaatagtatctaaagtgacatataaatgttcatgatgtctgtattgaagaattcacgctaaataaaatggtattatgttaagtgcattttactgatttggggttgttataaacctacaaacaaaatgttggctatttttcttcttttaatttttaaattttttattactattattttttgtagagatgtgtctcgctgtgttgccctggctggtctcaaacacctggcctcaagcaatcctcccgcctcagcctcccatagcactgggattataggcataagccactgcgtcaggcccatttttctgatcttgtgttaattttcctgctactgagcatacatagtacatgcttcatacattttgagtttgattgttttagattagatgcagattgtaatatagaaatgcaatatagaattgcttgagcaccgcttttcatcgccagtctggaatcaccaatttattttctttggctatgattttggagtctttagaaagcaacactaaaatcctagaggtaaagccttaggctcatttagaatgagaaatgctcatttgctgccatgctaaggtgcatgcaattatccagggtacctggcaattaacacccttctctagtgcagtgattacctaatttggctaagaatcattagagggctttttaaaaatacagattcctgcacctaacctagaccttacaaatcagaatccagcttctactatttactgagtgtcaaatgtttgatatctcaaagctaaacaaacaaacaaaatctaggaagagtccctatatttgcctgtctctgttttgaaactcagcctatgaaacaaagagcactatatcatagaagtcatcttgcattcaaaagctacaaatatccaccttatatcctgcctataagtctccaacttcctcttatgtcttaagaaaagtctagacatagctcaactgtgtctaagcaaatctgtgcaagcaaacttcagatatattgcaggtttggttccagactaccaaaataaacaaatattgcaataaagcaagtcatacaaaaattttgatttcacagagcaaataaaagttatgtttatactattctatagtctattaagagagcaatatcattttgtataaaaaacaatatgagccaagcgtgatggctcatgtctgtaatcccaacactttgggagactgaagcaggaggatcacttgagccttgggattcaagaccaaccttgcccatgcagtgagaccctgtctctacaaaaaattaaaaacaaaattaatcgggcgtgcttttccatgcctgtagtcccacctacttgggaggctgaggtgggaagattgcttgagccctgaaggtggaggttgcagtaagccatgattgcaccactgcgctccagcctgggagataaagtgagacattgtctcaaaaaaaaaaaatgcataccttaatttaaagaaatattattgctaaaaaatgctaacaatcatctgagccttcaaagagtcatatcctttttgctggtggaaggtcttgccttgatgttgatggctgctgactgatcagggtggtgatttctgaagggcaaagtggctgtggcaatgttttgaaataagtccacagtgaagtttaccacattggttgcctctttcttttgtgaaagatttctctgtagcatgtgttgctgtttgacagcattttacctacagtagaatttctttcaaaattggaggcaatcctttcaaactctgctgctgttttataaactgagtttatggaatattccaaattttgtcgttccagcgacattcacggcctcttcactggggtacattccatctcaagtacattctttgctcatctgtaagaagcaccttctcattaaaattttatcatgagattgcagcaatttagttacatcctcaggctccacttcttattctagttgtcctgttatttttaccacatctacagttacattctgcattgaagtcctgaacccctcaaagtcattcataaggattggaatacacttctttcaaactcacattaatgttgatattttgaccttctctcatgaatcatgaatgttcttagtgacatctagaatggtaaatcctttttagaaggttttcaaattacttcgtccagatccatcagcggaatcactgcctatgcagctatagtcttattaaatatatttcttttttttattatttttttgagacggagtctcactctgttgcccaggctggatggagtacagtggcgtgatctcggctaactgcaagctctgcctcccgggttcactgcattgtcctgcctcagcctcccgagtagctgggactacaggcgcccaccaacacgccaggctaattttttgtatttttagtagagacggggtttcaccgtgttagccagaatggtctcgatctcctgacctcgtgatccgtcgcctcggcctcccaaagtgctgggattacaggtgtgagccactgtacccggccttaaatatatttcttaaataacaaaactctaaagccaaatttactacttgatccatgagctgcagaatggatgttagcaagcatgagaacaacattattgtccttgtacatctccatcagagctcttgagtgactagctgcattgtcaatgaatagtaatattttgaaaggaatctttttttttgagcagtaggtctcaacaatgggcttaaaatattcagttaagtcatgctgtaaactgatgtgctgtcatccaggctttgttgttccatttataaaatacaggcaaagtatatttagtatcatttttaagggccctaatatttttggaagggcaaatgagcactggcttcaacttaaagacactgataactagagaatcagcctgtcctttgaagctttgaaaccaggcattgacttttcctcttgagctatggaaatcctagatgacatatttcatataaaggtatttcatctacattgaaaatgtgttgtttagtgtagctagcttcatcaataattttagctggatcttctagataacttgctgcagcttctacaacagcactttcagcttcaccttgtacttttatgttatggagatgacatctgtccttaaacctcatgaactaacctctgctgccttcagacttttcttctgcagtttttccacctctctcagccttcaaggaattgaagagggttagggccttgccctcaattaggtgttagctcttaagggaaagttgtggctgctttgatcttctatccagaccactcaaactttcttcatagcaacaagaagtttgttttactttcttatcattcctgtgttcactgtaggggcacttttaatttccttcaataacttttcctttgcattcacaacttgactggcacataaagcctagatttcagcttaacttggtttttgacatgctttcctcactaaacttaataatttctagcttttgattttttttttttttgagacagaatctccctctgttgccctggctgggtgcagtggtgtgatcttggctcactgaaacccctgcctcccgggttcaagtgattctccagcctcagtctcctgtctcagatactcccagatacagagtatctgggattacaggtactcagcaccatgcccacctaatttttgtattttagtagcaatggggttttgccatgttggccaggctggtctcaaactcctgaccttgggtgatctgcccacctcggtctcccaaattgctggaattaagtgagagatatgcaactcttcttttcacttaagcacttacaggccattgtagggttattcattggcctaattttaatactgtggtatctcagagaatagggaggcagaggagagggaaagagacaggggaactgccagttggtggggcagtcagaacacacacaatgaagcttaataaggtgaagcacaataaaatgaagtatgtctgtacttatattttccttctccacaaaacatttccctaaggggtgtgcatgtgtgaaagatgggtggtggggaggaaaagaggagagagaatattgagttattgcaggatcaactttgctccatgaactttgtaggggcttttacttacttacccttgctgccgttcaccagcaaatctcagtttctagaaggttgagaattaatacagttttgaggactggccctagtaaggcaaatgtttgagggtgaaagaaactcagagacatttgaggcaatcacgtgcaacagctggactaggtgcctggcagtagaaagctcacaaggacttaggtgagatggcgttatgtaataagagatctgactgtatgtaacagggcacctactaagtagcagggatactaacaacataacctaccaggaaagagaatgagcaggacctcaggggagaaagcccttcaagcagcagagtggttcagggtaaatattcctcatcactggaaggatcaggagaccaaaggccagctgccaggaatagaagattaaacttaacagattaagccagtactagaagcaggtaaaggagagagggaagggctacaagaatgcttacattagacctagcacttcggcctaactggcagcaaagattcaaagtgggatactcactgactttgagacttgagaggctcactgaatatgtattctctcaagatagtagaagagaagggcctgactgtattctggcttctgttaactggttctgtagctaaactaagcctgttagaagagctggtcttcagataagcaacagtaggagaaagtcagcttggctgtgaggtgttgtcaggtattgtaatttattcataacaaatacactgatttttcatgaccaatgactaattagcatcagcctaaagaggtctgtattgttgaaattatagagacttaaggtgtctttcagatgtaagccatgttttttctgggtagtgggaacaacaatcaatcaggaaagtgaaaacagcatcagtgggcaccatcagaggctacaattttttttgtactgattcaaacatatcttttaaaaatgattaagtatataaaagtatctaaaaaggataagataagaaatacgagctcacaaagggggaataaaagtgtagaacagccgaaagggtccctcagtttcaggccgagtgtgagaataggacactctaaaacactttaaaaatctctaaatacccagagatttctttgttttggattgtatttttcttttcttttttttttttttaaagctaaagatgaaatgctgtcatattacaattttgtttactggaagcaaaattgaccaaaagaaactgtccttaaactgaagtttaaagttggaacctcatgaaaagacagtctttataaatgatcaagttggcatgtcagggtaaaagacaggaatgtaagattaggcaaaccagaattttctctgctgtgattgcccttgctcttgagagctcgttctttctctttgactattagcccatggcagttgactcaactagggaggtcagcttctcagccgcccaagtcccaggaagaaaagacagaaacacgtaacctgaaatgacacagccgctgatgcagcttgttgctctgcttgcttatattttgaagtatatcatgtaagctgaattgcaaagaatagcattcgacagggtgaagggttgcatacactgaagaaaaggcaagattcttggtgaggcaaaagtctgaaggacaagtgcctttagcatcaactgaaagtcttactgtataatatgacctcaacaaaattggacagtgctgcatagtcaagaaagggatagcaaactgaaagaactgatttagtggtattgccatctagctagcttacttaggaattatttctgatgactttaatttcaataaggcaggactaattcctttatccacatttccatctatatctttgttggatgtttggggatggaagagtccaatagtaaaagggaagtagattcttatgtggcctcaaggaaacattgtgtattagtatgggactggataactagttatctaatatctagttactttatatatttgagcataaatttaacaattaatgatactgatttaagagactgattttgtcaatcaaatgacattttggaggtaggtaaaaaaaaaaactaaaaataatcccgcctagctaatacagtccttttcttgctgttgttgttgttttaagacaagttcttattctgttgcccagactggagtacagtggcgtgtttatagctcaccacagccttgaactcctgggctcaaacactcctcttgccttgaggtaggcaggactacaggtacaccacgatgcccagcttttttttcttttttctttttttttttgtagagacaaagtctcactatgtggctcagactggtctcacacatctgacctcaatcaatcttccctcgttggtttcccaaagtgttgggaatacaggctcagccaacacagtatttaacacagtattttgcctacagaaattactcaagaaatactcgtttaaactgtagctcaatttcctcattttccaaatgaatgtaataatttcctctatataatatagtgctctgctttcacaaaatgagtttaatatatgtaaaacaattttgaaaaatgaaatgaaacatttttattaatacgttccgattgagtttaatatttatcccatgcctgctatgtaccaagtgctctgctcatctgtttactagaatggtgtggatatggtctctacttaaaagaaaaataatctttttctctttaatttacttcgtccctattgaagttttcattgtcccattgatttaaactattgacacatagattgaagcttgtatactttgaacttatcttgtatttttctttgcttcaaacttttggttctctgattggtttttaatctctgattgtgctgggaccaggtcataatcacatggaagtttccttcaaactgcagtctcctctaagattctgcaatatcccctaggagtgctaccccaatcctataattactgcaatatgagtggctgtcatttccagatgtgtttccttcaggtgtgtttgagggtggtcaaaataatagagatcctcattcccgatagatccttgtttcatggttagaatgcacttcaccttcatcatgtactatggtatcaatcattaactgctatcataggaaatctatttattctttgccagcaccattagaaagacttcataaaccaggtaaaagtgctttctcttaagcagaaattttaaatgatgttttgtagcataaagtgacaatatatatatttaaaaattttctaacccccaaattcattagtttcaccaagtgcttccagcctccatcttagtccttttcttctttaactttagaccccaaattaacttctccagagctccctacaacgtatcttgtttcttgagggggaaaaataaacccccaccaaattcctgtaaaggatacttaataaatagtcattacattccttcaataactttaccattaagcttctgttgagtttgtggctaacatttcaaaaataatctcaactttttcttcttattgctgctgagttgggtgtgtctttcattgtggctagatgagggacataaaattagtggtaaagccacaaataaccagagaaatttgataatatgaaataggaatacaatcatattttctttgtttatgaataaaatttaggaatctctatttaaataatctcgacttatgaagagcaaaaatgtttgccttttgcactatgaaaattttactttaaaggttattctgttaaagttttctgttttaaagtttagctatacagtttttgttttaagagtttataattcttgttcttggggggaaaagagttagtattacaaaattcgtttatattaaacatgtcctttttgcatgtgaccaaaatcattggttcctaggtatgttttgcacctgttcatgtcctgtgattttagttctccattcctcatctttgaattgccactgatttcaaatccctgtctccaaaacaatataatgaccattctctgttagtctatcttcaaaacattcccacttggtcctatattttatcagccttcacatttccctgaaaatatcccctaaatgaaccacagaggattctgtgctaaatgcccaggaccacaatttgggaatcattactctatgtgactgatttctcccgaaacaaacactttgatcatttaaaaatgatggctcttgctgagagtactaatgagcaaattcgtgctttgtggtttatacacaatggaggattaaaaatgggttcagaattggactccctctttagtcttccaaggggaacattagtgagagagttatttttaaaaaattaatcctattttggcagcttcccttgatttgaatatgaaatggtgttaagtaggtgaccagtgaaatgactttctcttttctttgtagatgtctgtaaacagtggaaatacgaaaatgtttctgtggactttctagatccaaggatctagtggcccctcacccgctaataacagccaagagattattttgcagctcctttcacttagtgtctagaaagataaacatagagttagataatagcatgaatttttttttctgatatggtgcgaaagcaaatgtaagcatttcactagttgactatttcttggggaagactcatttgtctgtgtaaaatgccttcaaagaccaagaggaagccaaggccacagggaattagagaagggctagagtccccacattcctttgccttctcctttaaccccgactatgtttacagcccttagaaagtgcattagggagtgagtcttcaatctgaagccttaagagcagaagggtatggcctctactttaaaaaggtattgtttggataaagaatgcaggggttccttcgatgataatactagctaacatcattgagcacttatttcacactgcccttgaagtcacttcagaagtattaatccatttgatcactccacaactctaggaaataggagctattattgcctccatcttgtagatgaggagactgagacacagagacgttaaacgaattgccctaagccacaaagatgagaggtgcatgcagtctttgaatctactagttgctaccattgtaattttgcgaaaattattctctgctgaatcatacttataattctttttgtattccacttatattgaaggatctgataaggaagtgggacttttcatgatgtaaattgatgggtgagagctctcatttatccaattaggtgggagaatagcctggtccctttctctttctttcaaccttttgaagaaaaagtttctttttaaaatgatacattacattgtaatcaatatttatgtttattaaagttatacatgaagttaagactttagtctagaaaacttttgattcaacatagcatttctctgacttctctacctgtctattcatcagttccccttcctagaggcaactgccttcaacagctttgtttttttgttgtttcttttttgtattaaccttcttttctttttaaatattacgcatatactgttttccctgatttatctgttctaggcattatgcactttccgttactatagtttaatatctcatttacacctcacagcttcttcccttccctctattgtttcatcatagtttttcacaatttttagttcaattactaattgacattattattttctaaatttttccaactatgtcaataattatataaacataaatttctttgtattcaattttcttggatggagtaaatgattgcctaaattttaattttacttatattttatcataactatagctatttttccaaaaatatcaacaaaattgccaaatatctatcttttggccaaacactgaattattaaataatgtagtgcctccttttaaaaaatttcctcccattgttctccatctgcttgcttaacacatcttgaactaaaggctctattggcctaacacgcagtgcagaacatgtaacttcttgttgccatgttcctatgttcctgtgttcctgtgccttattattttgtcattattattattattattattattattattattattattatttgtctcccaagctagagtgcaatggtatgatctcagctcactgcaacctctgcctcccaggttcaagctattctcttgcctcagcctcctgagtagctgggattacaggtgtgtgccaccatgcccggctaattatttttttgtatctttagtagagatggggtttcatcatattggccagactggtctcgaacccctgaccttgtgatccacctgcctcggcctcccaaagtgctgggattacaggcatgagccaccgtgccggcccctatgccttatttctaacgatttttttttttcccttggtcaaatccttcattttgcctaaacacttcccctagttgcttccaaacaagaatatagtggaaataaacacatttagtccttccatatcaggaaatgtctttacttaatgctatcatttgattgataatttaacagattatttaattataggtggacaatattttctcctcaaattttgaaagcattcttctagcctccagtcagttttagaagagtccagtacgattctgattaccaactttttgttgtaagtgattgttcccccttcctctctcttccacatacactatttttggaagattttacaatcttttcttagccccagtgttctgtaactatatggtccttcttgttcatttattgtacagggcacttggtaagctctttcagtcagaggctcatatcgtaaaatttggagacattctcttgtacttcatgttaaattctttttccagctattaaaaaaaaattgttcttttggatttttctattaggtagatgttgaacttcctactttattctctgatcttttctttctttcttttttttttttttgggagacagtctcattcctcattgcaacctcccctctcaggttcaagcgactctcatgcctcagcctcccaaatagctgggattacaggcatgggccaacacacctggctaatttttgtatttttagttaggatggggtttcaccatgttggccaggctggtatcgaactcctgacctcaagtgatccacccacctcagcctcccaaagtgctgggattacaggcgtgagccaccgcacccggacttgatcttttctttctactcgtgtgttcgcttttcctgatatttttgggttagctattttttcctccagaaatttacttgatttaaaaaatatatttatatttttactttcctaatgccactctcatttattatttctgtttttatgaatcttatatattttcttattttaattacagtgctaatagtttttgttcgcttgtttccatctgtttcttgtattatttctgcttactttgggtttctttctgtttgcttattttgatattcttatttcatttcacaattttttctaaagattgtaagcttcatgagaacagagagtgttttatttagcacttgaaacagtatattgcacatattattcaatgttattattcatacaataaatatttccttaattattagttgtaagttagtaagtagttaatttatagtaactcatatctgcctattcacatttttaaaagaggcatttaaaatgctgattaaaatttccttgtgtttggagcaggggcactggacttcttgactgacagtcttctctaaatcaatcacattatgaagctgacttttcattgcggatatccaaattttagtgtctgcaggacctgggagccattcacttctgctagagaagactcctccaattttctggatgaagggatatatttttgcctctgacatatctgggaggttgactgaggatggggactaaaagtcttgttgctaatgaggtagattttaatcccctagtttgcagtctcacactcacctcttccctctgcaatgccaagtgaccttgagtctagactctagaagcttccttgtttaattttgtctcatgaaggtctgggagccgtcagctgactatttgcaatgggtgagtaagcctgggagtctagcctttctgaatgatggctgttgcaggcagtcttgaccatatcttcatggtaccaggcactaccaagtgatcagcctcttggatattctgtagcgaaaggcaaatttgttaacttctttgtaattaataccttcatccccacaactgcaccccgggagtgcaggggtgcaatctcggctcactgcaacctccgcctcccgggttcaagcgattctcctgcctcagcctcctgagtagctgagactacaggcgtgcgtcaccatgcccagctgatttttgtatttttagcagagacagggtttcaccatgttggccaggatggtctccatcttttgacctcatgatccgcccgcctgggcctcccaaagtgctgggattacaggcgtgagccaccgcacccggcccacctatctatattattatttcttctccaagaaacatttccaatcaaaaggtcaggtttttttctttagaaaaggaacataaaccccaagtattatatatgctacgcaggtcgaggaactagtatccaaagtatgatcagttatttcaattaaagactcattgtcgggggtcattttgaaaattctatcttatttcagtaagagtagatgtcaaagctcctaagagaaattatggaagtccacctggaaaaggcttgcaactgacttggttcgtattttaaaaagaatgatgtatatgtttctaacaaggtatcttagggtaaagctattgaagtttgtggtgaattcaaataaataataggtcacatgtataaagaggtacaatataaaggttgaaaggccaattccaatatagtgttatacactatgctaagtattgcagatttaaagatgaataaaacatgccccttgccctcaagagtcccttgataggacatctgcttttcttcattttcaagaaattagttgtatgtgattcttactgttataatcttgggatgtgacaagttgtgagagaaatgatttatcagggaactttgatagctaaatcataccacagcaatcagattaatgagttttggatcaatctagtcattcttttttctattttcaccagaaactcctaactcccaatttagcttcaaataatattttttcaactataccgatttacctcttctttgactagttctcttttagaatacatctaagtaagtggtactaacctggaggtaaatgaaggacccatcttttataaaaatgtgctgccttgaagaatttttttgacagaaaaaaatggcagactttctcttataaaccgtatgttcttacatttctgatatctggaatcaacagcttgccagaaacatttccaatcaaaagccagactaacccataaaggtgtccaaagaagtctgttctgattactgaagatgttgaactagtcttgacttcaaacagtagatatttctacactttagtggtatatgacagctctattcattccacaatgtcaaattctttggttttggccattgggtatttatgcacttctggctagggaagcagagaagcctaatttgattctggagccaaaagtttttaggccctgttcctttggaacttggactggagaatgttggcactgtataaagactaggacagatcaagtagtcacacataactaactgactcaacagagcatattcagagagaaagatcatgcctacacatggataaccattctccaaggcagactaacaacaccctgaattcaatcacccctaaataaacacacaaggaaagcacagctttaacataccttccggcacagctctccaatgctgcctgattggttttagtgccataggccaggctgcagatgcagccattactgttgttcttacttatgtctgtctgctgtctgctaacaagcattcatatgctttggatcattaaagtcacaacctcctatgccaatctattcctctccacgggtttgctgtagatttgaaagagagatgctatttctgtttctttttctttccattaagacctccagtcagggttatttctgaggtctgaatatcctagcttgtacccttgccctcattgaacatataaattgtgttccattaagtttgttctttttgcctgatttatttcccttgctgttgtatgtgcctttttaatgcaaggcaaatgatttgtgctggaactgcaacagacaaaagtgctgtaacttaagctgcttcctgatgccactgctatctatgagaggtctgctgtacttacacccatggtaaatatcttctgacagactccaggtggtcaggattttcacaatccaacccatttcagtgttagcacttgtcatgtggggctctgtgaattcttccctttcatcttactgttggtggcaggttggatacatttggacatacctgtacaaggccacatgtgtccacagttataatcgaaggtggagaaacacaagtttctctttcagggaagcacagaggacagatattgtacaaagaaaaaaagaaaaaaaattgtcacttgtagtattatgcaggctgcccatctaaacccatcattgcctggcacctacacactaagggcaagaatccagccaacttgtgagtgggcaccatgccatttgagcagatgggcatggaagtcggcagccagtagaccatgtatgtgcatcaacggtgggtgttgagggcacgattcccagaggagaatgtcctaacagctgtctggcctgagccaacatacttacgaccaaggaaaagtgccatccttcaatcctgctgagttggattaaccttcagaactaaatctgctttttcggcagcagaaggtgagtttagggtctctgaaaatctcaaagaataagtgaagaaaggaaactgggaggatacaattattctctattgactaaagatactgaggacattcaatatgcttattttaaatctttgactgagaacctgttaattcttgaaagaatgttataattgttcaaagcttggcttcccacaaagctgttaaaagtgacctttaaacataggcagaccattttcagtgagttaacacttttccacctttgcattaagaaatagtgatatatgaagaaaggtgtcagtagactactgacagctgactgtgggtagatatctttgtcaaacttgacatatcatggattaaattagatctatcatggatcagagctttcacaaaagagaatttcttcttcagtgatggaacatacacttgaagaagtaagaagtaaacttcctatttcaacgaaagcctttctgggcaatgaaagaaacatttttatttgagactgaaaataaagcctgattctaatttgttaagaatttccagacagttaaacatcattaaattagatagaaattgtttctgccaaacatagccaaatggtgatttgacaatgatttgttttacttggttaggaataggtagataattttaacattcagatccttaattattttctatgttgctttcttatgaggtatttgtgtggtagttcttgctattgttttctgttgtcttaaatctttttattttaaatataacatatgactttagttgtggataaaatatcagtttggttcaagattatccacctacgttttcttaatctactccctaaactatttcattttgtttatatcaagagagtaagtgcttatattattgggagtgaaagagattaataagttattttatctgctaatggtaggaactatagctttggctttgatgaattatataatgtcttagatctaataccattagtaacattatgagtagaataaaatgtttatatgtctattttggccctgagtttctcattatatcaatttagaaattcatggctaaaaaatacgtgattctacagagaaaaaccaagaaaattatattacttaggcatctctgagtttcttggctctggtggttcttatcttaaaagccgatttgaaggctaaaaattgtggtatgtccaggttccatgtgaatgacccctctctgtctgagaaaacagagagaaacgatctagcgaaaatatacaaaaaacataggggaaagctaaagggaatggtattcagcaataagcaagaaaatgtgtgtattatctataactaatttttatttaaatagtaaggtcatgacgcagtttgattttctttgtggaacacatgtgtttgggactaaataaagcagagaaagaatattaaggagttagaatcattttagcaaacgcttccctttggctatctgggatataggaaaatgtggttgaagctgagttaaagtcagctagacttgtgccaggagcgagaggctggtgggcactgcaggtgatgcagatgtttataaaaaaaaatccacacttttttaaaaatctgataaacttttatttgtcctcaagaaggtttttgaatcatttcctttcattttgtgccagggataaaaaagaaaataagagtgtcagatttctgactgacaataataaacaatcaaaagaggcttagggaagagcccccctcccaaaaaaaaaagagagaatatttgcttctgaatgtccactatggcaattgaatgatattgtgggcagatggaggaaagtggaattgtgaaacaatttacttatcatacactaataaggaacaaaacagaaaaattgcatctttctttcgtttatgacattggctcccactaggattatgaaaagatgcatttaggtagtgttagaataattgtgggacatggataaattttacatgtgtccacaaatagttaaaattagaagattaactgtaaagaaaaaaaaagcttcactaactttccttaattcctgattgtaatagctttaagaaatagaatttggcaaaacaaatgaagatttgaatgtaagaattgggatacaccaaaaaaacttttaagagactgtagagataaaaactaaacttaaccacagatttattgctgcttttcatccaagtatccagggacgttgctaatgggaggtacgcctcagaaacgtacatgtctgtgaaaatgttggaacaaactaatgcttttcttcaagtgattttatttcaattctaagccacaagatataaactttcatcaaaaatgggaatctatttaaaagcagagctatgaggaatgtttcatgtttatgtataactttcatagtagaccctcctacacacggaaaataatatgcccaaattctgttatttttacagtatgtaatatatcacatactaatcccacccatcagtttcatatcctttaaatagataaaaatgaaaaagggatggaagaaaaaatgaagacactttgaaaaactgactttttaattcctctttttggagaaaaagatatctgaaaaacttaattatgatccatatcctaataagaacaaagaggaatttgaaggaaaatacgcattatatattcagaatactatcttttttcatttcgctttgcacaattagaaagctaagtacctggggaggggaagaacagaagtagaaagggagagagtggtgggtggtgataaataaggaaaaacacagattttcagtaatactaggttcaaaataatccaagtcagaagaattttatatttcaagttttttcaatggtagttacaaatcattcctatttgcaggacgtgataattcaataggaaatagtgccattgaaaacaagattgcccacacgcagtaaaaagataaggttggactctttttttctccccaaaagaagggttaccatcagttcaaatatttatcaggaaaactcagttgcttaatatgcagaatattgtaataaaaataatttaagacataattatgccaccttgaatgaaactcttaataaacagatcagagaaacagaattgtcagggccccttttctttttctaaaatattgcaagtaaattaagagtaggaattcacaaaatttttcaagtgggaattttagcatgatattgaaaccaacattccatcatttataaatataagaactagcaaaataaatgaggctgtgaacatttaattatgcaatagacatatatacatgttctattctgtttagaggggggacctatatactatataaaaacatttggaaacaaaataaaagagacatgcataaacataatacattaaagcttctcagaagctttacagaaatgcttctgtttttaagagaaaataatttattgaaataaagttgtatcaagctactgctaatattattcttctattcaagttttcaaaattcaataattaatgaacaattctagcaaaagcaaaaaggattgaagatcaaatgttggaaccctcctttgtcagcattctgaaacttaatctaagcaacttgaagaataaaatgtagggtttttatatcagatacattttaaaagttctgagattgttgaggaagaatttaaactactgtttaaaatgaaattctctctgcaatactggtagtagagattttataacacaaacaaacaagtatattttgatcacttactattagaaattactgacatatggatgtactaaatgtgaaatgttttctgggtataaataaatggttcataaggacatctaatgttttaagctggaatatttgtcaagagcatgtcccataataatttgtaaaattgtcagataataataataagctattaatcgatatctatataagtactataacattttctgttatttatactatggcttaggagagacttttttcccttcaaacttacttgataagattttggttgacccaagttttctttataattattatttcaattaagtatattatgtaaaaacaacctgaaatattctaatttttgctgatatccatgcaaaacaattaagccattttggatccagaatttcctaagtcataagtctcagtcaacataatctgatttggagtgatcacatatttctttgtctaatgctttactgagaacaacattaaagcaaaagacaggtgatgaaagctctcttttttcaacatcttcataacctggttgaaaatgatagattggctagtttattgatttaggaatgatcagcaatattacttcccctaaaggagtattaagatgattcacaacaaatttgaacctgatttctagcatcctgtataaatgtgtacaaattcataagtctgactctaaattctaccttagaaatatctttttatgcacgtggaggctctcaactttgtagttccccaagaatgtagtgactgcctacacacacacacacacacacacacacatacacttatattgctggagaaacaataaagtgtcatagttgagcttattcctagatctaggttaaaatactacctatgcctttcattagctatggattttcaaagttacttaaactgtgtttacacttcgatacttataaaaatggttaatattattaaccttttaaggtttgggtgagaattaaacatgctaataaatgaaaaacatagagaaccatgcctggcagataataagtactcaatatatgttagcatacaatattatctttgtataaatttctcaatttgcattcttatttgtaccatggactcaatgggcccctttaagggtgaaataagtatgtgcccagtttctattttgagtcttcttatttagatttgtttcccaaacttcaatcattcacttgctatgtttgtgagttttttccatatttcataccataaattacttatttaattatattatttaaacttaaatagctttattttaaaataaaatatattcataccactagtaaatggttttggtgtgatacatttttctatgaaaccttaggattttataaatcattacaatgaaaacactcatcagctaaaataatctcttatgctcctaataatatgtacaccacacatttccaaacactgctttaaataaaagctttctataggtgattggaaaggaatattaagaggcaagtgggtctgtatgcccataagaatttagtagtggtcagatgaaagagggcatggagctagccatagaagaaatggtgcaactgacatagttaaaggccaagtgcccactcatcaatattgtggagacatttacttgctacttctctaacacttaagacttgagtttctttactttccaggagaattacttttgtcctaagaatgggaatctagttgggttttaaggaaatagaacaggaaaactccttccatcttggaactcttccactcttgaaagttaaatataagacgtatgtatgaaattttcagtggagagtataaatcttagtataatgagtagtaattaagagtagtacattctaaatgtatagcaagataaaataaatttctgtttttaaagaggtttagataccaaatgcatatattctttcactcctgagaagaagctgaagtatcagtggataattaataagtgtgaattttgggtttctacgatcactcccattaactaagtattctgccctcagtttcctcatgcatagacctttcatttagacgttaattgagcatcaactatgggtaacatatttaaggtaatgctagcagctgtaaaatcctctaaaatagatgatggttccaaaaaatagaagcttatttctcacttatgtaacagttagatggaagttttcttcaggaactccctctgcaacttttctcttaagtataaaattattccacaataaaaatttagcaaagaaaacaaagtgagctttactggcctatgtatggtttccccacatggtgattcagcgcccaaactccttccatcttgcaacttcatccctccgtagggccttgttcattgttttcccagccagggtgtaaggaaagagaggacatggaggggaaacactccctggttaatagccttagccagggagtggctggcattgtttctgctcacatcccttgatctgaactagtcacatggccactcctaactgcaaggtaggctgagaaatgtagcatctagaaaagaggatacaattttggtgaacggccatacccttcaccatatagccgtttacaccatccatccacctccccaatggacacagcctaaagttccatccagttacagcatcaagctcaaatttcagaatctctggtgataaacagctctctccataaagctcaggttttacgggaggggtggggagacagcccaggtaagtgatttagagcttgagatataagctctgtcccactttccctaccacgtccaatggacaacaatggagcaagaacttggtacctgggaaaaacaaacaaaaacctttctcatttgtcaaaggaaaaataggtaaacagccaacagtcactggaccaaaacaataattgaatcctgctggccagtctctgtgagacaacttccctcaaagtcaagacagtccccggctctcctttctgaaattccccatggccactgttctccagggtttctggccctgctttctggagtctgttccttctcaattatcttccataggacacctgtgaagcgaacattggggaaaattatctccttggatttttactttcttcataacccagttttcctagagcaaatgtggggttccaggttgtatagagtcgtggaattttttaggccaggattctgattttttttttttttggtagaacaattctctcaaaatcttcacagacattgatctaattccttcagtcagttgtatgtgccagtaaccagaaccaaaaacaataaagtcctttcctagacatagtactcaggtctgctttatttctttaatttcttacacttatctctctttctctctctttctctctctctctcatcctcctcatgccccttcttccctccttctttctctccaagtaaatatgaaacaatattaatgggagtttctgtttaaattacaaaacagtgtaagattttattataaattctctttctctttatgttttattgtagaatctgtctattatgcttcttcaggaaaaagaacattaagatttattttaatttgttctaaaagtacataagaaagtgtgatttttgagtatttaagcacatctggttactaatagaagacaagagacttaatagaatgttgatcctgtaaaagctgagctcacatcatcaacaaaaaaaaatttcaatatgaaatattttgtcctagtaacaaatcaccttgaaacatagaggtgtgaaacaatgtttttgtcatgcttagagtatgtccaaaaatttagatgaagcacaacaggaatagcttgtttctaccccacgatatatttgagttctcttctgggacgtttgaagtttaggggaaactcaatggccaaaaggcaatcatcgggagttctttttttttaatttttatttttttttagagtggggtctcactctgttgcccaggctggagtgcagttgtgtgatcatagcttactgcagcctcaaaatcctggctcaagtgattctcccacttgagcctctggggtagctggggactgactgactataggtgtgtgccaccatgcctagctaattaaaaaaaaattttttttgtagagttggagtctcactatgttgcccaggctagggctctttttaaatttaatgttccatttttaattattaggggtacataatgggcatatatatgtacggggtagtgtgatgttttaacacacgtctacaatgtataataatcaaatcagggtaattggggtattcactaacccgagcatttatcatttcttatttcacgtgttctcactcatttgggggcgctgtaaaacaattgatctcatagagatagggaatagaatgatgattaccagagcctgggaaggatagaggacttctttatactcacaagcttggtggttgatgctggctgtctgctggaacctcagcctttctatcaatcggaaacctataaggctttccttgtgcttactctgtgggtgtgatttgggtttcctccaacatattttccaagagtgaaggttctcagaggacacaggagaatgtatgacatttttgtgttccaatctttgaagtcatagagtggaacttctgctgtacttttttattgaagcaggcataaggtctgcccaggttcacatgagagaacacagacttcaacatttgaagaaaggggtgtcaaggttacatggtaagaagagaattgggtttgagatatgcttgcagccagccatctttgagtacgtattttatttaaattagtcaatgtccaaaacatttacttctcattttatatctacttaattcacatgcttgaataacactgaattggttattttatgtgtattcttactaaactctatcaagaaaaattatgtaataatatccaatgtcaatatatttgcagatatccagacacagaaggaatcattcacagcatatcttgaaagatgtcattcctccattggaacaactggtgagtgtttaagtcattatattcttcatctactgatacaaaataaattgccacaaaactcagcaacttagaacagcttaagttattatctcatttttctgtgggtcaggaatcagggcaccacttagtagagggatctagcttggagtctctcaaaacgttgcaacaaaagcatcagccagaattgggatctcatttgaaggcttgactggggaaggtctgctttcaagctcacttatgtggttgttggctgggttcagttcttccaggaatgttggccaaaggctgcccttatttccttgccacaaagatttctccaaaataacagcttgctttttcaaagcatccaagatgagaaggcaagagggagagtttgctagcaagatggaagtcaaaaatctcttgtaacctaattgtaaaagcaatacgccatcagctttgccacattcttttggttaaaattaagtcattaagtctagttcacacaaggggagaggattacataaggatgtgaataataggaaccagagactacagagggcttattgtaaatgttgatagttttttttgttattgttgttgttgtcttcaaaaaaaaattaatcgactcaacatccgtaagaatggcacttttttccatgtttttgtgtattgttatatcctagtgacaaaaagagtacctgaaatattgtaaataacatgaatgaataaagtattatatatatcttaaaaacacgtaagaccaacctttctgatatgttctgatacttctttcttttaatgacctcttttttgataaatacaatgtgcttttcctctatgctcattcaacttgtctttcctgctatatttcatattggtcaatatgcttccagtcttattggcttacaggatattgcactatgattactgcattcctgtctatctctagctatttcatccctgttatctttgggatgtcccatccttagcaccaacaataatttctttttttgcttcagtgttcctgttttctattgcttttcatgttccagatcccacatccccactccagctatttctccttactctgctttactttaggataagaatttctccaaataattgtctacctttgctgtttccaatttctgccctccctttgtctcttgaactaactctgtttaggcttttatctcaatcattcacctcttatccaggtcactgattgcctccatgttgttaaatccatcagtaacttctcagttgtctcttcagtaggtctatctgagcatttaacccaattgatagctctcttcttgaatcaattgcctagtgggtacaatgctcactgtttgggtagtgggtacactagaagcccaacaaccaccagtatgcagtatatccatgtaacaaataagcacatatatcccctgaatctaaattttttattaaaaagaaacattttcctcacatgactaccagtaaccactttctcatggctctccaattagctggagagccacctcttttcaaccccctttactggtccctcttcattttggagctcagtttttattttttattttttctgtctgtaggaatttcctagggcatctcattcagtgttgtagctttagaccatgtaacactagccagttctaaatttctatttccagcatggaccacagctttgaacttcagtactataaattctggcatttttacacacagttctaatatacatcctaaacttagcatatctgaaactgatcccgatttttgcccaaacccgttctccatttcacaagtcttctccatttcacaagatggagaagcacctccaggtgcttcagtcaaaacactaaaagtcatcttcccttgtttcagtcgtaacataaatgaacaccaaagaacccagtttgctctgtcttcaaaatatacccagaatcagttcatttctcaccaccattactatcatctgtcacccagtttattgaaatagtctccctgtttacccactttcgctttctactgtttattttcaacacaacagtgggagtgatcctgttaaaatgtaaattagattttgtttcttatcttagtcagtctgttactacaacagataccacaaacaaggcggcttttaaacaacagaaatttatttctcataggtctagaggctggaagtccaagatcagcattccattctggtcaggatctggtgagggccctcttctgggttgcaaacagctgacttctccttgtatcctcacacggcaaaaagagggcaagagaactggggtcccttttaaaaaggcattaatcctattcatgagagctccacctttatgacctaattacctcctagtaacattacattggagtttaggatttcaacatatgagttttaaggggaaacaaacattcggtccatctcacatcactccttgactcaaaatcctccctggcttttagtctaccccaggtaaatgctaagaaacatccaatggttcactaggccctagaagactcatcgacttccccagtctcacctctccctttcttctcctgtctccttctgctccaatgaagctgatacctcttcctctgcccggccatcccacctgcttttgcctctatctcttacaaaataatatatttggtgcccagaaatttggatatctcatatgttcctctgctttacatctctgctctaatatcacctttttaaataggtcttccctaatctctcttaaaaaaaaaatgaaacaaaaacaaacaaacaaaacccatagtggccaggtgtggtggctcatgcctgtaatctcagcactttgggaggctgaggagggggctcactttaggttgggagttcaagaccagcctggccaacatggtaaaaccccatctttactaaaaattagtaaatttttaaaattttaaaattacaaaattagccacgtgtggtggcactcatctgtagtcccagctacttgttaggctgaggcaggagaatcacttgaacatttggggtggaggttgcagtgagccaagattgtgcagagagagataaaaaaaaaaaaaaaaagaaacagaaaggaacctacaaatgaacaaacaagaaaccacaccatttccatgtacacttctgttaccttaatttactctatagaccttaccaccagatggcatactacagcatttatttttgttaagtttgtcactccattagaattttagttctatgagggcaaggacactgtctcctgtgttcattacttcattcccatgactacaataattgctggaacatgttagggactcagtaaatatttgttgaatgaaggcataatgaaaatttaatggcttttgttttcacttccaagcttgtgatacacaggtctatgcttgtaacctttctctcctgtgaattagtcatttgttctaggatgtcatctctatcatcacagaaatgaaatccctcaagttgaacccttcatcagtgccttctcaaactgattccctctttccattgagcccatctctattagtagcaaacatatatctaggatgagaacacattttctttatattctttattttctccctggccctttggataagtcatcattttctgatgaaacgtctcaatggttgtggtgcccatatgcttctccttgtgcacccccaaaccctcacccaagccttgaaatgcttctgaccttatcataccctatcatcccccccactgatcctaggcagcaattccagaacagccttctttcaatagtactttcattatttcattttcaaattttctacagcatcatggtccccaatttacgttatttattatcctctctcaaacacataccctcaagccaggagtagtaacatgattaagacatggctcttaccctgaaggagcttggatttcctgtagcaattacagtcctttcatcccagcacatgttcatgtgttgttttgtgttgctcactcttatttcataggtaatagacttgttccatggctggattgtaaatgtcttgaagttagaggccatgacttgtattttctttattatatcgtacttctacttagattgcttttggcactagtacttgttcaggaaagacatgcttgtgaattgatgtaataagaaattaaaagtttattaaaacaatgttgctagttgcagacattaataaatatatgcctaacatttgtagtgaaagccaatttttcaatataattagatatactaatatattgttttcaaaattaattacgtggatctcaacttagcattttctctaggaaggatttctctaattccttaaatttgaattagatagcccttctttgatctgtctctcaatagcagctgggtcttgactctattccagccccatcacactaaaattgcctatttcctttattgctcttactgagctataagctatttgaagggaggactatgtcttatttattgttttactattaaaacttcgtataaaggctggcacactgtagttctccaataaataggaaaataaatgctttatttgtttggttttattttaaataaatttggattacacagaaaataaagtacaaaaataattatgaagagctggattattttgtaaaaataacacataaaaagtttgctctgaagtagtcgatgaaacatggcaaaagttaggctgaaaatggagctcagtaaatgtctgtgtttgtgtgtgtgtctgtatgtttatacataaaatatatatgcacatatattttaacagtgcctaaaggtgccccaaagttttttacataaaaaattataatatatataaaatccaaattatagttatttaaaaaattaatttttatataatttttaattgtgtattttctatgccactatatcaagcataagctaatatcagaagaaccattagaatattcagaaatagttttcaaaatttacctgcctactcttaaggctatttgttgatttacttgcatatagtagggtttctctgcagcctcagttctaaataaatgaaactcactttgaatatcactaattatagataatatagtaatagataatagatctatttgcccaatactctattttagccccaatgaccttggaaaagtaacatcgagaagtcctgctaaacagaagcaaaaacaataatttttaagttttttaccttgcaatttatctcttttttgctgcatacccgaatatttttctgttttctctttttccttccttctctccctctcccattgacacacacacacacataaacacacacacacacacacacacacacacagtgccatgagttctaaaaacttttggaactaccaatcagcttacttcctagtcttgacttgggttttcctggatcatctctctgaacgcttatcttgctgtgtcttgtgaacatggataacattcaacttttatccatcaatctctacttgaattgaatttcttacttactgttattttaaaggcagaaacattatcttcatcccaaattcttatttatgaattatctatattgatgaacaatgccccaataatcacccattcccccagacagaaaatctgattgattatagaccattcattatcgttcacattgacacttgaattatttttcagaacctatgaagttttctttacatctgattaatctaatgctgtgttctttttaccaggactcacatactctttctgcactctggtatgttccctactttcatctctccaactctcctcacctccaccatgccttagggtggcttccagagtcatccaggagtcctggcagtagtttccttggctgtacctaccaggatgagctatcatatatgaaataatatacaggaaaatacttctgagaattaatgacattctttcctttggagttattatccatcatctctactgtatggatcttcaggcttatttatttctaaaatgttgggatatataaatctcaattcctttatatctcatattgagataactctactgaacattctccaggaaacacgagagacattggcttttggccaaatttatcaaagtgtcctattaggtccaccatgttgtaggacaattattcactttataaaatgaaatctgccattttggatgctctcatagaggctaacaccctttgggaatcatgctccctctcttaatgttccttttaagaaaatagattgtaaacagcatggttaaacagaacaaagcatttatttcttttgaatattggccaaaatacattcctaatctgaatctaaaatttcagagtggaaactacccagttcactgacagatgatgttatttatgccacatgtatgtaaatccatagggtttcggtagaagagacggaaatcatttcctgagaatcggtgtggttgcttagaaagtgctataatatcacaacagttttgtacatgaatcatcaaatatatcaatatgcatttgtttcctgatcttgtatattctatattataactgttcatgagacctaattattttcagggtactttttcttttccccttaaagaaacattcaagaaaaagaaccctgtttataacatgttaaatctttatcttgtttatttttatcaacagagtgtaagacatgtctatggaaaaccctgcaggagtcaaaagcctgtggcaggtttttacagaatcatctgctacctcctgagctaggaggattttgaggacagagctcaggaagttgctatggcttgggggcaaagcaggcttttgcagataaaccttaagtcacagattctaccttttagagccagatatcattttgtggattaattaatagtagtgagggctttgagcatgaaagacattgtgagaatacagtgttttcttgttttaaaacgaaggacatagactttgggggaatagttctattgatcaagctgggctttccttaaactgctgaaaaactctaaaagctctttagtctttcaaaattctacctgggtaagacaaaattaggttttctgaaatatccttccagatcttcaggctgttaataataagttatgtaacaataataagttatataatttaataatgctaatagaaaccatctctaagttttcattatttcatgtgcccttccttttctcaagtaagagcatgtatattaattcaagtatttgttgaggccatcactgtgctaggcttggaatatgtgataatatgctaactggccatgtccctttctagagaagcgttcagtctagggatgaacagaagtgttaaataaaggaaggcataattctataagtccaaattacaaaatgtgctatgataaaaaaaaaacaagtttctgtgagaacctacactggattaagtagtcacacatggattctttgaaatggccagttaacttgagattttgcaagattgatggagtttgccaagcaaagaactggaagaagaatgttgaagcagaaagaaacaagtgcaagggtcgccaggtcagaacaaagttgttacatctgaaaaactgcaaaaattccacagcagccagaatattatgaacaagggaaaagagtcacgggttttgaggagagagaggcagtgcccagattgcaaagggccttgaagtgatggtaagaagttcagaagccattgaaacacagaaacaaatgacaatacctctcccatccagctccacatttgaaatccatttaactctagagtagagaaaaagaacacacagaacagcaacaataaaggctattaatattgagcaatcctttcttccccactgcctagactgaaattaagttataacgcagaaattgaattacactaataagttgcccagacagtaaccaggaaggccattctcattgaagtccagtgacaggcaaagaacgaggaacatatttacatcaaagacacaaataaatagaattcagggaagaagagaaagcaatggtgggtggaagttgggtggtgcatgagggagggagaggtgagctatagtaaaagcctccagaagactgaagaaatttcttgagatacaaaaagggtgccttcctcagcctgtttcccaaacagaacctggattccttggtggtgaccaaatgaacacaccggttgccagatgaaaggttcagaaaaaaagtcgtatgggggttcttaaacatcaaataataacattttcaaaatgacattttgatgagttaggggtgaataaatcagagacatacagataaaatttcccttgaaatacacagaggtttaacatgatggggaaaagcacttggcaaaacataatatgtgctttgccaaacctaatatttgaaaaatggtttaagacattcagcataaccccaaagctggacatgttgtcttatcctaagtgagagaaagtaagggagggaggctacccatgaaaacattgctcaacaaacttattaaagaatataaataagttgaaatgagtaaaccatgcctaaatctgaaatcaaatttcatgctgaaatcaaacacgcttatcaaggacctctttgagaattcttggtgacctctttctatcaccacttatgtatgacccagaaccattctttgcttttcttctactcttcttcacatgcaatcattgcatccaactttagatatttggtttaccacttcttaaaaatgtgcacacacagtaaatgatgtatttacatcagacaaaaacatcatactgaatctatgtctaaaggcataatatttcattcttgagctatatttaaggcagttctaaaattaagacttttaaaaatgtttaaaaactattagtactttatatgatgtacagataagctggagttttaaggtattttttctgtttttgattctgttcttaatggattatgtccacagtgagttcgccggtaatgagcaaatcaaatatagcatgaatagcagagacagtatgggaataagtgaatattgagaagaaaatgtaagcaatgagttccaaagagaaagagtgcaacctaaaaacaaaggcaaaataaataaataaataaaagcaatagaaaaaagaaagacagataaggtagatatttctatgaatagtggagaagtaaaaaatggcgggcgtgggtggggggcgggaatttaagaaggaaagtgaagcatcatttgggggtaaaataatgtaaccaaatgtgtcctcattctgtgctctttaatagaaatcattgaaacagacaagattaacagcaaagtactatgatctattaaaagttcagagaaagtatagcagctgcctcgttattaaataggaaaataattaaatgctaaatctgcttgataattatagtggcccagggttgtagttatagagagatgatgcagagttcttttagagagaggtcagtcagtcacacagaaggtttcatagggtgatgctactttaaagggatcatctcagtttagagctggggcctgtctcagcattgtggatccagaaaactcatatttatcatcattattagtgtttactgagatgaagatcccttgagtctatctcacagtacataatagggaatattctgatactatttaagtcacccgctttctacatcaaagaacctaggaagctgaactaggattcagatggctgccaatgagcacattatcagaacaaaggggaagagaacaataacttaaatacatcagcagagaaaacgttatgaggcataaggaccatgtggttctggtgttaaaagccaaacccttctcatcaaaatctggtaaaagttgcagattaagtttatttccatttataaacagaaagggttattttaacagaaccctttggtggaatggtgtagatgaaaatctattatttgcaattgtatctgagaacaacatgaagccttctcataaaaaaaaatgcagtgtgtgtatgtacagttaacacactagtctttctgccatgattgttaccattaatcaaaggttgtcttctgctcccctgtcttgtctgtcgcctccaacgtaggttgataaacaggtgctatctgggtatcccactgccattcattcttctcatctgtatctcagcatggctgtgtctgccgagcacttcctcagtgcttgcagactggctggcatccagtatgaacaaattgctgatctttccagccatttaatgttaaatagggcttctaaggaacattggacaaatagctcaagaagccagatttagcatctaaagattggttgacatttcttaagtatacttagttcagggactgctacttctttaaagaacttcaatttggcctagaatttggcaagtagtatcctaaacttagacctagagctgtaagtaattttgtaaattactggagacaagaccatctgagctctagatgactagcacgctcaactggaatttatagatcattgtcccttcaaaccatgggattaacattgagtaggaataattattagagaaactaataaggtaccatatataaacccacatgcaaaatgcatagcaatcttttgcttgccctaatacttctttcggcacactatgaggctcccagaataactgattcctggtgtctgaaacatggtgacgtatttcaaactatcatgacaaagaatagtaaagtaattaatcctacctcgtggaaacttcacttgccagcatgagaccctttacaatgcagtgctttcagtgcagaaagcataattggaattttctacccaggctaaaagatggcctgagtctgtgagatgacttaagcagggcatggtatcccgtccccccagaaaaggagcaggaatatcttgaatatgaactcccaggagtttaagcctcaagaggattacaattgtcctattaatctttccagttctgttgtaagcagagaagctggcatttagaggaaagaagtgttattaattaaaaatgtgttgaaaagaatgaataagtgtacatcaagtattaaaaagacaatgaaagggccgggtgcggtggctcatgcctgtaatcccagcactttgggaggccgaggtgggtggatcacctgaggtcgagagttcaagaccagcctgaccaacatggagaaacactgtctctattaaaaatacaaaattagctggtcatggtggcacatgcctgtaatcccagctactcgggaggctgaggcaggagaatcactttaacccaggaagcagagattgcggtgagccgagattgcgccattgcactccagcccacgcaacaaaagcaaaactccgtctcaaaaataaaataaaataaagaagatgaaggaaaataaacacctgatctcagaagtgagaatgtgtgcacagtggtaggacatagatatactacgtgtagaaatctgcatgtaaacatttaacaaatatgcatggtggtagcaagtgtagtaggtaatagaacatagcagaagcgttattagcttcttctaatgacctggaaggcagcctgactttggaaaatgatataagagaagataactaacttgctattcagtccgtcctcatttttcctgggacctctgtatgatcattcctgaaaagtctattgcattgatccaagaccatggaactggctcagccactgatgacaatgatgtcacatttattgagtcttaacttgagaaatccagcccttggcatcaatctcaagtattctgggaaaagtcctgcagtgtctggggaaatgttacttatgtattcaaagaaagagaattctatgatgtacaccttaaacctgtttatgttgatttctccctataagagtattagctttttcctttcacatttcctatctcttttagaaaaattttcatcaataatttatctttgtgggtagcaaatgtctaccgagggatcttttgtgaatttttggaaaaaacaattggggctatatttttagcagagaacgcatgcatcaatttttatgatgggttgataggtttttgtagtttttttggtagataaatccaggttttgggtaactgttaatcagaagaaaacttaaataaaacaataaattttttctacggttacacaacaaaatttctcagtatacattcctaaagaaaggaacctcctttgtggtggtaattgctattgaaaacatctttcttccaaacatttgtggataccagtgatacacagagttaaacactaaatttattatatgggttttacgaggtagaaaaataaaattcctggcaccaagaaaaagggacagtatacatagaataaaatgtggaaaaagcaaatgaatagatgtatccaaatacaaaacaaaaaggcaccagtgaataccatggttctcaaaattatccaagaaatcttccttagatgctgtagagttgtggagaacatggtgaagtaaaagaaactttctggatatggagataagtaaaaaacactttgctatcattttcataagtcatcattattattatctctatcattatttatttagtcaaaaatgtattcatcaaatgcattttaaaactaagtcccgtgctatgtattaggaataaaacaaggcagaaaaactctcacctatatcagagcagacatttaaccagtgagattttagttatttggaacaactcctttacctctaaatatctcttcctttcacttgtagtattgaagataaatttcttggcttgcccagtttactataaatatttaaataaacatttaaatagccattcatttacttatttgttcaaacagttttattattttgactattggcactaccaaaatattccagaagctaggaatccaggtgtgaaaggtacagttttttgcctttgatggactcatagcacattatttgcctgcaggcacagataaataaaatgacatttacaacatgatctgatatgtgctgtcacagtgacaatggcaaactgaaaatggagattcaggatggtgcacctaaaagagatggcagagaaatcatggaaagaccctctaataaaaagacgtgcacattaaaatttggttttcttcttattttttgagatggggttcttgctattctgcccaggctggtgtcaaactcctaggaccaacagattctcccaccccaacctcccacacagctgtgattatagacacttgccacctcactgggttttactaatttaattttgaagtagattaaatatacttaagacttttgtgagatgaagacatggtcatggtggactatttcagctagggggataacatgggatggcactgagggagtgtggtcctctgatactaggcagctcagggagaagggtgtgggcaattcactaagagtgaaagatgaaggctaacgacttgggatggggcatgtgaggcagacacaggagggtagaaataggatgctaagaaattaaaacacctagtacagactttgcagggagtcaacccatcacaatttgcattgtgcatttattttgccaaaacctccgcaaacacttctgcggagttataatgacttgttgaatttcctttaagaaacttgcagctctattagaaatgaaagccaatacagtatatgcaaataggaaaaggaagcaatcctacatcatggaagaagataatgagatactgctactacagggtatcttggcaattgaccaaaatatatgaaatgttgctattttaaatgcccttccatgattcaactagctcagttacctggtcccattgaagtcttcctttatcccggcttcggaaggtacatggggaggcttgaaaagaagaacttttctaaggatacttggtaaaataaaggaaggcattcaatttgtctttcttttaccatttgcaatcaattttttaaacaagtgacttcaacgcccagaaagaaaagtcaataaaggtgtatcactatctaacaaatcattcacattcctcttcatagtctgtcttttagatatttaacagcttgtaatgactatgattttgcaggcacttcccataagctatatatgcattattaataaagttctatgactgaaaacttccgtcactgcaatgactcttgaaaagcataggtttattcaaatcaacaatgcatagtagtttgtcacggttttaacatatgcattcttcttgcagatggttgaaaaagaaggttatctgcaaaaagctaaaattgcagatggaggaaagaaactaaggtaataaaattctttaattcacttttatataactatgctggttcttcatatgctaaacttgtgccactgttattgtttgggatgcaagtccctatggtaccagactagaacagtctcctctgctactgctatgatcaacattatttttaatggaactacagtttttaaagaaaggcactacattctatattgtcgaacagaacacataaatgagatgctttttgtcctccttggacttgaactcataaaacactgaaaataaataagacaatggattgtgatttctgtgattgaaagattagagaatgaatgcattcatctgcaatacagaaaagtctctatacaataccttgtgagaataatttcttgaaggatggaagatttgaaccacttttgtagctcaaaatagaaattgataaaataaaagtaacatcatattcagaggtgagagaaatttgaaaagggaataagaaccttcagagaacaataacaacaaaaatcttgaagaaaaaaagtaaggttgataggacggtaaagaaagatgataattgtgtggtatataccgtatgtttagaaataatcacctccattttagaatttttgctatttctcgtattggttctgttacatatttagctttgtgctgggtgatatgcaagttaccaaatttgtagaaaatgctcaagttgagagacaaggcatttactcttaaatgtattactaacaattaaaattaataggataaatgtactaattagctacacaatgggacacatgttagttgtataatacaattcattactagaatgacactctgggtcaacaccagagaataaagtctgcttttgtttgatggttataatgaattaatatatttatttaaacaaagtaaaatttggaggggggtggagaaatcatccacaatttcactacttaaaatagctatttcagttgtaaataacaagctctattttctctccatattgtgtcttattctgggatagtgaacaaggccttaaatctttgcctggactgtttttctggagtggccctgcagccaccttcccttgaagagttcaggagagagatgcacaggagacaagatcaaatgcaaggttgctttaagagatgtggctagtcccttccccagtggtgaattgggcttagagaattgggttctgaaggaacaacaggaggaagtctttgagtagcccagcccgagtgctctcctttcccctaaaccttatcatgaccttatcaactcaggaaggagtgtggagggtacaatgatgcctctccccaagatgagtaagtcatgaccctttcttccctcagcagccatgtggaataaagagtttcttcaaaattatctaagttagccagttcagccctccactagagctgagtaggagaatagaggtgacagcattggtcagttccaccctccagcctcatgcaaggaagtaggggagatcctaaatgaaataatttcaagaaagcagaaggaggttctactgtgtggttttgtaaagtatccttgtccataacccctctgtaaaccaaccttataacatacagaaggcagtgtcaagaggaagcagagaagaacaggtcccttcccccagccaactcacatgaatatgtttttaggtagttttattcaatttgtatactattgtgtttttgttttatttgctgttactttcctgttttccgtgttacagttaaattaatataaacatttgtttgtactctgttttattatttcactttgcataccattatgcattctttcagccttttccacttaaagttatatgttttagttttccttttttttttttttttttttttgttgctgctgttgttgttaccccaggtgcacagaattgagctgattatatccttcggtttgtggccttgtgctattatcattctgggcaagagccctagctggttttattttattatcagtctccaatccttgcttcaatcccttgtagaccttcattttaatgtatttaatgtgtgtttatcaaactcattctccatatatatctatatttagctgtatatgtggcattcaaaaaagaatgtatagttgtgtatgtgtgaatgtgttctatatagcataaacatttttgtatcataaaccttattatgtttcttactactttcattcaatgttagctcttgggcagctttctatggtgctatagagacatgcgtctcttaatgatgggcatatgtcctgagagatgcatccttaggtgatttaatcatcatgtgagcatcatagagtatacttacacaagcctagatggtatgtgatatagcctattgctcctaggctacaaacatttacagtatgttgctgtgctgaatactgtaggtgattgtaacataatggtatttgtgtatctaaacatacctgaacatggaaacgataatgcattgcgctatgatgttatgaagactaccatgtcgctaggcaataggaatttttcagcttcattacagtctcataggactactatctatatgtcgtccattgtggattaaaacgtttttatgcagtgcatgaacgtctttaaatctagttcatttcttccaattgctggccactttgccatcgtttatgtgtagtcatgtgccacatggtggcattttgatcagtgatggacagcatatacagctgtggtcccataagattataaaactgatgcctactgtaccttttctatggttagatgtgtttagatatacaaatacttaccactgtgttacaattgcctacagtattcagtacagtaacatgctgtacaggtttgtagcctaggagcaataggctatgccatatagcctagcgtgtggtaggctttaccatgtagatttgtataagtacactctgtgatgtttgcacagtgacacaatcacctaacgacacacttctcagaatatatcctcatcattaagtgaagcatgactgtatatgaattgttacttatccagtctcccagctgtggacatctaagttgcctctaactcctttcattccaaacaacatttcaataaatcgcacatatatgtttcctttgaacctgttaggaattttctcaggggaatatttccaggagtacaggattgctcagtggtaagtcacatacatttgtaaatctactgactactgttgtcacactttctcctgaatgagtgcaccaattcacaccagttcaatgtgcaatacagaagggattctactttccacagttttatcagcacgtagcatcatccaatctaattatccatagaacattaccttaatgttgcttttatttgtgtttcactgataagtattgaagctgaggatcactttatctgtttagagacattcagattctgcattctgagtctattcataaactttgactattttctattgagtttcctgcttttttattcaataatttgaggaaactcataatatatttgggataataatgctttgtcaattttacatgttgtacatatcccctccaagtttatggggcttgttttgtttttattgtaaatacaaattgaacattgtatatgtaatcaccatgtttaagaacatgataatcccattatgttgataggctataatatgccaaatcatccctacctctttttttacttgatttttaagttgagtctggttttatatttatattaaattatttgtattagaagttatcattgcaatatttctcctgttgcttgtcaatttttcttttatatttttgtctgttttttgagacaggatctcactctgtcacccaggctggagtgcagtgatgccagcctcctccacccccatccatccacccaccttatgcggggataaatgagtagctgggaccacaggtacacaccaccaggcccagctattattttgtatttttagtagagacctgggtctcgccatgttgctcagaatggtttggaacccctgggctcaagagatccactcaccttggcctcacaacgtattgggattacaggcgtgagcaatagcacccagccttcttttatattttctaaagacaaatgctaagcctgcattacttgatcaaatcacacgaccattttaaatgaatcttagtatgcactgccatattgcttacccaaggagtgtatatgcttttatcactagcaacaaaaatggtcagtttagtcataaccttgaaaaattatgtagtttttatcccattgatagtttagtaactaataaataatataacatactataatttatgcttcttatataaaatttgatagccttcatttcatttatcaaggacctttgtatcttttataaattttaatgaattaataagcaatattaatagatgcttactctgtcaagcacttggctgaattctttatcagtaatacttaaatgatactacaatatagactctattattgcttcctattgtataaatggagaaactcagtcaacagtattaacctcttatttctcccaaatcttattttatatatagttagtatcacagaatttagccctgacctctgcttgaaacacgtttgctttatctctcttgctttaagctatttgagactagtgagcaaaaatggtcctcttatttcatgccatcaacagtaccaggtacttcaattgtcacttaataagtattattttattaatttctatcaagttttctacttataaatccataatagatcatcataccttgtattgtcttcttattttccttctttctcttcttttttatgtgtctttatttgtctctttaatgtattttctctttctctcaaagaaaatttaacttatctctgaatataagcaggagatggtaaaaggaaagataaattattggctatatttgacattcataagaggccatacctttagccttattttgaaatgaggttatacacatttccccaacaatacactgacaggcttgaaaacagaatacattcagcattcactttaatttttaattgtgaacactgaaactatgccttagcttatctgatgaaccataggaatttcttcatttggggaattccgtccccaaacctgtaagtaaccctggcttctctgaaactctatgacaccttagtaaaaagttattttcaatgcttacatttacaaaatacacctgacagtatgtttatgaagtctcagcaccacaaactttcttctccctcggcatctaggtcttcccgtcatcagctcctgtgtggctctgcgtatcttaccacaatatagagtcacattcttctctccttagatggacatagaaagatatacttgggggtgaaaatatggccagaagatggctacgaaaagaaatgcagaaaaaagattgtgcagtggttacgtctactagtgcctgctttcatcctagggcccatagctactaggccttcggttgggtttttgtttgtttgttttaacagttgttattcagaatggactttctttggaatgtgagactaaggtgtgcgcctaacgtcatcatattttttctttagtagtttctgctcagtatcgcaataaattcttccaggctgaatctttcttcattttcttgcaatactgacagagatgggtatttttacacctcagtgtctttttgacccaccttttagcagtcataaattacaagatgcttagaatatgagacagaagaagtaagttcctagaccaaccagtttgagaatgagtctgtacgtttaacagtgtctgagtgattttgcggtaaatcaatcagggacattagaataaattactttcactcccatcactggtgtggaatcaagtcaaatccagcatgaccaagttaggtaacaaaggcagatggaccaaataagagaacctgaaatttgtcaaggaacctcacatatattttcttctgactttttggtttgccactctgtcattacctaaagaaggcaaaagaaaggtaagcgtaggatataaagcttttggtgtttagagcaaatgaatgtgttaaacccggagtttaagctaacagattcttataacggtaatgaatattttaagagccatttttcatcaagcattttccagataagctgttacaatcaaagttgctgttattatgtgctgccatccggtgtccattttgtagaatgccaagctgatggctttgttgagtttttgtttttgtttttgttttgggggtgttttgttgttgttgttgttgtttgggctttgattttgtttttgtacttctatttgtctgctagttttttttgcatttttccaacttcacaattcaggatttgctttagggaagttttatgaagtgtttcacttggataaaatgtcccaccaattgcataaatggtacataaatgccctcatagaaatttagttctccctacttcccaattgtagttagcaccccttttccccttagatgtaatttgttttgtatgtcaaaagataagataaatacctgcatttctttttttgttttgttctgttttgagactgagtctcgctctgtcacccaggctggagtgcagtggcgcgaacttggctcactgcagcctctgcctctctagttcaattgattctcctgcctcagcctcccaagtagctgggattacagacacccaccaccatgcccatctaattttctgtttttagtatactgggtttcgccatgttgaccaagttggtctcaaactcctgacctcaagtgatcaacctgcctcagcctcccaaagtgctgggattataggtgtgagccaccgcacctggcccaacacttggcatttcttgccctaggatttgtctcctgcatggaatcactaggatcaaacccttacctgattgttacctgtaaattcctgtggaaactgatggctgtctcccttactcttggcactttggactgtcttactaaagttagatatttcctgaactgtgtgtcttagttacccctttagtctatccaacaccttaatttttgtctctctgtggaaaaaatagaaaactattctctcaaagttatgatgaaatgtggaggcactgattggtcagtgggtgaatttgcctgctgaccatcatgataggggtggaagacagggataaagggctcgcagttcagcattgcaggatggcccaggtcaggctaagacatggctttgctccaaagagaaagagattctagtacttccctgacaagtgttccttatctccccctcttagctcctctcatgaggctctcaactggcatgctcagagtgactacagagagagctgcatgccacctgctgagagaccatggagacactggagtgagcaggggcctgaatcccatctctatggcttgttttcccttggttaggatgcaaccttactgggcttcagttttctcttctgtaatatgggagtatcctaggctcattcagaagacttggtttccatgtttattgtccatcttcttgtagttagaagtacagtttttgaggaatgtcttattttccatctcttttcagcccttagaattgtgtttggcacgtggtaaatgtttaatggagacatgtgaccagcttagtaattaaatcacatagtgcatataaaatgccaggtggcatacctggaacagagcagaagccagtgcaagctcagcgtgggaagccctctggagaaagctcaggtattggacactagaagcataaattaggaaaaaatatcctatatcagaagtgttcgatagttaagaaaaaataatgctaagaataccttaataactactaggaaactaaggaacagagaaaggaaaagaaatttttcagtccttgttaatgacgaacagcaaacataaagcagaaaaaatctcgattttttctgaaatttgaaaggccatatactcttttactcaaaaaatctttaataatcacctactaaatgtcaaacagtatgcccagtactggaaatgctcttaagaggagagaggtggtttctatttctttgtgggagcttggggcatagagggacttcctagtgcaaaaactgtgtttatcctagaaaatagtctatttgcaaagtttcctcagaaactgctggacacacctatcctggctaaggcttttaagcttgtatgagttgcccacttcctgaaatgtcacctaatatattgaataagggtcatatatagtgatttggttgcgtatagaaaatatcaaatccttaagtcaaggtaaaaccttgccaagtgatcctttgcacactccagagctgacaatgccttacgagagagtcactatgttaaagtaattgggtgagaaagctattcccctgatatgctaagaactatgggcaacacaatgggtcagacatggcagccataaaaaaaggatgagttcatgtcctttgcagggacatggatgaagctggataccatcattctcagcaacctaacccaaggacagaaaaccaaacaccgcatgttctcactcataagtgggagttgaacagtatataaaaaagaaattattctttggccattgttgtaaagtcataatgtagttagggctggcttcaccggtgtgcgtccagggccccatgctcagaaggactctgcccttgatttaatgctagattgttactgtcttaaaatacttcataatttttggacacggaatggtgcatttttattccgcactgggctttgcaaattctgtacccaattctgtttttcactggcagataggtgtaaactcatgtctttcagttattcaaaaaaatatgtattgaggccctaaaaagtaaattaaaaaaatttggatttaaaaaaaaacagcggccgggcgcggtggctcactcctgtaatcccagcactttgggaggccgaggcaggcggatcacgaagtcaggagatcgagaccatcctggctaacacggtgaaaccccatctctattaaaagtacaaaaaattagccgggcgtgttggtgggcgcctgtagtcccagctactggggaggctgaggcaggagaatggcatgaacccaggaggcggagatttcagtgagcggagattgcgccactgcactccagtccagcctgggcgacagagcgagactccgtctcaaaaaacaaaacaaaacaaaacaaaacaaaacaaaaaccagacagcataaagtaacgaacagattataggttttggagctagagaaactgggtttaactttaaatctaagtgtaaggccttaagttaccctttgagcctcatttttcatattagtaaatagagatgttagtactttcatcatttttgtgtatgaagctaagcataaactagatgatcaggtttacgctaggtattctaaataatttatgctaattattattttaaaagaatcatgggaaaaaatcgagatgaaagaggacatctaaaaggttgtcagcagcattattattcttcgttttgaaatgaaattcttttcaagcaataacactgagcccatggaaaagctttcacttttattcagagaagatagacagtgtttatagtttataaattcaaaacaaagtagcaccgtacataaggcgtcagagcaagtcatgttgctaaggttttgagacctgcagttcttaccctcttcagttttttcatccaattcacctaacaggcacacagttcacagcagttcaaagtccttataaagaacaatgagataattgcgtttcatgcaacttcagctctaaccagttccatttccaagtttaaggatggggagagtttttgccagcaagttctataaatgatcaacatctgaaacagatccaaatcagagccatttatccaggacttactatagataggatgcaaataaggtatagtgtctccttgtgagaatatgaaatgtatagtgggaaatataataggtaggttaaatatggattcttcgtgtgtgagggtgttctgtactccctgaccacgtatggtcaaaataagggtggtgttaaaagatgcccagactagacttctaataatctttctctttttcctgtttggagtaatctattattatgacctgaatgaagagaaggctattgctgcttcaattcactctgctgctgctggtacctaaaaggcaaaatgggcactagggcagaaggaaacgtctgtgtggttttctttctgggttttgttttttcatcttttcattatttaattgaaaaattgatactcttcatttaaagacaagtgggtccaagaacacagtgtttgtatttggatgttgaaaaatacacattgtgcttcttgtgtgtctgcttattctgttcttttttaacacaatggtgtatcattaagaaagctccaggcatataagagcaacctaattctttttgtaaatattaaccttactgaatcaaagctgtcctttcaatcaagctcttagtttctaaaagacaagtggaaataaattacgcaaagatcttcaatagtcatttaaaaagtattttggtgtggttttctattgacctgaataaagtctttccataaacttaaaaaaaaatcacttttgtgaaatgaattcaactgttttgaagtgaatgttaagctgaagcaaactgcagcaatatgctctaatgggtagaaacttatgtatattaatctccttaatatctttactatctacaaaagagtgccttcatgacatgaacatatatatattctaactatagaagcaatatgtgttcaatgcagaaaacttggtaaacaccaagaaatacaaaggagactcaaaagccgcgattttaccacttgatttaactactgtcatatcaagactttttttccaggccaaagttcagtcattgactcaatacatatgtattttgcgtctattctgtccaaggcaccatgctaagcattgtggatacctttgtaaagatgaactgatttctaccatctcgaggctcatttcttaatggaggatagaggtgaaatttatgaaaaatatttttaaatttatcataagtgttatgagaggaagtcatggaaggcacatatgacaaagcaatgttttgacttctaattaatggaattaataatcagaaggagtgtatgggtgaagaaagtcctaggtaaatagcacagcacggttataaactacgtgtattatggtctgcattaaaaccttcgcacatcagtattcttctacagcatagggttcattattccattatatggacctattatatgcaatttatttaacctatcttttttatattttatgtatggaattaacaagtaatgatgcaattaatttctatgcatacagactcggcaatttgtgagactatttctctagaataaatttaaattcgtagggaatggacatttttagccaaaagatatacacatttttagggatttttaaaaagcacattttcaaattgcactccagaaaggaagcaacagtctgcattcccaccaatagtgtatgagagaatctatttcctacactgtgattatccctagatgttatcagatgttagttcttttattccttgacaatttgatgtacaaagagggaaaaagcatgtcactatttttatttgcatttctttgatttctagtaagattcaacattatgaaaatattttgaattaagcaatgacacatgaggctggttagtttttaagactgaaatacactaaaccaatgaagagaagaaacaatgaaggaaggaataggttctgattcctatttttactttgctatttttggtttgctgtaaaaacataaactttttatgggaaggatgcacatggatacacaaaaaatggatttttggtagttgaaaaagatattaggaggatctataaattaagaaattcttactataaatgctgtacttttaaataattccagaatgtctttattattacccaaattccataccacttatagattttaataaagaggagacttttagcaagactgttaaaaataaagatggtctctactcattccaaatgttgctcatactgtatctataaatgatttcttcaactgataatgctttctttcccttttatttttttgtcctaaggaaaaactggtctacttcctggattgttctttctagtcgaagaattgaattttacaaagaatccaagcaacaggctctgtccaatatggtaagtaattctctgtttctattgttaaatatcttttcagaaatattgtagaattaaaagtttggttttatcagaaatcacactaaaacctccaagctaccaacatctgaaaacagatggagaaaatgactcaataaacttttaatcagatgaagggaaaatagaacttagtgtctgttttattaagtggtgcatttggagaataatcacaaaatgagatgtatggtgagcagctatgtagtaatgcgaaggtaacactttaaattaaggtgccatttataaatgccttattcttatttatgaaatgatcactaaatgcagctacttgctcaaataatgtattataaagtatgttataaaatgcattagtaataaatgcttaacggatgatactatgggaagctgttttaaagaatattataagacgtaaatcatattaaaccatgtatgtgcatctttaatacatgaatttaagttggtatctagcatgctataaagtgcttcagacattaataaataataataaactgtttataaatggcaccttaatatagggtattaccaatgaggaaacactctaaattagccaagtgattttttatcttcgtctaactgtgacgttcactatatccagctaacctttttgaatatttctatgactccatctaatggagctaatacaatttctgtatcctgtagttattacaaagtgaaatttgtagggtttcttccttgtacctggaggagggcctcacatatacctacaaagatttgacagtgataataagtaagagcaattcggagccagttactggggcaattcaagctcaaaaccttgctgcccaaacacaagagctaccacaagatgtaggagacagtgggcaggcaacatatctgacagcctcctgattaggaaggactccgggcaggaactaacctgccacagcccatcggcctgatggatgataaggaaaggggtcgcctggcaggagttacccacaatgaactaatttgtatttgacaggtaataaaacgatgggaagttctttgctctccagccactagttgtgtttgctatgtaatcctctttaaatagaaaatagaaaatcatttgctaggagatttttcttaaaagaagattttagtaagaacaaaaggtagcatttgacttgcttctgataaccgcagtagcctttatccccaagtggcttgctgattttggagtctcagtgctgtccgatctgtaaactaattatgaataaattaaaaatatatctcagtcctttgtatttttaatttaaactgcctcagaaatttgttttagggttttattttgtttttatttttggatacagtaaggttgagataatctttttaaggaaaataaagtacccctaagggccaggcacaaaacaactaccatccacttgcaggtcctttgtcttccctttgaatgagctctaagggggaagtcaggaggggaggaaagtcgctggccttgctgagtttggctgctgaaaagatgatcttcccctgctgagtgagaagaattccattgggaggagagtttatgcgaatgtgtgggataatgggagagataagattccatattttaaagcatttggtttatttttattttattattttaatctctttataccatgagatataattatcagctgttaaattttatacaggtgaaagaaaactccctttttgattgcaggcaaatcttgcaagttagctcactaattgcatgcctctcgttcaaccttcagaactgttgtaagttgacaatagacttgacttgtagaagaaatttgttaacattttcctaggagtccttatttattacttctggccccatttttaatgctcttatggtttctaccaggcactcattgtcttcaaagtcaattcatggcaggaactaactgtgttttgtggtaatgggtaagagaattacagatttatgtttgtgctgcatgaattgacttgctagtcaacttcttggatccatttctaacccagtattaaaggcctagtgggatagcccacgtttaccagttccagtcttagagaaacgatacaacgattgccaggccttgattaaagatgctgtggttttattttgaaagagatttatgctcaagtttctgaatttctcttgcacccccttagaatttttctggtgttgctcattgtgcttctggaaaaaagtctgccctttcctcctaggggtcaagacaagctgcctgagtgagtgcagaatgtgatttaaaagaataaatggtattttagtccttatacaaatgatctttaagtgttaatgcagcagtgagacaaggcaacaaaaccagccagagcagttttgaagttggactctaggggatgtaattcctttttttttttttttttttaccactcattagctgataacattactcacttctttgagcttcagaatccttacctgtgaaatgggcatagtgatacctgccaacagaattagtaaggaatgaaattaattggtaaaaacaaatacataatgaacaaaaaattattgtgctttattatatcatatgctattaaatacagaaatataacatattctatagtacacaatagagagtataattatattattacattagttttgtacttgacctgattcagacatttatagaagagagaatatactaattaattcaagaaactccatcatgcatgacctccaaaagaatgtatccagaagtagcataaaatgctgtctcagagcaatgactaatactgaaaataaagccagccatccatttagggctctagatgttaacctcttgaatgtccatacaaagtttcccggtgcccccatcttcttcctttggctcttacccttactgttttcacatttaatacagcatgttacaaagtattctgcctgaccccacattctgtgtttggttactttcctttctcactgaagttcttccagttcatatctgtcttactcagttaggactgctacatcaaagtaccaatggctgggtggcttaaaccacacacatttatttctcctggttttggaggctgggaagtccacgatcgaggcacaggtgaatctggtgtctgctgaggtcctgcttcctcatttgcatctgtcctgtcttctcactgtatcctcacatggcagagggcagaaagtgagagagcagacgttcgtgtcttttcacataaggccactaatcccattcatgagggctccacctttatgatctaattacctcccaaaggccctacctcctaatggcatcacactggggtttaaggtttcaacataggaattttagagtaacacaaacattcaatccttaaaaatatccaagtcacatttttatcaaaagcagccttactgtgcaaataagcacagaatcactttgcttattttcatagagattcataggtacctcagtgagttagtaaaggagaaggaagaatgacctattctgttcttgttttatgaaaaggacattaaatcgtaactgaccacctactatcatcagcattttataacagaaaggacattataaaatacccaatccaaaaaatagaaaggataaaattatcagaataaaagacaccctttaccaaaaagaaaactgtcccccttatttgcctaacatactctctcttttgctcatcaagacaggtggatcgggactggctggtcctccagtgaggaggaaaaccactcgtgtccctagatccagatttcctgaattatgaaggaaaggatggtgttcatattctcatatttttaatgtatttttatttataactcacttaaaatattataaaataatacagaaaccattttaagtaaaatgtataaaacatctatgtgtatttttaataggtatcaatcaatcacctgcataagcactacccaggatgagttatagaccctgccagcccttcagaagccccaacccctatcagttgtccctttgtcatcatagcctcttcccttctctggagttagccaagaacctgcgttttagtcattatttcattgcctttcattattttcaaacctatagctatataccttaaaaatataatttaggtgttttttaattcatataaatggaatcctagtgtatgtttcttttgtttcttgcttctttcactaagtatttcttgctttttctgtcctttaatattttatcattccatttttttcttttctctactagtttgggaggatacactttgtttctgctctgttagtatagttagcctagggttacagcattagtacttatcaacaaataaagctagtgtgagaccctttaccttctactaagatgttaccttggaatatttttaatcaatttatccctttctcaatgtatatgttattaccatctggtgttttaatttttttaatatcaccagacattattattctcttttatggagtcaatgtttgtttacatttgcctaatatttgccacattctttgctatttatttctccatgaaccttggacttgctttctaggatcactttttcttctgcttgaaatatattctgagaaattcctgtgctaagggtcttgcagggacaatctatctcatagtctgcttacttgaaaaaaatctctatttctccctcatcctagaaatatatattctctttgaatatagaatttttagttggtagtcattttcagtcagcatgtcaaaaatatcattacactgtcttctgttatccattcttaaaatcaaatcacctgttaatataactgatcttttctgattgctcataatatttttctcattacctttgtttttctacagtttcatcatgatgcatacagatgtcagtttctttttatttttcctgcctggattgttatgcttcttaaaattattgattgctgtcattaatatatttcaaaaaatttccaatagctatcttttttttttttttttttgagatgaagtctcactctgtcacctaggctagagtgcagtggcatgatcttggctcactacaacctctgcctcccaagttcaagaattctcagcctcagcctccagagtagctgggattacagacacgcaccaccaagcccggctaattttggtatatttagtagagatagggtttcactatgttggccaagccggtcttgaattcctgacctcaagtgctctgcctgcctcaccctcccaaagtgctgggattacaggtgtcagccaccgcaccaggcccaatggctatcttttcaaatgtagccctttttacattccctctctcatttccttctaaaccttcagttaaacccatgttaaatttctcactgtattctctaaatgctttacactctcatttttcttatatttttgtctttctgagctgcattgcaaataatttctctttaggtatcttccagttcttctttctccttaatttcaattattgtaatttttatttctagaagtttgtttcttttaaaaatgtactatgtatattgttagagttaattttttcctgcaggcattttttaagactctattttattttgttataactaggaggcatagttgttttataatctgtattttgtgattctaatatctaaatttgtgtcagtatgtttctgctggttcttatgttgctttgttttcttgtgtgtctggttatctttgactgtgtgctaatcattgttattgaaatattatcatgggaggcactctgaggcctaggataaatgtgtcctactccagagtattttagatttttctcaggaggtttgggacattcccagagactgactatctcaatctaaattaacagtataaaactctccaattatgtctacataataggagggccgtagctatcctgccacttctcagggacaagattgtgcttcagtttttcttattttcttattttacattgctcatctaccaaaacagtcttctttatatttccttcggtttggagaaaggccacaagtttaatatcggttctcccttattctttataacactttggccaggaccttgctccattattctgggtttgattgaccaaagctcaaatgtgtagtataaacaaatgacctcaggaaaaatgcagttgtgttactttgatattcagcttccctcactgaattcatattcccacccctaaaaaatatttacagtggcagtcccactgtcttttcagactttcaattcttttaaggggtaattttaaaaagaaatattttatccagcatttttattgttttcagtgggagaattgatccaaaaacatagcttctcattgcaatctacctcacttcaagttaagtatgcatttggttaatcaagtttgtgctatttatataaatcttggtgggaaaagacttcataagaatatgtattgaaattctacaatgaacagcttgctcgttagggctacatataaggcatagagatataatcaagatatagtctttgccttataaaatctctgccaaaaaatagggtgagatgaaataagaaacatagtagagttgtttttttttttttttccactgagattttgaagaaggcgagctcacatctgtgaaagatttgaattgggccttgtaggaccgttataatttgaatatgtggagatttgtagggagggagtgcaggggcataaaaaacatgaacaatggcataaaactgagaatggacagagcctgtgcacaacaaggagaaatgaatttttgttttggtttgaagataggataagagaaaaggattgagaagagtttcatggcctgagatttgctgagtgacaaatttttaataagtagtgttagcgttctccaggtgtcttcattctggaataatctgtcatggctattgttttaacaaacatatactgaacagcagtactagtcagtggtatgtgtcttaaaagagccaggcctattgtagggccaaagcaagagaggatgctccttcttcgaggctcttcatctcatttactgcagaagtgaaaactttttcctcaaaagcacccacactagtgtttgtttcatctggtgctaaagaagtactagagaatcaggagttgtctgtttgatttatcttctcaggccttgactcacactccttgtatttttcaggtacactttcctattttagtatcagtgaagtatttcaattgactctagcacttcatttgcagcttgactcctaagtacctgctgtactttgtgattttagagcttctgcttgatgtgttcaggaggcacctgaccatgttcatgggatttggcaaatctccatttttggttaaacaaaacccatttgatggattgcatcatagagaagaagctctgcaatttagaacatccattcatttattctctcaacagttaacaactcctaccaggtgtcatataatttttttctttttgttttgttttgtttttacattaggggcaacagaaatattcaaatgaatagtatatgatccctgctcttaaagtactcacaatatggtaaaagagacataattttgtataggtttattataataaaaccatgactaaagtgttaaaaaatattagacaacatgccatggaaccatagatttagctataggtagtctttttccagagaaactattgttgcaagtcatgttcagcttaggtatctctccttttgttcaaatattactgtttgatattattatatcaaatattattgagcatctcttatgtttaagtcactacgataggtgttctgaaagataaaaaatgaaccagactgaaacaaatagaaagtatggccttagattgagtatagtgaagaaatggatgttggtagttgtcctaaaatggcatgaacagagacatggcgtcgttttatgataactcaagagaagagtgtgattgcttccatttggacaggatttgaaatatattcatggaggaagtgacatttgagcacatttctgaaggatgtataggattttgatgtaaaagggggcaaaagatattttatgtactaataagagagtaattaatagtgaactatggaaaattctttttttgttgtttattttacagatgtatattgatctcttgccttcttccatgcactgtgtactagtcactgttcttgaaatgtttgaatgggggttccctgaggcctggagtgaatatttcctagtccagagtattttgtgtttcttctctaagttgcctgggagtgaggaacagctttagactaagttgcggaacagcattgtggaacagcaaacagtgtaatttggttagaaagtcagtgtggaaccggtttaggaaagactttgaacaggattgggagaagagatcatttcattctgtaggtaatgtggggtttttgtaaccaatatgaaatattctcaaattaagagagactcagagttttcagagacatgtttagggaactgatatatatatcagttgtctataaaattaagtctctcttaattttgtgtatatataacttaaaaacacatgcaggacttggtaaattatccgagagacatgttctaaaaatttatgcaaatagatgtgagcaataaggcctgagctcttacgacagagaaaattgtaaaacggctgtgtgtcatcattttggctcaatgcatttagtaaatcacaggacatcttttcactgacaaaatattttgatattctcatatgtctctgacctccaacagtatggccatttctaaagacgttctagtgcaaagagaacaagcagagctatccatctaaggagagcgaaaaacatgctgtcccaagaactaggtgtgtcaccatctcagtgagcacccgttgcaaacctactggtgcttccatctgactccagaacatctgtttagtgtcacaccctacttaaacaaatgcattgtgtgaagtctttccaccaacaatcagacgctgtggaactcattgtcaccaattgggtggatgagagccaccgtttctattatattcatcacacactgctcagaaaatttagtgtcacttttgatataaattcaaaaacattgtaaacattttagggaatattttccccctaaaatggtgtggttctaaagccagtatattcagtagaaagcctatatgttggttgtgtaagggacttttttgttactcttatgttttttattttacattgtactaatatgtatttttaatcagagccaacaactggcaatttttactttttaaaaattatatttttgggttttacatttaagtctttaatccatcttgagttaatttttgtatatggtgtaaggaaggggtccagtttcaattttctgcatatggttacccagttccccacatttattaaataaactataaaaactctagaatgaaatctaggcaataccattcaggacataggcacagacaaagattttatgatgaaaatgccaaaagcaattgtaataaaagcaaatggtgacaaatggggtctaattaaactaaagagcttccgcacagcaaaagtaactatcatcagagtgaacagacaactttcagaatgggagacaatttttgcaatctattcagctgacaaaattctaatatccagagtctataaggaacttaaacaaatgtacaagaaaaaacaaacaactccattaaaaagtaggcaaaggacatgaacagatacttctcaaaagaggacatatatgcagccaaaaaacatgaaaaaaagcccaacatcattgatcattagataaatgtaaatcaaaaccacaatgagataccatctcacaccagtcagaatggcaattattaaaaagccaaaaaacaacaggtgctggtgaggttgcagagaaaaaggaacacttttacactgttgatgggagtgtaaattagtctgatcattgtggaagacactgtggtgattcctcaaagacctagagtcagaaatattatttgacccagcaatcccattactgagtacatacccaaaggaatatcaatcattctattataaagacacatgcacgtgtatgttcattgcagcactgtttacgatagcaaagacatggaatcaacctaaatgcctgtcaatgatagactggataaagaaaatgtggtacatatagaccatggaatactgtgcagctataaaaaggaatgagatcatgacctttgcagggacatggatggagtggaaatcattatccttagcaaactaacacagggacagaaaaacacacttataagtgggagctgaataatgagaacacatggatagagtgtggggaacaacaaatactggggcctgttggaggtgggtggtggggagagggacagcatcaggaagaatagctaatagatgctgggcttaatacattggtgatgggatgatctgtgcagcaaaccaccatggcacacatttaactatgtaacaaacctgcacatcctgcacatgtaccctgaacctaaaaatggaagaaaaaaaatgtatttttaaaaagtacagtgtgatcttttgatgcatgtatacattgtggaatgattaaatcaagctattaacacttccattacctaattttttgtgtgcaatgaaaacatttaaaatataatcagtgatttttaagtatataggatgttattaattatagttaccatgctgtacaatggatctctagaatttattattcttgtctaatagaattttgtactctttgagcaacatctccccatacccttcccccaaacccccagaccctggtaagtactattctactctctgcttctatgagtttgacgttataaaaattttacttttaataacagaaaactcttccaaggcatttaatgaactattaacttttccaaaccactcattcagccataaccttgaaagcaaaaatgggcaacataaaaggcctcattaaaataatttgttttcagcctggcccacatatcgagaccctgtctctacaaaagtttttttttaaaagattagttgggtgcagtggcccatgcctagaatcccagtactttgggagcccaaggcaggtggatcacctgaggtcaggagtttgagactagcctgtccaacatggagaaaccccatctctactaaaaatacaaaaattagttgggtgtggtggtgcccacctgcaacctgagctacttaggaggctgaggcacaaaaattgcttgaacccaggaggtggtggttgcagtgagccgagatcccatcactgccctccaccctgggtgatagagtgagactctgtctcaaaaaaaaaaaaaaaaaaaaaaaaaaaaaaaccacacatgcacacatggtggtcatgcacctgtaagtccagctacgtaggaggtcgaagcaggaggatcacttgaacccaggtgtttgaggccgcagtgagctatgattaagtcactgcactacaggctaggcaatagaatgagactctgtctctaaaaaaataaaacaaaataaaataaaataaaataaataataatttacttttaaaaaatattgtttactttcaatatgagtaatgaacacacacattaattaaataatgcaatatatctaatgctcattcactgtagtatgactttaacaacaaaatgaacttatttatggaaggaaaatgatgtgatttagcaaaaagatgaaaatagtttcaatcagaaagctattcatgaattattgagtattccgtgcaaaatgaatatggaatgattttatctttgtagagtgagtattgagcccttattcagacccctgcttaagaagatcatgaaaaaatggaggggcaaacaaaagatctatcagccttagactaatgaaggcattttaaaatctctgtttaatcatttaattctcataatagtagtactcttgccacatcagcatggttatcattgatgcagtatgttagtatagctgtagattgcaccatcatatggcctcatcaaacatttaatgattaggaaaaacaagttacagttcaaaatctggaggataatgggtagagatggaaatacagagaagaaaaaaaggaaattaaagttcagtgttttattaatgtaaactttggaaggaaaaaatcaagtgatcgatattgctataaatgaagccatgttctctggttatatttttttctagctttggccattaactataataaattctgtaacttacataatttttaataaccacagaaatccatgaaattgacaggattctttacaaatggatcagagcttactgtccctcaataaacctcaccttaggctctctcagaaaactgttttaattatgaagcttgtctctctgtggtttatcattttggccaatgaaatgcatctgttttggagcttgcatttctctaagataaaatgagcttttaccccacagtgtattttttaatttatagagtatatgtatagtctttcttaaaaattcactactaaattgaaatgctctgagaagcagtatcacattaggtagaaacaggggctttcaagtcagatcacctgggttaggaatcctaggttcatattttacttgctgctctagtttattttcaaatattaatgataaatttattttcacatatttattggctatctcaactgcaatatgacattaacaagggtgactatctcgtagaactatatgtgagaaaattgatgcaatgtgcctcacacagagcaaacataataaatcttaattgtatttatcgttgtcgttattactacatgaagcaatagagtatagtggttaggagtagtggcagatgagggaagggtaaagggagaatgtgggaaagatctgcatgtgcctagaagtcttttcgctcacattccagtggtaagtataaataattggccacattctgatgcaaatggggctgggaataaagtcttcagctggcaagctgcttcccaatgacaacacaaggcacttgaagagggagcacaacacacattttggtggagaacgattcacctctgccacagcgagagcagcatcagtggtctcaatcctggttttctggaatacaaagcctgaattaagagcctgactttatctgggaggtacaaatccaggacaagagagtgaagtgaaaaggaagtcaggccagaagtgatgggcagtggtacagggatgttaccatgttggctccccactacaatgagcttcaaagagacggagagaaaagggtctgcaagtacgctggtgaaagcttaaagcaatctgtgggaggaagggagcagaagaaggaaaaggaatttatctcccatatttcttcccatttcctgcacttttcccatttcctgcacttttgattaaagttcaccacccagagtcttcacttgcctgcttcagtcggacctgcctcagccatgggaggctactcagaaagccaggtcccactcctgcaaagtggcatttcatctaaagtaggaagtggtggaaggagccaaaggcccttctatagtctggcagcctagggggaaagtctggtattccaagaaggtggctggtcattctcaagaggtggactgcattgcccaggcagggctggtcatctgcagggacagctgaggttgactgagtggatgacagtctaagaggaaactctgaggaggcacctgagacatcaaaagtgtacccaagctattcaccttgcagaaataaattgcctttttaatgtaaatgtaagactatatcagttgagaaatataatcattatatttattccagcaagattttgattcagaaacaaatacaataggtgctcatttcttgaaaagtgtagaatactttctcctcaaaaacaaacaaaaagcacataacattctagtgcccacaatcactaacaaaggtttatttttctgaaaatgtggtttgatttggtcatgtaatatactgagaaatttcactgtagaaacaatttctgttattattaacatcatttatattcatatacataaaacccacatcttataatcaaagtatcctcttttatgttgacaggggccatactttagacattaataagatcaggtatccattcagccctctttcctaaatcattttgcccaaatgagaatatataaatgagttttatcctcctccatgaacgattttccagaatcaaaaccagttatgtgataaaacttaattcctctaaacagattttgtgtttcgagtttcaaaatgataaggacaatctgagtctatattctggaatagcaattaatccaaaataaaaaatggcgctaataacctatttcataaaatccgagctttgtctctctttttgaaccacatctagtaataagggtaagaggctgtgcggccaaatgatttgtggcctgcgtatatgcccaatcttcatcatggaagctatcatcaagctaaagagcatctggcctttgatattttcttaatatacattaaaagactatggaccccaaatatcccataaagaaaaatgggaaacttaatcccacaggtttaatctaagtcagagaaaaaagtattacagagaaaatactcttagctattattgggaaatggtgaagatagacgaagagaataataaaaatcagaagtgcaagagacctagggtcaatttttaatgacttcacattcctctaaaaaagaggcttttatgttttattgtccaaaagcagtaactcttaaataattctatttaagtattttaaaaatcagtcatttctattttaagtttaccccagaagaaatatggtgtgtacattcttagatttaaattcatatttagtcattttttaaaaagtgtatttttataatgatgtagaatatgatccattggcatcatgctgttcattagcagactttttcttgtgttttatagctgtagaatcggaaatatgttttctattaaaggattctttaatttcaggcttcttgaataaaatcttgattgtcttccgaataaattctacaacttttctgaactacttattccaataagtagtttaaatgtttaacatttaaacactgagaatttcttctaataatctcgattccctaaaactgctcttcaggcataggtctttctgctgtagctttgtgaaaatgaactacttattaggaccatttttacacaatcctccagctacttattctagttttctctttttaaagcgaatatatttattattacttaagaactttgtttttttatctgtcatacttttgaattcaccccaaatctctattagctttgattataccatatgatcagttcttacttaaagttggtataaaatggaaatattattccatatgtacttctcactttgtgaactgtcattctgagatgtattatttatttttatttgttaatgcattggaatcaatccagatatttttcattgtcattctctatccagttcctcaattatttcaatagttcacaaataactgttgaacacttatttggggccactttgctagattctggaaaaataaagaaccataagtcaaacccattctcttactggatagctaggggaaaaaaaacacaccaaaaaggagtagcaatgtgtgactaacaagagttgtaacacagtatgtttcaaagtaggggaaatggtggaaggagtgagtgactacctgcagagggaaaattctccccatggatatttttatttttttaagttgtgtcttgaaaatgagcaagattacggcagatggtaggcaagcagggtagattgaagagagagataaatgtatttcagatgaaaagaatgaatgcatactcaaatcccaaatgtctggcgttgtgaaaacacattgcattttggaaactgccacggatgtagcgtagctggtgtgaagaatgggagaacgcatagaaccgagagggatggttggaggaggacagaaaggagctcgtataccttaccaagggatttggacactatcccgtagataaattttccataataaacaatgtgaggtttgtgtctcacattgaacgaaaaaaggtcaaaatacagagaatgaattgcaagggtttttgactggccacagaggcaagaggtagaagaattcttgtgagagaaaataagaactctactgaggttaaggtcatgagatggagaaaaaggaactaattccagaattcgagactttgtgccttttgattatggatggtgaaagaaaggagggagttaagaaactttcaggtgaagtgagtgaagggattattaagcaagacaagcaatagagaaaaggaggcaggtaggagaagaagataatgatttcactgaggtgactgtgctacactctcatggtaatgtagaaaatataattctgacacatcagagggagctggaggccagaggcacccattgaggggtcaacatatggcaggtaatgggacaagactaggggcaagaccaaaacccataggaatcacatgagtgaggagaaatgatgagggcctagaacgctaaacctggggttactaacatttagaaagtgggaagaggaagaggactcagtggaagaaactgaaagggaagagtataaaaggtgaaatgcttccatggccaagaaacaagagggctctaaggagaagggccaacagaatctaacagtgcagagttcaagtcagatgcagatggggaacaaggcatcagattgtttttgttgaccttaatggttaagacattttagaaaagtcaaagaaggaagtaaatatcagactgcagtgttgaagaagagaatggagtctgagcaaacagagaacatgaattgaggagaaggacaaatctggcaataacggaaaggaaataagtgagattgagaaaaagtgagggtgtggagttgatgcttgcttttcttcttcttcttttttttttttaaacgggtaatgaacatggttagaggctgaaggacacaatctatttgagggggagaaagtagaacgaaatgtgaaattcttattcttggacaactcaggaaatgagggacaagactggatgaaattaggaactagagataaataagccttgggcagaaggagtatctcttcctctgaggcaaagcaggacatgccttgtgagtcctttttgtgctttatggtactgacaggtcaggtaattttgacactcacagaggccactgtcctgccaaggcatgggagtttattagacagatgggccagtcacagccccagaattttggggctggaagacaaagtgggaaatgacacaggaaaaaaatggaaaatgtgaattattattcttggacctgaaaaagccatttttaggtgaactagtaggaggaaaaaatgagtgtggaggggaggccatggattccattgtgatcaagaactttaaacttggaatccgataaaagtaaattcgtatcagctcaggcactttctaagtacatgaccttatgtcaagcacttggccgctctctgcttgggtttcttcatgtataagttgaaagcaatggtaatattttcaaaagattgttgtaagaagtaaatgagaaatcaatattaagctttcagagtgcaatagaggaagctatcattaaactttatattcatttgtttatttggattacacagactaagtatgaaagtgggaagagttgtgactgttccagcacaagggctgtgatctccatgaagtcagaacaaaccatttcgtggggtggactcataagggttgaagctttcagagagcagtggcaagaggaagaagagaaagtgactaggaacacatacaaagtatcttaagcagagtcaaaggcccagctgaagaaggtagacattatttgtaatattgctaccctaagtagtcaaaagttatttctccagtattcggggatatgaggaatattatggaggggcaagcagatgagagcgatatccttggaggagagggcaggtggagggggtggttgaagtgactgtggaatcaggaatataggacctgaaaggaagtgaagccaggaaggaattcagagactgggagattgcacaaaggtcaatgattttaatagcatcagaaacacacggataagaaaatctccagaaatggaatctgtcagatgagcagcagaatgaaaatcactgaagtggagacaaggtgaaggagtgagattgtaaggagtgcaagagacgggcaaggtcctggagaggatggccacagacagggtttggattgtgataaacccgtgccaggtactgtggaatttgccttaggaggctgtagggtaaacacacctgatagcaatagcttaacaatctctttggaatgaccctctatggcagacacacctgaatgtgtgtttcaagctagggaatccaggaacagctaacctggagattcgttccttgtccgtgaggaacacctgagccctcatccagtctcgtggatcacaggctgcacaggggaatgaggctttgagttttgggttggatgaaggttgccaggtggaggtccttaaggggagggctttaagtgaaaatgctatataaactgcatgctggtagcaagaggttgtggttttcctgcccagccctccgccactgggctgtggagcccgctgctgctggtgcattcttgtacgtgaggtgtttctcctgtccagcctggcaccactggcctctttccccggtatgtaaacccttaaaatcccatatcttgtttgctggctctgggtctcgtctttggcctcttgaacctcagccctattgggttaataaggattcagcacaacagatgctgatgagaacattttgagattgacaaagctagatgatgagaaaactgtaaaagcttagactgttttacccacaggtttcctttagctctatagcatatggagtttgtaggtaattatacagaaatctaaagctaatatgagatttttcaaggaagagtcagtatctcccttatccctggagttcagggagcccagcacagtgggtaacacattgacacatagtaggtgtgcaataaatgttaattgagtgactttgtgtaatctcacatttaatccaaatatgagtcctttgaactgtttctcacttttccaaatcacaaagactgcttaaccatttaaaaaaaatacaaatcttaattgctataaaattgggaattttaagacactaaagtcttccttccaaagcacaaaagctagttgcattttggtatttttccttcattcatgaattcagcaaatattcattgaacaacaactatgtgccaggcactgttccatacattgggaaaaacagtagaggaaaaggcaaacaaggccctagctcagggagcttaattctagtgggggaaacacagacagtcagcatataaaaatatatatgttaatttcagttaggaggagggctgcagtgaaattaaaacaagtagtgggatggagagtaaccaggagtactggagtacagctcttttatataaaagacagtcaaagaagacctctgacaaggtgacatttaactgggaactgaaggataagaaggagccagccgtgtgaagattgggaggtattccaggtaaacaggtggtgtaaaggacctacggcaagatcacgtttaacagagaaggacaaaaacaagatgaatatgtctattctggagtctagtgagaaagccatagcttttcccaaattcttacatgtttttagcatatgatcacagtgtctattcaatttttaagggctgcatcatggttaagaacagtctctgcagtgacactgcttggatctaaatcctggcccctccttttctagctgggtaaccttgaggaaatttacctaactattctggcaggttttcttacctacaacttagtgatgataatacctacctcatacagttgtgaatgtaagatttcacagaatcatttggttaatatttattgcacacttattttgtgtccatgtgttagccacagtgctgggccctagaactccagaggcaaggaaaatacggaatcttcctcattttagccttagacttctgtataattgcccacaaactctctatgatacagaggttatacactaaacgaattatcaataattgttgtacgtaggtaagtacctggaacataaaaagtgcttcttaaaataattatacctttttaaccccctgacttgactgtatgggaaaaataagccattttgttacgtactcttaatgattattttcgttggttctgagtatcccctaatgtaattaaatctataagaagcatgttgttgttaatttttctacatcataaatcacttgacaaagactatcattatcatgctttgaaatctaaaatagtgatcacctgggtggcagagcgtgggtgaaacaataaaaacttttcactgatcaaaatctctttaaggagcatggctcattttgatgggtttctcctgaggttactaaataacaacaacaaaaaaggtagatatgctatcaaattctatcctgccggctgggtttatcctgtaggaaagttatacaatgtttcaaaaaaaaattcagttgccagaaaaaagtctcataatttaccataaaaaaacaaatttctggcttctgaaaaagcctatttatgttgaacttatagaattggatataatggctaagaggcaacaaacatggacagaatatgtttttaaaacatatttaccattctttcataatttcatgttttatcctaatgttcataatgttaaaaacattggctaaaaatataataagcttcatatactaaaattctgaagtattttatggacaatgacttgagaaaagtatggaatctacagagaaacctagaaaatttatctgtggagaaacttcttgaaaaaatagtaaagaaattctcaactggtaaactttttaaaaaataattggcggtatggaggtatgccaatgtaaagttgtataagtatgattaacttgaatcaagtgaaaatatgaaaagacaaatgtgggtgatattcctattgattattgtgaattattgaaataaaaaacatcttttaagtaatacccacattgtaattgtgtaataggaagcacacattttaatccttttggtctaagttaaatttaccaaatgaaattatatttgtgtgtatagtcttaaagtctgaaaagtgaatttctaaaaggcatagttgacacttaataaatatgtattgaatttgctaacatgtgaaacacaaacctgaaaggggaattggagattaatccacctgctcaattttctagatgatgtagtcagattctaagcaactctactatagtcgcaaaactaaaactctgtaacagttttttgcattgcactatgatttatcaattttttcttttactgttaggtctaaaagtaatataacttaacatgcttttatgttactttagacattgaagagcaatattccatattactaaatagcagattttaaaactttcattattcttaaattactaaagaataccatctcaaaatatcagtattctagatattaatttttcctatggtttatagttaattaaataattttaaaaataagtctgtaattttagacattgaaaaaaattaggtcccaaatgaaaattcctacaaattaggtttcccctggggaaaacaaaaaaggcattatatcataaatatgtatagctgctaactcaataaactcctatttctctgacatctatctacagtgttgcatcctcttattcttacttcatttttgtgattacagaaaactgggcacaaaccagaaagtgtggatttgtgtggagcacacattgaatgggccaaggaaaaatcgagcagaaagaatgtctttcaggtaagaatgttacatatattcaatttattcctattctctctaaatctgagctctcttgggtaactaaaataagactaccttcttgtgatgtgctcatgtacatgaactcgttgtctgaaggtcatgaaaggcgactcctcttcccagttgaatctttggttttgttgctttttttctggcgactggttgctatctaaacacaaaatgtatgttgcacgttgattaatataaacacacaaaagtcattgaagtttgcagtatatgcgatagatgtctggagttcaaacatgggatgtttgacttaagtagatttgatctagaattttcagatgcacacaaactaagactcaccaagtataagctatttacattcattgacactcttgccttctagtcattaattacatttaccagtataacttacaagaatggagagggctgaacagctataaaaaatagattctttcatattgcttactttagttttttgaaaaaaaaagttgattaataattgcaatcatattcgattgaatggcaagaaccagatgaaatccttgagagagataaaattggaaaatgtaatttcacacgttaccaaaatcacctaattgcgtgatttatctggtaattaataatttgagatcttggagtttgatttttgttctattttatatgaaatttaattttatatttccaaagtaaccagtaattagatatattttagaatttatataatttagtagaagagagatagagtataataattattttttaaattaaatgtcttctgagagcatgttggcccttgaataaaagtcaattcttctactcttaaatgctttgctgaaattaatattgggtcctatggaagcataggtaggtgacattttctaccgacactctcactgaggggaagaagctggtttccagttcggtttgtattttccagatgctattcaggtatatccaaataatttgggtccataaaatattttaacacattctagaataaattacttttctggttctagttttattttgcttaggtatagagattttttatcaaacaagaaagtgagagaatatatgcaattattatttgtcaattaaaaataaaatttaaaaaggaaggaaggaaataaaagggagagagaaaagatagaagaaaaccaaacacgcttgtcctgaaatcaatgctctaaagctgaaagtgactaaaatgtggctttacagaatcaagaaggagaaataaactttctttcaaagggaggaactatagatcagtgacttcccctttcccccaatttcttactcttattattctaccataaataacagtttagaggttataattctagccttatgacaacttagatgatcaacataagaagctctgaagtagaccgggaaagctcagtggtagagccttattatgtactgtgaatttagcatcctaatcaccaaaattgtaaaagatgttgaaatttgtcatagacattattcttggacaatagcaattctttggagatgggctaagccagcctttttcagtttcttctgttaatcttatgaagagttaaattagttcacaaatgaggatgacagtcagctatatttgatgcatacagggctgaaaatattgatgaaaaaattatgtatatttttatataactatgaacattatatgcacagatagacatttcagccacctatattgacagtgtgtatcatcccaatcttttcaggatatgactaatcacctcctgttgcaattttctatttgatttttatatttttgaatgtagatccttccaaagatattaaaaactattctcacttttggtagctttctgaaggtgaaaattttgccagctagttttgtttgtaatgtaattgaacagttcatggggcctcagtcttcttacagacgctttatttttttttagtcttgtacttttagagaaacaagaggtgatcataaggatattgtgaataacaaaccaaaagaaaagattcaagtttcatgttctgtttcattctttttgagtgaatcccttggtttccttgtcgtgctgaaatcttttcatcacctaaatgcatgagttttggtaaaactgactaatacatatccatagatacagactatgagagtaagccttttgagaggaacaatataaatagcttctatagttctgttaacaaaaaagcgtcgggaaggatttgccagagagctaaatctagatgacttgcatcaatatttgattagatacattagctggtcgaactctcaaatgatcagaataaacatgattatgtcttaaaaacatggtattaaggcattgttggacgttggagtgtatgtgtgcaatggtttcattacctgcagaataatgaagtgtttcttcctgactgaaaaagaccatcatagcttcagctgatgtgctacattggaaatagctttagaattccaagtttgaattaggcttggtgttcaatctcagtctatgaattatagattacagatagcaaatgactattgagatttttggttcaaggaaaatcaaagaagagcaaaattagaaatattttaaaatttgaaatctgtctttaaaaagtttgatggattagcaattgtatgccatgtaattacaatgtctgcagagaagttgaacttaaaatgaataggaaaacaaacaaaaaattgtatgtgcctgagaaatgttgcaagtctcagaagcacacatttgtgacaaccaaaaatggacagatttcatttatttcatttgttcatatatgctgtttggatgtttgagttgttttctctttgtactgaaatccaaattttccttcctagttgaaatcctatcaaactgttgacatggactgaatcttatttgattgctatgtggaaacataacaatgacaacattaattattaagttttggtattcaacaactttcagtaaatcagaatgatacttgctaagtttaagaatatctgcatattttataacagcacactctttggcctaattggtacttcttaacaataaataataaaagaattctataataaagtatgtattagatgttataatttatattaaaatatatacatgaatatacatgtataaaatatatatacttatatacataaaatatatatgcaaatatacatatgtatatatactctacctgtgtgtatacacacctaatagcttgaccttaggaaatagagtaagcacttccacacacaaacacagaaagatagtacacatttataaaagatcatacaaattctaagttaaagtggtaaatgtccattgctgctaacttttgtttaattctgcatttatgttcattgtcaaggactgtcacaagtttgatgtagttcgagaaacctttagcaactcagctataacgagctgggtacgcgttttcttagttaacagcaacactaggtcttcatcagggatagagtgaataaaaagatttatgttcaaaccacatgttttaaacattcctgctaagtgctagtttgctctttggtgtttagcctgaaatttaaagcactaaggattaaaaggattacaacataatcttaaataatcctaaatgtcatttacagagagatagttgtaataactaaataaaaccatgtgaaaggatggcagcattgtcaggcagcctccctcacacaagcggggctactgtcaccttctgtttcctggctgggcatgttaggcagttacagtctttcaataagaagttcaactgagaaaatggctgcaaaataatttagaacaagtttgtttaaaaaaaaaaaaaactcttatatcttgtttctaagttgaaggaaatttttcagttaggttttgtcttttcctttgaacacaaacctttctgagttaaatattttggaaagcctagggaaaggaagttcgtgacatggctatcaaatagacaactgatgtatctctaaaaaattccccaatgtccaaggagatacccccttattaaatatgtgagagtctcagagcactataattatttccgtgtcattaaatttagtacttaaatatcctttacttaaatattctgtcatgcaaattagtcttgtctccccaaagaaaatacatagaaactatatcccatactgtcttctacttattaagccagaagactgaacactttttagctgaataattgttactgctaagggtacagttgcattcctttaataaaacaaaacaaattcactcctattaaaaaaaaaaaagttatttgtatccacaatataggccctgtactccaaaatttccagggtgtaaaataggaagtaaagatgaagaagataactgtttcctgggtctttttcattacaggttataagacagcattatttatttaagataattaaatcatttttactctaaaaatttaccttttcttagagccagacagtgactggcctcagttttcctgagcttcctttaaaataaagtttttaaaaacatacattgggctcttctatagatttcatgctttcagtaggatatttctgccaattaataaatcatggctgattaggaatatgtcaattacctgtttgctgcttgaaaggcagaaaaaattaaatgactaaagaagaggaaagtctgttatcctccccccgccaccaccaatttgtaacctcaacaaatatcatggtcacatttcctggatttgagattatttttcaagattctttttcaatatattaaaaaatagatctcgggggacagattctgtccctaaaagtaaacctcggaatagatttattatttatattacttctctgactttggatggagtcttctgactacaatgtatattaaacttttttatgtaatattctccatggatatgcattacatttaaacataatttgatctttctgatctgaatatgtcttatcttaaaatgtttaagtactacttaagtttattaatgtgaagataatttaataacatcttaaaaaaacataattttaagccaaaaggaaaactactggtattgtgcttttatccatttccttgtgttacaagtggtggtttaaaataaatccgagcttttaccaattttctttcatttttcagtgcttgtagttagactaaatgcaaaaggatgattcttcacattcatacatgcattagatttccagtaaagctggtttcactttagagaattaaagtatcttaaaagacacggcattaaaaatagaccagagtaagagaaacattcacgtctaacacagttgttttttgccctacagcttgtccccaatcatttcatctacctattagatattcatccaacattcaggaggtgcagtggagagaacacatgggtctggggatgtgtgttccaatttgggctatgtcagttgtaactttatgcagaactcacagcaggatcctcctccaactttgtcacaccaaggaaataagagatgacagtcctcacctcacctgcccatctgtgttaatactaaaatgaagcaatcctgtatgtttgtttgagagcaactacaaagaagtgattttaatacaaatacagcagactttcattattcatctactaaccacatcatctcacaatgttttgagggaaattccagatatgaattttagaagaatagggttgagagaggtaaatatctgtgaaatgtaactcaaaatttctgctctacttctggtctttctgttgccttctgaacttaatagactgatatttaatacacaacatgaaaatctttttattgtgtgactaagaatatagatccttaatcttatttttaatgtgctattcttagtggcattaatgtaatatccaattaattaatcaatgacatattcaaattaatacttaaaagcatatcaccttgaaagccctaccaagctgttaatagaaacttgcaaaaggtaacatagaaacaagtgtagcaactatgccccaagtgaaagagggacaatagtgacacttattactcccctactgaggtatcagtacaatactgtttttctgattgaagggaaagagatatgattatttgtatgatgtttagcttcacttttgttgatgcggtcacacagattttgcacagagggaggcataaaattttataattagagatttgatttaagaatatgaatgtcaggggtatataaagattgagtgcaaatgatagaatctggggacaggaaataaaattgattgtaagaatctagatgagatcaagagagcatgttagctttgactgatgaaaggagaaacagaaacaagaagatggatggaaagtacattctgcaaatgaagaacatgcctattggttcagataatgtgacttgggaaccactgtctttttgcacgtttaattttctaagaaataataaaacttttttaaaaaatatattctagacatctagaattaagatttataaactaagtgtatcgttagggaaaacaacacgaactttatgttgcctgggtgatcccgtgaaactcactagtcaaagccttagacatcaaggatgtatgctcatttgcacaccttcattgtttcattactagagggcataatgctgccttactagattcattctttttgaactatcaaagcagcatgcaaccggatgacagtaaagattgaaaatagtagtattagtacattttggtccccaattagtgaagggaaccaaaattttgtaattccaaaataacataaaacaaaagaaaaaagtcaacttggcttcttctgtttctaacatttcagcagaagaatggatgcacgtcatctaatgaacttagacaactggatagctcacttcacattgccttctggaatagctggctatgtgagctcaaagatatgagttgtgcagttggaataaattctgggttttagtctgacaccaggctaaatgcaccatgctgttcttcatttaccgacatcatattgtgaatcccttcctctcatggaacatattctgtttcttgatgatttggtagagctagtgtggtagtctctatgccatccatgggctcctgtggcttgcaacgcactttctctgttttcccataagcagaatgagactaactgagccacatggagatcaaacctgagacttgacacgatgcactccaacctgggcaaaagaaaccactgccactggggaattttatggagtaaggtagaatcaacaagtgtatggtttttctacttgttattttaatctcatttataaagtatagaaaatatattgatgctagcaagacaatattcaagccaagggatcctttttcatatctgtttcaatatcttttatttttaaagagagcagccatgtgtatttcatgctgtgtatgatttttaatagcaaacagacctattccagaaaaaggaacaatttaatccctaaagctggtacataatagatggggccagtaaatggtatcacattttacagcttgtccataaggatgacacaggatgaaataaaattgagtgcttttggatagcataggatcactggctgataaatagatgacgctattcagtttttagaaacataaggtaatgaagctggatctgaaagcaagagaaaaaatacatatatatatatatgtattcagtgtttatatgccacaagccactgagcaggaggaaaatctgggcagcggtgagcaaagctgaaacctcagagcaatgtttaaagcaatataagaaaataacaaagcaagcatccataaacaaaggcttgaaatgcacagaaaaataagttcaagatgaaaggaaaatgcccacacttatgcataactggaaaggccacttatggcatctatgcatagagtctctcaatgtaagagttaaacatactactaaacatttagcagaaaaaaaattcaaaaggatataaaacactgcagggcagttaaggattcttggtatttgaagaggggaggaggctgctcttttatcttaacaaaacaggatgttgagaggtggcctaagtgaaacaatgaaatgaaatggttgatgttggggagaaatcaggaaggaagctgtttgaactcttttcagataacactgatgggtatgagatggcttaaccaagggagaggtgttcacatggagggtttagatgcatttctttttagtagagagctattagattcttgacctcagcctcatcaatttacctaacattgcatttccggcactgggagaaattctaacagtctcactttctgggtgaacaagtgtaaactaaaaaaattacagtggcaaaattaacaaattgctgaagcaccttgaaaacggaaataccaataatgaggattcctttcccaagtaacttagaaagaccttgattgtggtctttttttttttcttgaagttgaattttaagcaatgcttcattttcaaaattcccatgcccttgatcaagtaaaaggcaagcttctgatatttgagatctgcgatagatttgaaatcaattcatggaaagggaggttacgaacatactcttttgatgtgtaggatgtactgataggggtggcagaaaattatgtgaaacccttctcttttgacagctatactggaacatttacaaccacagatgttatttgtccatcagaaaagaaaatatttgtttcaagcttcaggcattttctactacagtatcaatatgaaattcaacctcaatttaatgtttaatgcatatgaaaataaatatttggagggggcaaatactagaaaacaattgaaccccacaaaatgtaactagcaatatggaaaaaaatgctggcttcattacgagcaaatttgtccttttactaaagtaaggattgttctattattaacataggaaatcttagatggactgcaaagaatgctgcattattcataaaagcattgctgccatctggtggctacttggcatttcaacactggcttctctgattcggtttgactgggtgctctcgggaggtatttaaagaagagctttaagtggtaaaatataaatgtggacatcctctggccctacatgtcattcatctgatggcagtcctttctccctgtcttgtcgtggaatggaggattcagggagaggaaatgagatacttggatatcttttgtcctgaatgtgaaagtgtattttacatggcttatctaaagaagttactcttggctgttgttgactgatgaattttatcgacattcatttctgttggcaaataaataagtatatacccaaatattaagaaggtttattgaatctaaagatatgctattttgcttaaataagaatatacatgagatgctttaatccctcatttggatctaagcatgaatttttttaagttatcagtcactgaatttgactttagaaataatataatttagaatgtcaaaaaagaaaatgtacagaggttcataaatttcttcccatttattcaattgttatattaaaatgggaggattgttaatgactcagaaactcgtaatccttcttcatgaattttcaagttaaatgacaaatattattcagttcacatcgcactttttgttgaaaataaaatagttaaaatttaagaaattttgatgattctcaagcatcagtgtattaactcattcttaacaagaaccaattagaattaggatatctctgtaattttagtacggttttaagtttccaataatcgtagaaagtctccttggtatgtaatgaaaaccttgaccctttaaatggctatttatatagatcacaagtctttgaagattataggagataatgagttaaaattgccccaggaggaaagctgaagttttcttctgaattctcagggatgatatttaatagttaatattcagtttctagtgaatatttccctgtatcattaaactgccttctgatttagtaaaagtcagataacaaagaaccattacactaaatctggagaattatatactgaattaatattatcctttacaagaaaatgtggaaatgcctatattgaaagtaagacttttgggttttatttttaaatttgtgggtaagattttcaatctgtgaatacatacttgatattccctttgttactagctatttctaccactaaaaataattccttcttcaaaatatgtaatttggcttatggaagaatgttgctcatcttctctaggaagatggctcgattccccatccttcctctgttctccattctactcacatttaggaaggatatgaacaacaacaacaataaaaccttgcaaagaaagtaaaatcgataatgattatatccctgtctctttcatctgtaagtataaaatttcaactaaattattctcctaatagacttggatacaaccctgtggtggtttctaatggctccataatagagatagtaaaccttgtagctatggtcaggatgccctaggttttagtcataagttgctaatgtttgtttcaataacatttgctctttggcagcttttacagctacttaacactaaattcccatttagtcaggaggatcattcatatactgtaatgaatgatgtcaccttaaatcctttactatgtaattgctggatgttacattttatagtggggcatttgatggtgtatttgtttatgctaaattttatgacagtgacagctgtatcttggaggaatgaccttttttttttttttttttttttttttgagacggagtctcactctgtcacccaggcttgagtggagtacagtggcaccgtgttggttcactgcaacctccgtctcctgagttcaagcaattctcctgcctcagtctcctgagtagctggtattacaggaacccaccaccacacccggctaattttttttttttttaatatttttagtagagacggggtttcaccatgttggccaagctggtctcgaactcctgatctcaggtgattaccagccttggcctcccatagtgctgggattacaggcctaagccacggtgcctggccgacccttttcgttcataggaatctagtttcaaatctttttaagcaaatagtttcatcatatttgccttctggcttaggctaggttcccctgaaagaaaaatttgagactaggaattgtgtgcaagcagtttatttgattgaagaaagcagaaattaagaactagcaagagtgaaacagaaggaagaaaagccaatgcagaacccattattgagttggtcatagggtagctaggacaacttgccagaattttccacccaaggatagacaagatgaagcatttgttcattagctcctgagcctttggtttctggttgcctctgggtggggataatgtctttagatcttgagtttcaggctgttcatgggtgggcgtgtcaagaaggctctttcaggtttcctaccctgtagaaccaggaaatatccacagcagatagtaaaagatgtgtaacgcgtgctgaggcaagatgcagtcagtacaaaggagttgaagtccacacagaactgttgcaccagctgcagctgtagtgacacccacacagctaagaggatgtgaagcagggcacaggaagcatctgatgcaatttaccgcttgcaatattcaaatttacttatctcatgttaaatctaatctgttgccatgtcttcaaaatgatggctggcctcaatctctacaaaagagctaataaaaatgtttttgtttaaaaaataaaaataaaaaagctccactcctccactgcaactgtgtatgaggccatatttgatatttatcatctaccaccttcactcattctagattttcctcatcctcagccaggaggagtttagtcggttttgtttgtctgaaggagtcaatcggacctttgtatatgcggggtctgaacctttgattttttttttttttttttttttttactttgtcacgccctgttcactgtagttgacagttcactgctctcatcaggcctagatgtaccacaagacatctcactgaatcatctgacttccagattcattcttcctcctgctgctgtgcatatgcaaccttactttctcattataattagggtcagctatccccatgaatatagtagctattttagttgccctcttgtacacatcatgagtatccatagttaccatgcagtggtcacagctttgagttcatgatacttactaatccctgttagaagcagaactctcccgtatcccaagaataagaatatctaattcagcagagccaaagttgcaaaacccagaagcatacatgctgcagataggttactacgggggctactcttactcctaccttttggtccttagacccacatattccacctactggagacaccatgtcatgtaacatcatgtatcaatggtgtgccatgcattgattcagtgaatatactgcaacttggaatattgaacccccaaaaaacaggatcctgtctccaaactactacctaagcagacactttaagaggccacttcattattagatcaggttgatttcttccaagtgatgtgacatttagtaagaacggcagatcttaagatcacgtgcctggtgtttcatttccctcatttccttgatttcaggcaagatcatgaatcaccccacattgctaattcagcattcttaaagatctggaatggtagggcaggcagagacaccataatcagagaaagcaaacccatagaatgaatcactgttcccccaaggatggaaggggtctgatgttgtcagtttgctgtcaaacacctggtttgtcctgaaggggtcagtatctgcctctgctgctggaagatcatgtaatcagtggtaggtagccttggggagaaaaagccatgatgttgagtgtgtgcagcatctccatctctgccacatggccactccactcatgggcctattgtgcatgttgtaagtgactaaagagaggctaaagaacttcaactgaccagtcatctggtacattggcttaccctctggtagatgtagacaaggatctgcatgctctggatacattcttatgaatcttctaacatttcccaggcttcttgtttctaatctttcagactgtctccttccaggcctctaaagagcaggaaaagtcaccttccattgcctggaaatcagtctatattctaacctcaggctaccctcctctcaagatggctgcttgcctctctgtcctgtgggaggatttctcttcaccacagtcctataagatgactgggtgggtctacggtgaagctgcagtcttttttttttttttttttttttttttttttttttttgtgctcaccaacatactgagctaacccatccatgaatcaggcttgaggttttttttcatcattcatcagctggcttcaagcatctccatgaagccctaggggtgaactcagggagaggcaccagtgttaacagtgacaagaaaaatgggaatttgagccatctgttcatggaactttcttaatccctctagacctgtttaggccaaattctgaatatagcatttcaatccatggattgttgtccactctatgattcagtgaattcaaaaatacccaggtcatcatgagaagctgaagccatagagttgtctgatgtcatataattagatattccttctctattctgacccagcaataggccagaagctacttttcaaatgggaaggatatttttgctgtggaaggtaaggccttcctccagaaccttaaagactttcattgtgaggctgttagtataacctaccacacactccacagtaatattatatttcactttctcactaaattttctgaatcatattcccaagagtcaaggagctcacatgacagcctggacctgctgcaggcattggtagttatgaatagccaccctggtatatgaatgacattcagaaatactcctattgtccaatctactaacttatctagtaatgacagtcccgggcttgtggtcatatcaccctatgagaatatctgagtgaggcccagattcctgattgtctgcaaacagtggcagttttaaaccactaaatattgggccggtttgttacagagcaatagctaattgatacaagtaatatgtctacaaatacagtagtttgatttttacaagaaatggtgacatatttgaaagtcaagttcaaccggtattaacggaccttggaaaaaagataatgagaccacagttcttggtgtcagcttctaataattaattaccaagcactagctccatagaggcttgtagagaacatgcaggtggtgccatttcatctggtcatgtagcttttctgttactcagattgtttacagaaatagctgcctaacaaagttaacttctaggaaggatgccaggttacacggaatcataccagagtcttagaatcacattgggctttcacccaaagtttttgcaacattaggtggaggcaatataatttggcttgaaaagttacaagggaaaaaaatgtcagaaaatgctcatggaacagggtgttcagagtcttcaagataggatctttcttggcctcctgaaaatcagagaaaattgtatatctgtgatttttttttttttttaatagaacgacccaacagaatccagggttgtcacagatcattattaggccaacaactgtagaagttctaaccccaaaattgagctgtaagacataggagcagatagagctacagttggaaaatctaaacatagtctaaaagttttggcgcttcaagagcttctgggggaaagaaaagaaatttgatttctgtgttgctgatggaaaagctcaaaaattacctgagaaaattgtatttgacatatttttattgcaaatggtattttgctatttgtttctaaaagttgaaaatgaccttgcacgttaaaaatcatcagtttagaaaaaatatgaagtctgtttgcatttggaattaagtattccaataatttcttaaatttaaaaactacacatagaaagtgttattattattttggagagttttcgtaggatattccaggccaatgatacttatctgggtaaggtgaacatgcaattcttagacttgcctttgttaacttttagtttttttccttcccaaaatatataaacaaaaaggtttaacttatttctttctgaatttttctgacataaataaacccaagataagcatagtgtattcatgttaaagcttcataacgctaagtctgttctgtcttggactgaaaatttatttgaattccttcaattaaattaaaatttaaagtttcaataaaatatattatttctaaatctattttaggttaacttcaggaatagaaactgatgaaaaacagggggtaaaattattcagttacatcaaactctaggtgttaagtgattttttttcagagttattttcgaaactgtgtgttcagttattactttttcatagtactgagtagagctccagaaacttggaagagtcagttttcaaaaatatctaatttatggttaggaaactgaataacagtcaactatttcccattgtttcccactaagtcctttgttccacagttactttaaataaattttctcacttcatataaaatgcccttttgataatactgtcaatttatcttctaaagtcaagcaaaattaattttttcaatataatacaaatcaaactatggtgaaaatttcagtgataggagaaggtagctgaaatatatttcaagtacaagctctaagcaagtaactaagacttggattatgtagagtgcttactttctattggtgaatactactttgctgggccccaaaacagggcagactaaaggtggttggtagttgccattgtatgaaggtagattgcttttacaaaagatacaatttggaaatgatatgtatctatgatatgtttcttattttgttcacttagcatatttaagtttacttattaaaaatgaaacatttctgagataattttctattttaatgactccaatctgatttagagacagagagatagagttctccttaaattattttgcatagggtttccattgtatggacaaaattcttatgctttttttcataaactttgctcaggattcactcatgtttctaaataaataaaagataaataaaaataagttaatgaagaaaatactaacaggacaatacaaaggaccaagtatcattggagttttggtttatcatagttccatgtatggcccctgtatcagccaaaataggctaaactatgctttgagaacaaatttctgttgttcagttccatactgtcttcagtctgagatccaggttgatggaatagtctctttctggaagggtgtgacaagcaacatgtttgcctttaaagctcttacctgaaagtggcatatgtcacgtctgtcttcatttcatgggactaaggaagtcacagagccaacaaagcacaaatgcataatccctccatatgtacagtgacgacaggaagaaacactagttggcatggtaaagaattgtagaccctaccacagtccctacacaactaaatattcagatcacctgctcaatctaaataaaggtttgccatagttgttgttgctgttgtttaaatgaggcaaactttgataaagccattccagagataaaagcacatttaacataatttattgagtacttgtaattgatggtaacataatgactgatttaaaagaaccattcagctcctttgataaacactgttaagtgtcaagttattcaacaacatatgtcaacctgcatgccgattcatatctatttttaaaatttggaagtgttgggaatatgggaaatttgcatcaataattatttaagtccaaggcagatgcataaattataggagctgaaggtcaaagaattcagggtgaaataagtattttctgaaggtgacaaaaatgaggtaagggttgaaaagtatttgctttcagtaattgaaatatgtaaatgggtttagtcctttttccaatagtaaatgaatgtatgttatacatcatcaaatgaattggtattctattcacagatatttgtataccatttttaaagatataaagtgcatacatatcctacataaatgtttttggcatgttgggaaatgctctgctgagaagatatgctgttgagtatctttgttattggaataattgttttttggtatacaaatatttagcacaaaaaatattttctctagctagttttatgaaatatatccatgtgggcatgtatactaaagtgataatattagaatggatcacagatagaatgatggccattaatgtaaattgctcaatagaaagaaaaccccacattttgcttgggaaaaaaccatctgtattttcagaatgaggcataaacctcatttttaatgctctagatttgttacaacaagtaaaaactactctaattttagcaaaagtaccaactagagtcagtgaaaaatgattgcaattcaactctatgtatgtaactatcatggcaaactaattttatagagtgtagttttttttttttttccactttgaagagattggtgttaaatcctatttttctaatgtagagcatattggtttaaaacaacaaacaaaaaggccctcaaacaacagtcccagtaaaccaagttgcaattagctgccactcctgggaaatattctaggatatgtggctggcacttgaaaaatttacaccttctgaggaaaagcagaaaaattctgtcaaacaattaaactgattggaattcccaagaatataaaaaaccaaaatgagtcttatgttagaaaagaatgggaaatagttctatatatggctgcaaattggagcagaacaagtaaaagattttttgcaccttgtataaatcattttttttctttagaacaaataggaaagtcaaggaaaaactcattgtactagtttatttttaaaaattacacgttagagtttgaaaatgtaattagttaaattacctcaaaatagcaataggacagagagttgttagtaatatttttggataaatgtatgagatggttgttagatctatgtatgaatatacattggacaaccaagttggttaaaagtaaaaatccgtatattactgttaaagaatgtagaaaatatcaagatgagaaatattcaaattaagagtaagatagaagaagaaattggcacttctaagattcaattaggataaactcttataactttgattaaaagaaaactatgcagtacaatggaaagggaaagaccctattgtatctgcctttcctaagtaaatatattccaaagtgttataaaaatttagacatcttagattctcaaggaaataaaatgttttcttgtttaaaacgctgtgtgtttggcagatatcttgaagaaagagaaaagactatggtttgcatgtttcctatgccaaatatttctatgctaacatcttcaaatatgggttcattacgttcaaattccctaatttatatagaaattaaaagcttattaaagtaatgcttctcaaacttttccattaataagtctctaaagagagaataaagtactttgaaagtctggagagcggtcagagataaagatatagatttagggattttcagaatttagatgatatttaacacatgaggttgaatttttgccattaaagctgtaatttttgtcacatataaaagaaatgagtcttacggaagtcatgatccttacaatcaacttgctcttcagttcctaaatttcactatcatagtgatttgattgtattttttataacagtactccttttcagctgatggcagagactcttgatctctgaattaatatagcctcaatgagtcatccttcattagtaagatgaagaatgaattctcttttacccaattaggctctgagcattttccatgaagatgaagcacaaaataatcctgaattttaaatctctgagttggttatgcatatacaccttccaattggaaaaagtgtttcaaatcacttcctataagttataaatgtgttagtttttttttaagtcaagctacttttaaaatatttatttttactatttctttgattatactgagaaaatcaagaggaaaattatttaaaataaatcattctcagggatatactggccacaggtttatgataccaatcttgcaatcatgcctattaattgataagtgtacacatcccattacatgcaagtatcagtacctttttttacagaagttttccaaaatgaggtacatatgttttgttgagggtttataagaaaaatatttctccattaaatattaatctgtgttacttttttttgttttttaaaaacagagtctcgctcttgtcgcccgggctggtgtgcaggtgtgtgatctcggctcactgcaacctccacctctcgggttcaagcgattctcctgcctcagcctcctgagtaactgggactacaggcacgcacccccacgcctggctaattttgtatttttagtagagatggggtttgccacgttggccaggctggtctctaactcctgaccttaggtgatccacctgcctctgcctcccacatattcttaaccaactacatattttttatgaaacttcatttgattttaactttgcttaaaatgttaccacacagtagtcttcaaccttgtagacatttctgttttgctttgaatatgatcttcttggtatttacaatttaaaataaaattcttacccatcctgatcggtagcttttcacttgtattgcctatttttgaaagaacttcaatattttttagcatttagctatttgacccattggtgatatttaatatgttcataatttattttgctgtgtagtatgaagtaactcaagtactctgcacattcaatatcatttggtaattaatgaattgctcttctaatgtttcgtgatgcttatttgtaattacatactactttcctgtttaaataaatgtatctcagagacattttatttctttggtattgacatagtattactgttttagttattttaaacatataatttattataactactagaaaatcaagtctcctggtcaactttttcttttcaaaatatctcaatattgctatagcattctcagactgttagtatggtatggaaacaacctgattttggcttttgtaagtaacctctttggcactcgtgtttatatcttcattcagaaaatgttagaaaaacatatttatcagtcatattcaaaatattttaatgtatattcaaaaacatttgaggtcaagttatttgtgttaatgttcatatcactgatcaagttatgtttttcaatcttcacaaattcacactttctgtccaatagctcctctccatttttcatgtgtaccatttctatctcaaaatttccatctgtctttcttctgtattagaaattgaagtttctcctttccattgtcagcacaattttatgcactattaattatgctcttttctttctttaataaagattttaattctgctactgtatgtagatttctcctgcattgattctttacctttcttcagccatatgtgcattccatttggtattaaccctttaaaaaagcaaatcttccatttctggcagtataaattacaagttttctgttactgagaggtcaacaccaggtacattcctaaagtttctatttcttgtaataaatctaccttcccccttaacccagataaacattttctccgtatcttttaaggatttcttctcttctaacttgtggacaccttttctaggacccaggttgatatatggttgttgtttggttttgtttgtttgtttgcttgttgagacggagtctcgctctgtcgcccaggcttgagtgcagtggcgcgatctcgtctcactgcaagctccgcttcccgggttcacaccattctcctgcctcagcctccggagtagctgggaccacaggtgcctgccacctcgcccggctaatttttttgtaactttagtagagacggggttccaccatgttagtcgggatagtctcgcgctcctgacctcgtgatccgcccgccttggcctcccaaagcgctgggattacaggcatgagccaccgtgcccggccgtttcttacaggtttttatactttcaaatctacttgagttctaacaaactcattcactctcatcttgaaggaaaatcgatgtgtcaaatatcgttttccatgttctgctcattaaaaggagatggatttatttcaagaattaaattgaaatgtattttaattttaaacagtttgtggaatttcaaacagtttgtagttctttttttacttggatgcgggcatgaatctataattccctagaagaatgaactatgccttgtgttcttttaaatcgccggtcattgttgattttacacatcaagtgaaatctatcctcttctcatgctgcttccttagaagctgatggtggtggcaggtgaagaagatgggataaaaaggaatgtgaatggtcctggtggccccagaaaacaggtcacacatggtaggctgatgattgtgaggctttgctgtgagcagggcaggccagaacatattagggaggagagctaacaagggctttcttaacatccatactctttctgctttttctgcttaacatccatactttttcttcattgaaaagttctagaaatgggccaggcacagtggctcactcctgtaatcccagcactttgggaggctgaggtggatagatcatttgaggtcaggagttcgagaccagctagccaacacagttgaaaccccatctctactaaaaagaaaaagaaaaaaacaagaaaaaagaagaaattgccaggtatagtggtgggcgcctgtaatcccaggtattcgggaggctgaggcaggagaattgcttgatcccaggagacagagattgcagtgagccgaaattgcgccactgcactccagcctggcaacagaatgagactgcgtcgcaaaaaaaataaaaaaattctagaaatgcattagctgctcatctcaatccaggtgatctaaagtatttagagagtattatgttctctctctttgagagaactgccaatcgatattcttgattttcagtactactaaggcctgacctcttttgttttcatgtggttttcagtagaaaaatattaatcaaataggtacttgaccaccaggtcgatccagaatcttgctttttaattggatgtgttttaaatttaaatttaactctatatgatggaatttttttttatttttggcattgtcatctccaagtttgacaatggaaaagtactgatgtcaatatagactatttttattttatgttttcaagtactttcttgatatgtttgccagtttataatttcattgttcttgtgtcttttcaataaattgttttaagattagattagtttaaataaattatttatacttctctatatacatcattattctattgctatttgtgaacactatattattttaaaacatttctgcttaaaatattgctacactaatatcctcattttcaaattgttgacatccaaaagtgaaagaaattgggtgggaatactttcatttaacaaattagttaaaaaaaaattcaacaagctctaataggaactaatacatatttttgaattatttgatgatgattggtaataattacagatacttctcaacttatgatgggctgacttcatgataaaccctttgtaagttgaaaatatcttaagttaaaggtgcacttaataccccaatgaacctattgtaaagtcaaaaaaaatggtaataccatcataaattggagaatatctgtactaaatggttttatagtataaaatgttcaacctaactctagttaataagtatatgaacaggccacttactagttggatgaaatatattacaaataaaaaatcataatgcatgtccttatgccatatgttgcatgacattttaaaaaatattaaatacgtcagtgtgggctaatattttatttgtacaattttttaattttataaatctcttctgctaatcttactttgtaaattaatttttaacctattttaaatgctagtcatttccaaaaatttcatttccatattttattcctataaaacttcatccagttagtaattttctatttattgctaatttatttcctgatgaatacaaagattattgaacatagtctggctcatggagttcaaatcttttttaatgaataaatatattttgtattttttttctggaattctaacaactcttctgttatattatgactgggaaaatatctgaatttgatacatgaactttccagaaaagtatggctttctgcatttggtggccatccattttattgtaatcactacttatcctttaaaatttttaagtaaaatgtcctgtgaatcttgttacctttgtcagttagatggcctcattaagtactctgttgtataaacataaatatattagataacaactttgcagcttcgaggaaaagtggcaaatgtctctctactccttgttatctgggccttagtgacttatctaagtcctggctgtctttaaagttcagaattttaggagtacaaagctgtctttaataactagtttgtttccacagagaaaaaaaaaatccaaagctcttcattaattttcattgttacattagaactagcttttctctggtcttctcatctgtacttcattaagtcacattctgtggtataatgttgcaagtttggaaatgcagaaacagttcaagaaattgattctatttgttctttctgttcaatagacctttgatctgaaatgttcaatggtgcctggctgttccacacaagccacttttaaaccattgttcacattgtaatagccttgttatcaggttgtatgaattaattccatcacattaggagaaggaagttagacttccacagcacaatctaataactgtctcatgttaccatacaattgattgggtcacaagacaacacatcgtgtttataattgaactgttttgtaaggtggtcttggtcttaatttcagaatttcataacgacattaataggttttgatttccccaggacaccttgcccaacagtctttgagaacctaacaatgtataactgaaaatgtcacaatgaagcaggccaccactcttggtaaaattcccgaatcaaactcttctgtgcaatgatgtaaccacctacaaacaaaaccagcactttgggaggccgaggtgggtggatcatttgaggtcaggagtttcagaccagcctggacaacatggtgaaaccccatctctactaaaaattaaaaaaaaaaaaaattagctggatgtgtcccagatacttaggaagttgaggcaggagaatcactttcacttgaacctggtaggcagaggttgcagtgagccaagatggcaccactgcactccagcccggacaacagagactccatctcaaagaaaacaaaacaaaaaagcagaaaccacccacaaactaaaaaggcaattatcttgatggggcaggaggagttaggagaaatatggaagttctctagtcagccgctgtcaaaccttggcagagagtagctactaagttgtctgtggagagatcccagagatcccacaggcttgccacaccatcacggaactattgatagcaaaaaatggaaattaactagtaagggaatggaataacgtgttacgttgctgtctctatcacatattactgagcttggtggtggtgagttgcagttagacaatttgcaaacagtaattttgaaacagttcaaatagacacattaacaaattaactatttgatgagctgaattcattcctccacctggttaagttcgtatatgtgagattattctcattacttacttgaaaagatccagtgagcaatttttccttaaggcaagcttcctgctctttaggttaccaaccccagagggatgatcaagtgagttcccagattcttttatgtaaggtaacttccagggctattaacctatgataatgtagttccctggacccggtagtcctctgatacgctggtttgcttgtgtctgtactcttttggtgatatgtgactgctttgaaacaatggataagccctttaacaccactgttcatttgttcatttgtttgacttcccaatgctgagccatttccctcctggtgtgccctcactttgcctctcttccaagaccctggctatctgaacaggtagggcttgtaagtcttaagctattaggtacctttgggcagctttgttagacaactttcaagtgacaagacaaatccataaacccatcctttacaacaagttctttcatgaactcttccttgacttccatagcgagaatcgttcttcccacctctactcttctgtagtgcatacaaccttaaagagactggtgtgaaaattaaacataacttagacagaatggctcccacatcaagtgttcagtaagcatgaataatgtttatgaagaccatttattcagcccaccatttctaatcttatcattaccctttaccaaacactctagtgaaatctcagcactctgttagatctttcacgtgtatcatttctactctttgcagccgacttaccaaatgtatagcttggtctgttttcttgtttaaatgaaagaatttacagagggattagttactttcccctatttcataaagctcttatggcaaaatcagggtttaaacacagaggtgggttgcctgtagtgcctgcattgctaatgtttatttaatattacttctggatgacagttttgctgtctttgtgcattattagaattattaatcccatttgttagacattttttgttaactggcatttttatgcatattttcatatgcctacatattccttctctcattacattttgcatctttgtaaagcaggggccacaactactttttaaaatcttctggccaggtgtggcagctcacatctgtagttttagctacttgggaggctgaggcaggaaggatgacatgagcccaagagttcaaggctacagtgagcagcagtggcaccaccacactccagccttggtgacagagtaagattttgtctcttaaaaaacaaaacaaaaaaactttagtgcctaccatagtttcttgcatggtgatgcttaatagtatgtttattctttgtttggtttaattttgtaccttgctgaaacattggcttagctttaggcacacaatagaaatgagcaaaaacttcagagtgatttagaaattgcatcgttggagacttccccaccacaccatcttatcatctttctatgcactgaggcctcatatttcacagtgttctttgtagttgtcttgtttctgttgctgtgattgtcatttgtgttttgatcctggatttactgaaatgcttccttacaccctcctgaactttctttgcttttccccctctagtatgcccaggcaacctaagcgtggaaatgaattcattcttagccattctcttttcaaacaacaagaaataaagtcgtttatttttcatttgttgcacactcctcagtaagaaaaaatgggcagtttcattacgtatcatttgtttcttatttctttagtgtaactggcagacatgacttgtttgcttttggaaaaaggaatatgagaaggacagattcagggactcatatcaggatccagaatgtccccccaggccttagaattatatatgtgcttgacacatagatgaaatgtctgcctgggtatttggacagatagaacttttacttttacatcttaaggtaatagccatctttgggcatctttctcagaaaaccttcaagcagaagccaatgagacaaatccagagactgtactgccctgctttgtttactaaatgcacctatttatagacaaaacttgaagttggtgataatacctacatggtgcaatggggtcacaacacccattttaatcagctggataatctttagattgattagtttctaagcctgaggtaaaatgggccatgattccttcttcaaattctctgtctctgcatcctcctcttgctgtcccattctcaccagcttctgtaggggccttttcctgcccagttctctccatatggtttatttagagaaaagtacagagaatatttttatactctgtgaggaaatttatagatatagactatgcatctccagcatcttacaaagcttgggttcattatctgaatatttttacattggttgatagtggcaggtctgagactctagcagaagtaattctgaaaacaattccctccaggttgtatttgttacatttatattttttaaaatcccatatttatatactaaacaatacagacattttatcctatgtagaaagaaaatgccaagataaaaacagtgccagggttggttaattcaatagctcagtgacatcattgacaacacagttgttccttcttcctgtcctgtcatcccgtgtcaccttctctcactcacggctgcatgttgcctattgccggtccagaatgttcgtgaagacctgacagagttaagcagattgaaggattctttcttatacctcttgaagatcaaaaaatgcttctcccagatggtctgcagcaggcactcttgtgtcttgctggactagaactgatcacatgcccaccccacaatctaaccctataacctgcgagaggaatggaggtaccatagttgacgaggaaggaggactgacatttccccaacttaaggctctactagtaaagaagaaaatggcttttgagtaggtaactgagaatgcctgctaaatttggccccttttttagacactgaccttgggcattatctattgtcattcacatttcttaccccaagtatctaattatctagtccaaatgcagggtttttttccattccctaatgtagagttccatagtgcctcaaatatttctattctggtacaatgcatatacaactacttaaataatactaaattgactactacagcaatttaaaaatacaagaaatcttcttatttatagtttaataaaaataacttctggcctcttgagcccagaaggcactgtgaaattcatagtcacattttgagatacagatattttgttctttgtacctagctacgctgaagagtttctttctttctttttttttttttttggccaggctacatgtaagatggattaaaagaaggcagatttattatacattgtaggtgctgtttttactcaaatagcagagaatttagaggccacttatttaagtacaaatgctgcctcctacctaagtcacttaatcaggacactttaatttctaccactgctaaattcagctaataatacctgccccctatctacctctctgggaagctgggaggattaattagataaagtcttaaagctcctcagagagaagtggtatatgtaaaagatgttattatttctagggaagaatgaagcggtatctcttttatggactgtccacacttctagaattttttcctcttattcagctcaagtgccaattttgtggattttaattcatcatgtgagacccttctcattctcaagtagttgtacttagagaaaagattttcaagtattgcgtctgatgatgggaagtacattcctgagtttcactgaatatttcagagcactatcctgcaaactggtatatatgctggaatctggttgcaatatttgtaaaaacaagccatgactgcattgcagaatgtgacccgggcctatttttgagatcctttccaatccccatgatctaagtcaggtcactttggacatagaagacaaattgatagtaaaatcttgaatctctcataaatcttgttaaatagtttatatttaaatattcttttgagctatacatttttatatttagattacagaattctatccttcaagaattctcagttttggttatatagttaagtgtacacaattttcccaacctatgatccactttacagagctttgagtatgcttgccttttacattgctttattggacattgaacactttcattaactattacattgatggtttcctgtttagaaattgagttagcacatccctgtgtgttttggtaactgcagctgctacttgatgttaacaagtctgcattctggtcagtggtgcagcagctcattacagatagagatgggcttattttctcacagtagtttgagaagccagtgagtcactggatccactggagatcttgggagagcttgggaagtggctgttgctgggaacagccaggttgacttcccccaaacactttagagaagattttgaccaccttcaatcattcacactttctagaaatgaattcaacctataattcttcacaagtcaaaatgacagattctttcaaagcaaaagcatagctatatgatttactggaatcaggttttcatatttataggctttcttttaaaaagataaaatttcttgtttttcttccagttctaaaggaaaagatgagaaatgagtgtcaaatttgactcagtgactaataccaaactcactcaatctgccaggcatcaggaactgggcaactcaataggagcaagaaaggatgtagggagcacagtgtcattaggggaaaagcctttaccttgccggaggatagagtgaagaagaaaatcaagggtcaggtcatttctaggtctatttatcacatgaagaaacaataaagagaggttaatagtgcacttaagacttgcactaccaaccacttacctaagtcaggtattgggccctgacccttctcatcataaactcctctgctcttggcagaagctagaaatgagggtgagtgaacacgggcctagcatgagagaaggcagaaatggtttttccccgtatggtgacaacatggcttttcctagtgttaccagcttcattcatcaaaatgtattatctgtctatggtgccttcttgtgaagcattcacagccaagaggagtgctgacattagcttaaaaagctaagttttaaggctttgatgaaggattcactgagtggttttgagaaaggagaatcatggctttgaaattcaaacacatccttaactaccaccctcattccaccaattaaataaagtgaaatgatgaataacagacaatttataagaaagtatctatagttttagatacaaagagatgacaaatgcaaaaagaacacccctatattttgctagaagaaaaaacatttagatacagattttttagaaagtagtacagctaattagcagtagagccatgttttacttactacatgctagacactaagaacttatgcttaatccttaaaacatcactaagacagttacacccattttacaaatcaagaaaagtaacaaagattccagtcacttttccaaggtcatataattagtaagtggtaaaagacaggcccagagctagggcgatctatttatagatggcttcatgttgactactctgctacacatgtaatgaagacaatttaaaatgtggaaaataataaatgctaattccagattttcaaaatacatcaaatatatacataggaaggacagtaatcacaagacaccattaggctactttaatataaaaagaccaagagcttggatgaagtcttttatacagaaagtgctaaggagcatagcaagatgagttttatattaggatataatataataggataagatatgacttattgttaggatgtttttgcaattaagatttgcttaaaaatagaaacatgcttcatgaggtcctgcaacagttcaggtaggaagcaacagctaaatacaagagatacttcaaatgactcttccataggtaacgtggactcccgggaaacgggcctaagaacccaatctctcagatgttataatgaagctgcaggtcctctttacattggccaactgttaatgatgatgtttcattatggtaatacaatggccagtcattaccctcacactttattaaaatgtacatgtgttgcagatacctcatcttcattagcaatgatagactccgaatattctactttccattttaaagaatcctactattgagataaagagaagaaaaacatttctcactttattccttttttatgctttttgattgctgaattatgtgaaagtgttacctagccaaaaatatttttaaagtcttctatgaatccagtattcataagcttatgtaactcttccttcactctcagactaaatgaacttgttatagatggaattgaataaagttaccatctacagtactcataagttttttcttttagtagttttcagttttagtaacttcttggagttatcactttaaaattgtgtttctaatcctcctatacttgtaaataaatttgtaaatatcagaatcatattgtttatgatatatgtaaagttttatttccccctaaaagtctatagactttaatctgccctcgtatggaagtttctctattactttaataataattttaataatgttataattacagaagcaccaaaaataaggcatgcatccatctctcattgtataacatcattattggtgtattagtttgtttgcatactgctgataaagacatacccaagactgggtagtttataaggaaaaagaggtttaatagacttacagttccacacggctggggaggcctcacaatcatggcagaaagcaaagaggagcaagtcacatcttacatgggtggtggcaggcaaagagggagaacttgtgtcagggaactcctctttataaaaccatcaggtctcatgagacatgcgcagaacagcacaagaaagacctgcccccatgattcaattacctctcactgtttccccaccaacaacatgtgggaattgtgggagctacaattcaaaatgagatttgggtggggacacagccaaaccatatcaggtaaatattaattgctccatcttaaacgtgagaaaactgggattcagagaggttaaataacttgccggatttcacacagctgataaattacagagccaaaatttggacccagatctgttttcacaacttgtactcttctcacactggcatgctatttagaaggttagcccttttctggttaggcttcctcctctactttacaaatcattaagtgctgcctcctgttggtctcccttggcgttacgctgtagccagcccttcaatacaatcagtgaaaacaatccttgttgggagtagatcatttcggagtattgattctaaatttgtcattgttttccgtgaaagctaagcatagagtataaattgccactcaccacataaagttgatgactttctatgcccaaatgatttgacaatttgtgatttttccccaggagtttttttgctaacatttttcaaggcaaaatattcaatccctgtccaaaatgatcaaattttgccctgcagcaaacttgtaaatttttgccaggacccgtgaaacttcacaaggcaagagatcaataatgtcacactgttcccttctcaccgctttcctcaatgtacacactatctagtttgaaactgccaacatgagaaagtaaaaaatttaagggacaagtaaggaactctctcctcatcttttaaaaatataggtgatatctttaaagtagagatgatctgtctgtgctcaaaaatttgaagtaagacaaaaatttagttttggatatttaaattaattttacaaaatagcaacatgcatgactctactcttgtattatcctgttgtgtatgttcacatacccaaaaatatttttggtgttctgcctattgtgtctgatgctgtcagcctttgttgcaaatcaggacttaggcaaagagcccagatgggctttgcactgctgtcatgccaaggcactaagacattttacttccacctgtaataatattaaggctttacttcttcaacattaatttgatgcatacctttcttttttcccccacattaaaaaacgtcaataagtgtgagccaatgtttcagtagatttcatcactctttctcttcaaactttgtctttctatccaggtctgtcttgtctgcctgaattgtaactgtgaatattttcccatgttcacctattgggctttcattcttcttgatatctaattcctccttcagataactcatccattttcatggcttcagctatgcctttacttgaatgatttccaaaattctatcgccaatcctttcccctcatctaagcaccagtcatttattttcaactcttcactggacatttctactttgatgatttgcccccttttcaaaataaacaagctgaattctccacccctcgatcgcctcccactcctgatttcgtttttgttttcaagaatagaaacctgtttccgaatatttatttggaaataaatattatccatacttgaaactttgggccaaggcacaagaatggcaatgcaaagacgtacaaaaaactggagttaacatacagaagtgcagtgagccaggctcagctgtatggacttggggccttggccctgttttactcagcgccacctaatggtcaccatttagaaaggcaggcctacttttgccagatgcaattttgcaaaggaaaatgtaaatgtcaattttatagtgaaatttatcaatatgtttaaacgttgtcactgttaaacaaaatgcagcactctggaagcaatatgaagtttatatatgagtatgtttattccaagagctgccaatttgtgaccactacgaaatcagctgagctaaaagacaattggaaaatatataaataaataaaaagtaactggcagctcctcttggttatgataatgatgctagagctaacacagataacccaaaagaatggagccgttccagtgcgtcacaagactttaggacacttacatagtgttctgaaaaataggctaaactaatttcatcagtgagataaccaacattgagctaaacccacaaacctgaaattaaacatcacacattgtaaatcagtgaagcaaaaatcaaacatccagaaactacaaaaagtaatcctgtctcttttaaaataagcctcaggttattcttctttccttaaaggtgctctgaggcatgaaaagtaaattttcagcctaagagtggtagatttcaatgaatatacaatatggttcccatgtctcaaattcttactttgttctgtttttttgaaagacaatgtacatttgggttttacataacatataagcctttggaaataaatattacagacttctaatgttagacttgtggaaattgagccaaagacatacaccagtcaaagacatatattgatgacataaagcaatctttgtgacaagatcgcttaagatttcaaaaagacatatgcagatgaaattaagcacatataaatttatccaatggttacttaaaaaataaaaataaaaattagattaactgccttcacacttgggatttttacttgtaaacccaatactaattgagaaaattaagaaactatggaaacttaactaattcaatattttttttcaatatactggcaagggtatttttataaacataaaggaaatgcaaaatataaatatactaaaacattaagatatataaacactcaaactatcattacaaaatctatgtgaaatataaatcaggcaattgacagtaaataatatgaaacttgtactttgtttgctttagaaatattattttattttccaatatctttacctcggtcaggtggccaaactgtctgattagaaatatcttagcataaagatgaaaaatgcattctatgaactactatagcataaaggcttttgaatttcttctgagttgccattgatctgcacgcattcatttctgaattagaaaacagctaatattttgtgaaaagaggatacatatttctttaaattgagaaactaaatttcatgttaatatagtatcagtttattgtacttcagattttagcacaagcatttcagaacactgaaaaactatatttagagtgagatctacatattccatacagatggaatcagtccatgaatatatattggtatcattcttgccagtcctaataaaactctgtctttagtgtgtttgaacaaggcttaagttatacatgaaaactgaaacatcaaaccattatataccatttaagtgtagataaaataattttacatccgtacaatatttttaaatgttgactttagcaaaaacttaaaaattctctgaaatttgaaatgaaaattcatgatgcacaaaattatgaaagaagaaaatgtctactccaaatatcccataacttttttgaacaaactctgttgtgatttaatctttttcatttacattttctgtctgtatttgagtttacaaagtgctttcaaatgcaatacaacatttaacctgcactatggccttttgtgaaaagtggtgttattgtacttttaatgatgagaagagtctcctggaggtgaatgaccaacttcatcatcacacaaccagaaataaatggtaggactgaagcttgaagctctggttctctgaatgccagccagagtgttatttctaacagaccacagtgtgctatgctggtttctgatcagatccgtttttcctctatccattttacacacataaaatacatgagaacaaggtaaatggaacaattctaagttttttagtttttctttgtaatttgactctcttgaaatcccagctttgtctaagcatagcataactcgaatatgaaatcatattcatgtttgtgtgcatctgcatgtgagtgtgctcacccatatgtatacatgtaatgaattcctatacaattaaatgcactgcttccttttattttcttcagaaaaattgccatggttctaagaagaaaatagagaaaaagagaatctcagtaactatacaggaatcaaaggatttagtaaaatggaaatgcatcggcaggaaatcataaatttgttatttttttaaaatacagtcatgtgccaataggattacattctaaggaatgcataattaggcaatttcttcattgtgtgaacatcatagagtggaattacacaaacatagatggtatagtctaccacatacctaggtgatatgatggaacctattgtttctaaaccacgaacttatacggcatgttacggcattgatcttatgggatcacccttagtatatggactgttgttggccaaaacattgttatgtggcacatggctatatatagccaggtgggtagagcccatctggactgtaaatacataattcttaggagtctaaagttctagaggtgaaatggtttgacctgagtttttgagagtggaatactcaattgaacaaatgtataattctgtttctgtttcttggcgtaaacttattccatatatattcatatagcttatttttgtctaatgctgatataaaatttgactaataacaaaataaattatattagtccttagaagggaagtctgcttttgactttaatgaaatgtgccccaaaacacattggaagagattagacttaatctaattatctgttctcgtactacttaggacaagcgctttcttcctttctcaaaatccatcttgtcttctgctcggtttcactgtaaacttgaaatcactttatgacatcagcctgtcaccctgaaaataacagatatcccagatgtgtcattgaaagttcacttccaaaacaaagaggaagatagaatgggctctcgggggcctctgatcttgtttaaagaaatgtctgagtcccagcgcggtacctcacgcctgtaatcccagcactttgggaggccgaggcaggtggattacctgaggtcaggagtttgaggccagcctgaccatcatggtgaaaccccaactctactaaaaatacaaaaattagctgggcatagtggtgcacacctgtaatagctactcgggagggtgaggcaggagaattgcttgcacccaggaggtggaggttgcagtaagctgagatcgcgccattgcactccagcctgggggacaatagcaagactctgtcccaaaaaaagaaaaagaaaaaaagaaatgtctgagacttctgctctgtgggtctctccaggggaggtgaatgcccagacatatctcacccctgcaggctatgcctttcaggtgaaggatgctgaatgttccattcagactgactttctgatcttccaaactttaagaggttgtatcggagtcatactttgaaaagttatctcctcaagttcctggtattccctgatggttcagaactcatacaccttggcacatgtagttatgaaagctctttgcatttgatgagaagcacgaagaagcaggaccagtgcaagcccatatgggaaaaagtgccatgtgattcaatagtatataaatcggcctcccatggtgacagaaggtgtcattcaaggccataggccacagggagagtgtcactcatatgtatgcacactcagttcagtcctgtgcacatcctacacttccgaatgcatactgaccattttccccttggagtcacgtacacaacatgcagaatggttatgtaggagaaatccatggcaacagcacatagcttgtagattgtatttggaaaaaaaaattaccttttctaaagttttaaattttaaaacatgtaattcttgagatttacttgattcaaacttgaaaaaaaatagtgttgcacaatttttttgagcactagcttatcttaaggctttctgaataacctaagggctattcagtcttccttttagaaacctccgagttatttttctgtgctgtgtacattttcatccacaagaaaaatattttcttctcattcccttagattcctcgggacactttttttttttttgtctgcagacaccttaaaggactgtttaagaccctatccactctatctattcttagcttcacctgaagggcaaaatccctaagatcttgacacacatactgataaatacatggaattattaaaggtgccatctcagcagaagaggattgctgctgcctttgttctcgggggaatacatatttcacccagtagcaagacacccaactgctgctacaatcagaaatctctgaaatgcctttaagctaatcatctttgaacataagcctttgttgttgaatcagggaccttctagatgcaaggcacagaaacctttttttattattttgttttttctccaccttgcacaaaacagcatcaagcctgtcaccaccgacagtaaggttcagtgatctgtcaacattcacccctgatgaagacagtgagagaaatccatagctctggagagttcaggagagaaccaaacagtgtgtttgcaaaagagcatttttatatgttttcttgtgacagcactagtttaacagaaaatagttggagtgtgccaaaaagggggaaaaatgaaagacagtagtagtaagttaggctagcatgacatgatggatctgggctatgacaaaccaaattggaacaaagcttccctggggaccaactataccaggtttgctgaattgtatttcttgatttcttactgtgcaacagtgcttttactgttagattgactaggcttcagaatatttttaaaattgtacaaatcaaaatccatgtagcttaaaaatgaaggatgtaaaaggtttaggagtttgatgtattgaaaggcattctgtattccctcatgtgagtattaagtatacactttgtctgttcgatgaatttcaaatctttgtggaaggcagtagacacgatagcagtttacagggtggaaaaccctggttggaaagcagggcacaggctggagagattcaaagcttcttcctgcttatcccacccagatgtgcccaggaattgcaatatgcagcatctgtagggtctcacttgttctgagatgtttatataaaggacaagtaaagaaaccttaaatctggtgccctcttaacaaaggtgtgatgcattattcttattacttgtcctttcaattcttacctagtggctttcacatagtctaaggtaaggccagaagaaaaataaccaaaaaaagaggaagaagaattatttcaaagctgctaaattttactggttttcatataccacgtgaaacctaacaactagacaatctgattctttacaatagtcattcataataaactttgaataaatatctaaatgaaaggactttcttaaatacccaggcaagtttaggtactcaagctgcaaaggcataaacaattgagtccctatctttaaggagtttacaagcaatttgaataattaatgaaactgtcagagtgtaatgtgataactaccaagcaacagccaagctcaaagcagatagcaaactatctagtgggcttgatcaacacagctccatgactttcccaatagctatttacgatcaggagaagggtagagtaaagggatgctgaaagtgaggtggttggggttcagtaaaatagaagatctaagtattgaggaaggagagctaaataagacattagttcagaacacattaaagtaggaaacacaggctaaagcgcttacggctggtaatgtaagggaataaagtggtggtgtttaagggttaaggaaaataggaaatgatggcaacaagcccaaactcgagtttgtcccatccaaaaaaagaaaaaaaaaaagggcagcggctattcaactatagcccattgatgcatgccagaatgtggagcaatattgccaaatcttctggtcttccaagagaaaccagaaatctggattttcatataacatatatttaaatttagaaaacttttttttaacattacacatgacgtggcattatgtgaacccaatcaaatgcacctgagaattgttttagcccatgcactttcaagttgcaaccgtttttttgacatactcagatagtgtgtaataatggatacacaatgtaggaggaggaacagggagcctgaactgtttggggtaatcatcagattcaaatactttttaacagtaaatggctggaatgggttaggctgaggatacaaaagagatttagaaatgagggaaacacagattactcacttctcaagtagagtatgatagccggcagcaggtaacgaggtagaaaagaacagagccagctaagtgtgggtatggtcaagaaataagagatttgtcagaaaggacttaaaagacagaagagaaggaagaagacagggtgttatgaagtggccagtgagatcatcagtgagaggatacacagtactgttctgtggcctgaaagtggcattgagctgatcacaacagaatgccctaagtatagatttttaagagaattattgagagcaacagactgtttcaaacagatttgactttgaaagtccaggtgatttaaccctggtttgataatttctatcagaaatacagcaaataaattggttaactgaattcaatgcacttgcaaaatgtactaaagacagtttgaatggtattcgattaagtattttggggggtacttggggatgacaatgaatatgatgatacattagacactacctgtcccaaggtgtttacaatctgtatggaaaagcagcagacatgtacatgcaaacacagtttctctccctccctccctccctcctcactcactcactcacagacacactcaggcacatacatttgtgtgtgttctaatgcttgctaagtgttatgccataaaagcaaagcatatatgattgttcaaaatcaaatgttatagttttttctctaattctaaagtacttcagtgtattaccaggtgggttctcttcagagaaccccaacagcaggccaggaggcagtgtgctggtagatgccaggcaatccagacaggatcccattatcttcctctcttgccacttttgttaaaacctggtaagactagcactcagcaaacgttcagtgagttacatgttttaatttgaatgggctgatttgaattcaaactgatgaggtttgaaccttgcccctctatatctacccattttatcattgcccaccttctcttcaccaaggctagagctgagactagcgctgaaaagaaaattcttggtaaagaattccggaatcttttaagagttgtacccagacactggagaaatttaatcaaaaactcagttacatagaaacagcatatttaaaatgtttagaataaaagtattttagaaactgggaagttttaagacacttttgaaaagccataactacctctaacgcgatggctatttcacagtggtgctattagacagctacagccaagtgccccaaattaatattaataacaatgagtataaataatagtgggcttttctgtatataagcacatcctattcttattttaaaatacagtagcttgagttttgcaatgactattaaatttcatcagccattttggggtgacagttagcttccagccaataacagaatattataaaaggagaaagttaagatcaatcttaaatgtaatagtttttatataagtgttgctgcttttttttagttaattatttacaaatgtattttctcaatatataatgcaggaagatgccaatattactcaattattttgatccatttataccttgaactaaggaaataattggtatgccacccctaatattcatttactgaaagatttgtatcctctttggtttggttttatttatgtgtaaatatgcatagttcaaaacttgttagtagcaacactaataatgtcatttatatacttcaccttgtccatttaaaatggattgttctatttatagagtaacagcctgtaaaattaaattaaatttttaatagaaaagacagtccttttaaaaattattataatagaaaggttgatttttttcataaatcacttccaaagtaatttttaagaaaatcttattttagttccaaaactttaaaatagtcttattgatttttaaaaataattattcatgtaaaataatttatggcagagttttctgtacttgaaaataattcttataataggaattttacaagaccatttattttagcagtgctaggaaacacaactataatttagaagctattgttgattgtttctagaaatatatatcgacctcattagttttaagtgataacattactaagccaaagttccaatccaacagtaccagaattactgattgtaatcagttttcttcgaacttttcctttagcacttagatttcacttagcttatcatacataaatataaatgtaaatttaaattatcttagaattctcattattaaacagtatagaattaatacccatggaagctccagtgtctaaagtcttttgttacagtccctttggtatgcatttggggtctggttgtattgataccaccctcttggacactttattattaatcaagaagacacccaatggtctcgagaatcttcaccacccaataagcattcactgagtcatttattcatcgagtaatgctctagaggagaggaagtcatcatcctcatcactagcaactgacatttattaggtcctcatacatgccaggtgtgtttctacactcttaacatgtgttaacatatttagtcctcacaacaaagtgttcctgaaaatgattttgtgaagtttgttagctggatttacaactgttaaatatttagacacatggtctgcacatctccatttatattcttgtcttgagacccactgattgttaaaggctatcccaaaacatatccatttcgcacagtttagagtgtgattttatttatttcggcagaggatagattaaactgactttggtgtcttaaaccacatcaatgtgtcaaagatgtcaggctttgttaatgatgcacaatttactaagcacctgatgaaaagcagagactaaaagtttcttaggtaagggtcttcaggctgggtgttctgggaggaaggaaacggaaagtaatattaatatatatgttttgcaactattaagtgtcaaaaggataatgtgatcatgggatattcatattcaaatccaagtttaggtatcatttgctgacaaatgtttaacacaaaaactcaaaggtaaaatctctacttttttgcctattcagtttgaaagttctatagttaaggcagagacaacagcaaaatcaaggataaatatttgaattactctaagtccatttgacaaaaataaagttctggaaatgtaactcaatggtaaattagtcttagtcaatttctttacttaaaactcttctggtatttgtcataatgataaatgatcatctcctctaagcccttcctttccccataactgaattcctactcaataagcaccttaaagattctaagacagtctctgttgttattcttacatactctggaacccacagcacttaaatttatgaatggtttgaaccaccaacctattatgcaagcgtaacctaatgttctttgaatataagcactaggtaaacaagaaaatattgccacatgcatttacttagtgcttctgacattttgacatttaatggattgataattaactttttcaagactggtagacttctctccaaacatactagttaggataatactagctgctgtaacaaagcccaaaatagataatggtttaaacaaaatagaattttattttgcactcatgtgaagttcagcatggacattgttgattggcaggctgctttcctgcagccattaaaccaggaaccctgactcttcccatgtgatggacccagtgtcttcaacatgtggcttctaagaccactgtttctctacatcaagccagtggaaaaggaatgaagaggaggagggtcctacttagactggaagtgacacacatcacttctgcttatttcttactaggaagtgtagcctttgggggacagccactttccagcatcatctgccaaaggcactccaaaatgcaaaaatgtcagtgattagtccaaagaagtgactggaggattcaggttctctaacatccagccaatggctcttgttactagatcactgttttccagccagtgggactctttctgcaaacaggtgacctctacttggagagaaaccagaagaaaatttaattgaattctaagctaatgagaagaaatgtaatcataacaaaataatagccagtgtttattgagcattcgatatgtcttgggcattcttctaagcactttatatatgttagtttggttaatactcagggtgatgctaaaggaaattatttttagtagccccattttacagttggggaaactgaggcatggggctgtgaatatatttcccaaagccatatggtaagcatccaatgaaatctggattcaaatctaggtagtctgattccatcagattattttatcttccatcaaagatagaaaaatgccatttgaaaacaaaggggaaaatggagagaaaaggtttcttcctgaaagaaactttctctaattaggcatggcttaagttacacagtttgtaattctgtacaactcactctcaccctgtagacttgaaagcccctgttcttttccctatgattacttaccttgtccaagtcatgtgggctcagaagagggaaaaacttaaaacatggtctctcatctcaaggaagttagattctgttgaggagaagagaccctaaaatggtaggaaagaacagtcaagattaaaggacaaataaaaggcagacaataggatttcagaaaaggctgtaatcaccacacataaattaccaagaaaggtttcatcaaggatgttcttctttagctggtccttaataaatgggtaggatttcatgaatagagaggtactgagaatgtcaggggagaaggaagctgagaacaaagtttcgggtagataaagacacggtgtttgtagcagccggtctgtaataacaagcaattttaggaattagtgagagttacatctttatccatttttactttagaacttatttttttgcatatatttttaattctatgtaaccatctggtaatgcctggcactctatgatttgttgcagtagtagtgtttatctaaggaactacgtatgtaggcacaggaaaatgaatactgagttctgggaacaaaggctggggagggatttccaaacaaatgtcaccttctactcatttcaacaagtgtaagagttaagaaatgtgcctcgctgtcaccacatttctgggcctctacggcttgttacagagaacctaaccaagacctcggtattctggctgtcctgtctaactacatttagagtaactgaccatccttacatacctatatcacttcccatccctgctctctcatgcagagaatatttcatccctccctcaaatcaagggatgagcccctggaggacagcgagtgagttctgaattctctgaggagccacctctgactacgactgtccctctctgtcaatcacagagcacttcgagtgacatcatggctgtttgcagtattatgctgttgctgtaggcagcatgaaattgacaaggaatggcacagagaagagctgaaagggcacttctgcttttgtgatgcatctgacacctgtagttacaagaaagaaaacagctttcataagcatattgctaggtgatgtagaaggtgaatgagaatttagaagtagtttttcaatgtaatagcacaatagaatctaaactgcttctgtgcacttgcaccctaagaatatcttcctaagtggaagccatccggtaaggtagtttctcagaaacctttgggtaaaaagttaggcttcagtgaaaacccaatctagatctcagaacgttttggtctatgagatgggggtcttaccagctctgattttaataaaatataccttttttagaaactcgatcttcacatttttttaaacttttactttaggtattagggtacatgtgaaggtttgctgcataggtaaacgtgtgtcatgggggtttgttgtacttactatttcatcgcctgtgtattaagcccagtacccaatagttattcttcctgatcttctcccctctcccctcaagtagatcccagtgtctgctgtttccttctttgtgttcgtaagttcttatcatttagctcccacttgtgagaaaatgcagtatttggatttctgttcctgagttagtttgctaaggataatagccaaatatacctttttttccttaggttatatgcttatttgtatttcttctacctgagaaatcatattatagattgtaaagctagtgtccaaagtgaagcagaaagaaaaaaggtaccccagtatcttcctgagggggagcctttcctatgactgaactaacaaattgacctaaatttgttattattactgtaatagtaagagcaactctgacaattaagccttagcaagagaggggatttaagcccaaataaagtcagttgttttgataactgaagtagttttaacactaagtggacaggttacaaaattgggaagcaattgattgtactatgctgagagatcacaagtttgcacaccatccataatgcattcaacttgagcaatgtactgagtctgcagtactctgtgtgtgaacatggttgactctgcaccttcctgtagcagcccacagtgcaaatgtcatcttgataactctctgctgggtggctccttagaccctgtcatcctgatcttttgcctgttgtctggtcatggtttcttccttgttctcctttaccccctttgtgtggaaaaacattttagtctttagcagcaaatcaaagccattttcaggtgacactggtgatcttctctcttacaggtatatccttctgtttcaggtttgttatgatgaatgtaaggagcacagtgaggaaagctattgccagtcttactcacaagcactataggaaaattaaaaggaaaagtcttcctgtaactatttgtatgtctctcaaaccatggaaactaagaagagctacaattattgaaataaagtgctatattccaggctaggccaaatattcagcagagagcctgaatatttcatgtatatgcagtcaggaaataatacagaaaaaagaaacccaccacaaaacagtataattgaggactattactaggccacatgttttgaacacagtatctcatttaatcttagtgacaaatgttctgtgtgatcttctacctttagctcggcccattcctctacattcctatgtcattttgtagacttatcattttaattgttaaattatactgccctgggttcatagatatcattctctccagtgggaacctcttactcatctttttattccctggcatctatttatctatcaattgccaaaacaaatagataactagagttgatttgttccctatcacttctcttcgggctctaaatcacatcaagttctcagatatctcatccacgtatgtattgctatagagatattagtacttcaatccacactatgaattcccatgtggaaaaaatggtaaaaaaggtaatgttaggattacacctcaaattgatgtaatccctagttagcatctcgtaatactgaaactctttattatcctcttagtacaccatggtattgacagcactttgttttaccttatcattataacatcatctgtaagaatttctacttgtatcattaaaagatgattatgacagcttcgctaagcctcattcatgtgaatggaaaattagtgccataaagaaaattcctaataattattttctaggacgtgttggtacttttcaaacttaaactcattaaatcgatttgaatctcatttgagcaaatccacacaaactgagtgtcttattaatgtcagtctcatactacttttaggaaaagatttaatcagaaaatatgttaataaaatccacatgcatggttttaatctcctcacatatatggcaatagtgtctatggatctcaatatttgggaagtgattatcacaataatttacatattataaattatcaaagtaaattgaatttaataattaaattatcaaagtaattcaaataataagagcagacactgtgctagttgttttacacttattatcttatttaacatgagaatttttgtccccactttacagatatcataattgtgaaggtcagagaaaagtgacttgctcagggtcacgtaatgcatgtgtagcaaaaagctttttgggacatacttctgatagactctaaaatccttatttttttaactttgctacaatgtcatattgattcatgtttccagcactgggtccttcctttcattgtttcttcaagagcaagagtatgtgtctgatataaaaagcaagtactgagttttcttaagttctagttcaaggtctaaaaaataatgaaggattaaactttttttattcaacttatccattatgaaacatacttgaacaaatacacactgcagtaattaaaatcagcatgcaaaatgctttatgtaagtctagagagacagagtcaaacctcaccactctgaaaatttgtttgggttctattttcccagtgagtcagattttcctttttaagcatcaagagatagtagccaacattttggatggaaatcctctaaatatttaccacactttctcataccttgtctgtatctaatttaatataatgctttattgatgacatctcattataaacatatattacattatgtaatgttacagagtggccctcaataatcgttgagatatgagagattattgaatcctacactgaattttccccttattatatgaagtttcaccttctagtcttacccttatctgccacttttttctacgctttgtgcttctttccatggtactctctctccttttcctgtttggctacaagttgagaaaactactttcttaaaattgtgtctaaaataaacactcacagtccttaatgaggatctaaagagttcttctgtaggcaaaatacaagtgttttccatgaatgtgtaagtcataagtggtgaaaatttaaattgttttaccatgaattaagacaggccaagtagtttgtttacctgggaaatattcatggaatattttggaaacaaccatgttggaaagggcatttgagtaatattaaagaggaagggttgtcatctttcaggcagatatcaaccaacaaagtcttcatttttctccctcctatatcaacaaaaatctataatacacttgtaaatgaggcagcaagatacttacctcatgtgattttgtttaataacatttgataaatgaaatatctgggattataaaaggaaaattgaaatgtgtatagacaaactataaaacctattcaaaggggcataaagtctgggaacgtcctacaggagtgtgattaacctgatacctatgtagaagggaccaggtctgttggtaccagtgtggcacatggaaatacatcattcaatttggtcaacagatttggcacattcaaagattaaaatgaagctgaacaggatgagacctcaggatcaggtgtggccttggtgaggaagaattaattgctaatactatatataatcataattttttcatatatgaaaacttagtaaactgtatatacttttacatatggtttcaagttatctctaagcatccatttggttgtccatataggatcctcagtgtatgagttggtgtatccctaactaatacaacagatgagccagaaatgtagaattgcttaactgaaacaaacattcagacctggaactctacattcctgtaagcactgggggttcttggttaggcagctctcccctatgcagtgattcagggaccctggtaccttgcattctgtggctatgcttcctcctgaggcctcatcctttctgtccaaagagagaacatagacaagacacacagctacttaccagtcttgtcccataaatagcacacatctcatccccttacattccaatgattagaacataaacatgtggttactccaaatgcaaggcaggctgggaaatggagtccaattgtgtacaagttagaaaagaggaatttggcactcttgggtgtgttacatattaaattactacaggacctgtctctcagagggaactaccaaaccaacaagtttggtagcaactgcaccattgtatggatggaataactatattaatgaataccttaatgtgtatgcaatgtctgactacacttttttttctataagtcaaaccctcagcatgaactctaagacaatgcccttagtttttttaccatcatctttgccctttcctggtgactgtattttggctaaatactaaataagtgaacatgacaagaggcaaatatgaatgagatgttcctgaagtgttatatctaatacccaaacaccaagaatatatatttgagttgaaacttaatatttgcattccttttcactatttacttgttaaatcttagattattaaaggagagctgttcaatgtctctacactaataatgttttgaagataataaacaaagcccatttgtttattacacttcaggaacatctcatcagtatttgcctcttgtcatattcacccatttagaatttagccaaaaaatattcagctttgtcaatttatcattttcttaaaggtgacaaaagcactaataaagaaggcaacagtcaatatgtgataaactttagctatgtgtataaaaattgtctccacaagtcactatgattacttgatagatggtcaagatacacatattgccaccattgtctctttaaaatatcttcatagagtttatgatgtaggatatttttaagcgtgaaactttcattatgaaatttgcttaatgctaatatagcaccatttctgggttgcaaagagtttaatatttcagtgaatgtgtggattaaatatgtatacaaaatttgtatataacacatctttccatatgtgtatatatgtgtataatacatctgtccatatgtatgtataatacatacatggacggatgtatctatatacatccgtctagatatatatgtatatacatatatatggagacaacatatatatggggacaacatatatatggagacacatatatatggagacagatgatagagacatagagatagaatcaatgctctttaaggattttaaacaatgaatatgatcccactaggttaatctaatcaagcaacaaccaaggtaattttataaaaaaagttaagaacttctctgtttctaaaataggacagtgttttgttttagactttgatatttgctataagcatgtccttgaatgagtttttaatttcgttaacctcaatttgttcacctgccaaatagacgtaacctcttttacataggcatgttgaaatgatcacgtaagatatgaatatcagatgtctatagattgcattcttggtgttccatatccatcaatttcttcctctttccttctgtgtgattctacatttaaaatatcaccccctccacaatcagtaccaccattcttgtccctataagactgttaaagaggacttttaattcaactgacagattttactttctccccaagttaattttttgtttaaactttcacataaaaaactatagcaaggtataaataatacttcttgctctgactaaaaataattctgacactttatatcctttttgaaaatttcagtccaatgtggtgtgaaattctgggctgaaaaatctgcatttctggtgaaaatacttatttaacttagtggcacagatatatggaaggtgcagaagtaattctattttatgaattttatgacaaaagttgtctaaaagcagaaggagatcaagcattctccagtttgtagatgactctaaattctcccaggtagtgaactatccacccccgcccattagaaagctaaactaatatattttatatgcatatctattcccttcatgtgaattcaggaggaatagtcctgcctcacaaaatgatccctttatcaaagagaaaagactcaattgaataaatcatgagcttgaccagaagtaaactcttgtaatctaaccctgattggtgaggataaacaaaagggcttatatctttgaagataaatataataattctgctcctctgtaaataagtataaaattacaaggtatatatgcacattcacaggctactagaatcactttctaatccctggcttgtccatttaactttttaaagcagattgggctgaaagtatgaattaaagacttaaatgtaagacctaaacccataaaaaccctagaagaaaacctaggcaataccattcaggatgtaggcatgggcaaagacttcatgactaaaacaccaaaaacaatggcaacaaaagccaaaattgacaaatgggatctaattaaactaaagagcttcagtagggcaaaggaaattatcatccaagtgaacaggcaacctagagaatgggagaaaaattttgctatgtatccatctgacaaaggattaatatccagaatctacaaggaacttaaatttacaagaaaaaaccaaccccatcaaaaagtgggcgaaggatatgaatggacacttctcaaaataagacatttatgtggccaaaaaatatatgaaactggccagccatatgtagaaagctgaaactggatcccttccttacaccttatataaaaattaattcaagatggattaaagacttaaatgttagacctaaaaccataaaaactctagaagaaaagctaggcaatacattcaggacataggcatgggcaaggacttcatgtctaaaacactaaaagcaatggcaacaaaagccaaaattgacaaatgagatctaattaaagagcttctgcacagcaaaagaaactaccatcagagtgaacaggaaacctacagaatgggagaaaatgtttgcaatctactcatctgacaaagggctaatatccagaatctacaaagaactcaaacaaatttacaagaaaaaaccccatcaaaaagtgggcaaaggatatgaacagacacttctcaaaagaagacatttatgcagccaacagacacatgaaaaaatgctcatcatcactggccatcagagaaatgcaaatcaacaccataatgagataccaactcacaccagttagaatggtgatcattaaaaagtcaggaaacaacaggtgctggagaggatgtggagaactagaaacacttttacactgttggtgggactgtaaactagttcaaccattgtgcaagacagtgtggcgattcctcaaggatctacaactagaaatagcatttgacccagccatctcattactggatatatacttaaaggattataaatcatgctgctataaagacacatgcacacgtatgtttattgtggcattattcacaatagaaaagacttggaaccaacccaaatgtccatcaatgatagactggattaagaaaatgtggcacatatacaccatggaatactatgcagccataaaaaaggatgagttcatgtcctctgtagggacatggatgaagctggaaaccatcattctcagcaaactattgcaaggacaaaaaaccaaacaccgcatattctcacacataggtgggaattgaacaatgagaacacagggacacaggaaggggaacatcacacaccagggcctgttgtggggtgggggaagaggggagggatagcattaggagatatacctaatgtaaatgatgagttaatgggtgcagcacaccaacatgccacatgtatacatatggaacaaacctgcatgttgtgcacatgtaccctacaacttaaagtatataataaaaaagtgaacttagagttttgcattcatctttagccatttgattgtaaatatatttattcacaagtgattaaaatgaatatcacttatttaaaaataaaaatacattaaatatatttaaaaagctcatcactggtcattagagaaatgcaaatgaaaaccacaatgagacaccatctcatgccagttagaatggtgatcattaaaaagtcaggaaatgacagatgctggagagggtatggagaaataggaatgcttttatactgttggtgggagtgtaaattagttcaaccattgtgggagacagtgtggcaattcctcaaggatttagaaccagaaataccattggacctagcaatcccattactaggtatatacccaaaggattataaatcattctactataaagacacatgcacacatatgtctattgtggcactgctcacgatagcaaagacttggaacccaacccaaatgccatcaatgatagactgcataaagaaaatgtggcatatatacaccattggaatactatgcagccttaggaaaggatgagttcatgtccttttcagggacatggatgaagctggaaaccatcattctcagcaaactaacacaggaagagaaaacaaaacactgcaagttctaataagtgggagttgaacaatgagaacacatggacacggggaggggaacatcacacactggggcctgtcagggggtcgggggctgggggagggatagcattaggagaaatacctaatgtagatgacgagttgatgggtgcagcaaaccaccatggcacgtgtgtagctatgtaacaaacctgcacgttctgcacatgtatcccagaacctataataataaaaaaagtatgaccggtcttaaagcaatactcatctagttttatgggtgcttcatcagacttgtaatataagttttgtttgaaccaaataaaattactaattttgtagtttaaaatggtcaaatattggctctctaaacctttacaaaacatagcacttccaaaataaaaattaaatataatagtggtaaaattataaaacccaaataatatagatatatcaaacttgagatacaatcaatcttcttattgcagcgtttaactgtcaatgaactctttggaaaaaataaatctctaaagtgaagcaagtagcatgtcggtgctttaggaaaactggttcttctatacaaatggaattttagcaactgttgtaaacaaattaagggtaatttaaaatatataaataaaatttagtgccaagagcatgccaatcaaataaaactagttaatactatattctttaagatattcgccaaataagtgcactgtgtatcttacaaacaaatcactttactataaaaatagtttgtgagaggtacttacgttgaatttttaacaaaggttgttttttaattttggaaaaaatatttttcaaacacctgttttcccactactttattaaaatcttttggaacaatctcagtaatattactgggcaaattgtgaatttcttatataaggatatggcacatctcttcaaatgaaaatactgcgtgacagaaaaatgccttaatatatttaccaaaaatgtgagaaagacatagaaagtcgttctgagacttatggacagagatcaaagaaaacagtggttactacagtgttcggatttgtagagatagggggagacgactgcctgcttagaggagagtaaacactgtagtgtgttcaaatcataagacttggaattggctaaatctgtgtttgaacattggctctgtcatttactagctaatgacaggcacatgtaacccacacatatcgattatatcttctgataaatagggctaataatcatatataataatagacctcaggtgcttatggagatcaaaatagatgatatatgcaaattgccttgcacagtgcctggcaaacaaacaaaaatattaatccttcttagaattacttaggagaggatctataaaacaagtataactagtctgaagaccattagggttgtccttggataagacagacctaagtcctctgaatccagacctccatttaattcacccacctcttcagtagcggaaggattttgttttcctcagtgggagcagcccttggatagtctttttcctctcactttttccatccctttcccccaaatcccaccaactttctgaccccttagaattagttttctattgctacatcacaaatcacaaacttgacagcttaaaacaacacacatttataattttacagtgtccatgggtcaggattctggacacagccttgctgggttctctgctcagggtctcacgaagttgctatgaagtcgtcagtggggctgtgatctcctctgaggctcagggtcctcgtccaaactcactggtgttgggagaattaagttacctgtggttgtagactgaggtcccaagtcccatacactttatgacatagctgattgttttcttcaaggccagcaggagaatattgcttctattttgagccctttttctggggaagggcttgatcatcttttaaagagtgctcttgatgagctcagccctcccagaagaagcagccttctgattaactcaaagtcaatggctttgggaccatggttacatcttcaaaatcccctcaccaaaccacaggagtgatatccctcatattcacaggtcctgtctgtagtgaaaagagaggattatattgggcatttatgccaaggggttataattttggataccatattagaattttgctttccacacctccaaactatttcaactaaataaagggcatttcatttggcaatatggataagttttaaatgctaaggctcaataaaggtagtaacatgatatcaacatgcaactgaggtatcatcagttaatacattctgatcattctgatcaaaaccttctgtcccatattacaaattgaataatgagggaaagaggttgatctggaggtaactggttaatattttcagtgtgaaaagagagagaaaagagaaactttgcccctcattcaaacgaaaaaaaatttcaaatacctactgtttggagtcttatccagtttaccttccaatgacttaggactgagagagctgaacattagggggtctcaatcaagcagctggtaaaataaattacataatttgaaatattttcttttttctacgatataattcttatgactccatctccaaaagaaaaaaagttccatttaaatgaggcatcactgcatttattcatggattcttatatttgttgaaaagccttagttttagtctttcatgaacaagaaactagatacagcacacagttttatacctttcttgatgaaaagaatataattcacaacctctttcctcaaacatttaagcaaaatttaagaagagataatatgcaaacttttaactgtgagcaattttttgaaaaatccttcagatggtaagctatgctgttaggtctttggtatagctgtgaggtagaggagaatggagagagaaacagaatgggaatgaaattaatcattacttaattgattcaataaaaatagaataccataaatagacttaaatcatatctaagtaaatttctgtcttagagtttcatctcatactctattaaacattttcaacttttcttatgcattaagagaaccataaggggaaataagcaagcactttgtagccagaaagaaccaccatgggattcttgaggtcgcactagctcactggataatattaggcaagtgactgaccctgtccaagattctattctttaaaatcaagggtaattgtacccagtttgcaggattgagttgataagaaacacacacacacacacacacacacacacactacacaatacactacacagtgcctagcacatgaaagagctatggtaactattgtaattatgagtctttatattgccaatggcatgtatagattgttttaagcaagaatatgatagaacaagcatccctggtaacctgtcatgaaatgctggggaatgtgataactgtaaaatcattgagtaagtcaacggagaagtgcacgttagttatttggtttaaagaccattataatgttattattacatgacacaagtaagactacctgggaaaacagaagctgattctacttaaatactttatttacactttcccatagcctaagaaaagatagtaaatcaggaaaaaagggcaaacagatatattaaacataagggctagtatttgtgctgctaatgaaatttgtatttggtattgaccttcctggcagccaaaaaaaaaaaaaaaaaaaaaggaagaaaataatatattttaagaaaagaaaagtttttatggagtttattctgataatattatctcatattgttctttgtgtgttagtgcattgctaaaggtattttcatttttgtagtctatcaaggactgttaatagaaaaattagagcgtaataaaagatgacacactgaaggagatttgttcagctaatgaggcctattcttgtggaatcaaccttttcccttcatgctatacctctatttttaaaatttagcaacaaagagcctagtcaaagcaatttggaactttggccaatacatcagaaaatacacacataataaaaatcaacattatacagataccatttgcagctgttggctctgctgagagcagaggttcccatgtacaaaagatttgcctaaaatctcagagtcaagaaaattcagttcaaatccatctacaccaaagtgagtgtaggctgatcactacacttacttggatagttatttaacaacctttaaatgaagaaatggtactatactgatgtcaatgcccacaacagggcctagtacatcggatacactccacaaatatgttttaagaatgaatactattcctctgtgatggtggaaccagtttggtggctaaggagggttagttgatacaaatacttgatatttatcaattagaaaaggggaggtggtaacaataaaatccctaggtatgtatcagggtttctcaacctaggcacgcttaatattttgtatcagataactctttgttgtgggggctgtcctgtgcattgtagaatattcagcagcatcactggcttctgccaactagatgttagtggaatctcaagttgtaacaaccaaaaatatctccaaacatttagaccccatttgagaaacacagacatatatgaacttgtgtgtgtgtgtgtgtgtgtgtgtgtgtatacacacatgatgatgatagataatagctttgttgcatattatttgcttttattgtactttgaatatgcgagatcaattattttcaattattaattttatgttctttcaaggcataatagataattaacacaattagcccaatggtcacttattttgaaaatagcatgaatatggtctaaaagaattgagcgttttccaaaatcacagctaatgtacttcattgcattgcttatggttcttgataaaatcacgcaaacataagcagtctgatgttatttttttgtttacagtattactgtgttgttttggttaacagaatgaaaaacagcactgtaatactacaagtaaaaatgttttattcttagtttgtttcatcaataaaagctgacatttttgcaagaaagatgttatactattgaaattaacttttagtcaattgtaaatgattgtattatatcggtatgttatcatgaagattagaaatcatttcctacagaatcatgtttttgcttcctcagcactgtttcaattgaaaggaatttgaatgaagtgcatctcattactaacataaagtagatggagcttgaataatttttatatttattttccatggatcgctattacatttcttatctatccaaattttataaaataaattgttttaatccattctttggagaggagcaatgaatttatttttgcaaaagctatgcatctgagtatattgtaatatgcataaagctctgttaacacagttatttatataaaaagtgtagctgccttaccttttatttaatttacatactttatttactttctgacaggttcttctctttgcatttttatttgcaaaccaaaaatgtcttttcagataagtcaactaaaactttgatgtactgtataatctaaaactctataaaatgttttatgtattgtataggtttatatgaatttttagactgaggatatagaattttggaactatttcattaatgattcctatatggtaacaccatacttcttaaatatgatgatagagaattgtcttttgtctgagatcatgtttaggaaaacctacagaacttaagcccagtctgtttcaaatagaaaaacatatctctggctatttttaagggttgttattttttctcaaaatatgaacttcacataatatgaacatcttaatccttagagaatttggtacatttactgtaaccttatacaaaagattcatatttttctactcaaatgttggaaacaataaaagttgcccttgtatgtttcataaactgtaacaggaatcacccaccagtaaagtaataagcacacggtgtatcaattcaaagacgtccagttttagaaatataaacttaatcctcttcccctcccttttttttttttgtatttagcttttgtaagcatggtttgtatttgcataacccaccattcatattcttgtgagttcatgatataaataatttgaaaaatttcattcagttccccaaattattctagtcattatggatgattcatgagaggattaatctcttggatgtgacataaaactagagaggaaagacactacctatcatatcatttgcagttaagaacatgctgcatatctttaagctttacttaaagtgcttatagtaattgggtgtgcatgccttagctccgttaaaacccaaacagcaatatgggagagtgtggtttgttttttaaatgtgcaaggaaggaaaattagtgaaatctgtttaagtcacaaaactgcctcattcaggacccaattcagcagcatggaaaaagtaactcaagttaactgtactcttagcatatgtctaagctcacaaatttcaattcacttcaaatttctttcttctcccatggatctgcctgcaaagaaaagagatacaaagatggcaaaccggttcaacagttcattagccctagattctcttagggttttcagaataaaaacgtgtccatttgcagaccaaattcctttatgtgttggaatggcaatgcgcctcaagaactgtttacgttgcattgtgggccttccttttttttccctcttcaccctctactcctgccactgccatacatgattacacacatgcatatggagttaagggtataatgtattttgattttatccatgcaagtaaaatttggtggaggaaacaaaactaagctaatgaacaaaagatttcagaattatacagagattgtggtttagtgacctaaattgcaccataatcctttaaaggattacagtatttggataggaaaaaagatttatctttctataatggcatctctgtataagaggatattattggatatgagctgcatggtagcagcagatatttttctccacgtctttcggcaattcagaatagttctctgatccatctgagaagtagcactgaagaattagtcctcatttataatcaaacattcttgaataacattttcttccaatttttgttttaaaggtctaacatttgatcgtatgttttctttagttaactttctatattatatggcaatctctgcagttatttttttcaaagataaaaagaaaaaaaaagcatgttcaaaaatgtagaagttatttttgcagtaacgtatgtcatgatttttaaacattcaggcctttaaactttttttatagtgtatgttcttgccaatcccagcacagttctacaaagtaaaatatttggcagtgaattcatattaacagatggaacaagaaattaacacgtttttgcttcgctaattcacagttcttttaatacgctaattctaaatcacctgttctgactttgacaggctacagacacctgtttggggtaatattccacagctaattattacatgagaaattcagtttccaacaaaagagtttctgtgtgaaattgccattgtagttaacaaattaatatcaactatatacaaatacatttctgatgtcttaatttaaatacagctaatatactactcatctataactaaagaatggtatataaaaactaagactgccctcttagtgtttgaattctgtctgtcacactttacaccatggttgcactgatcaagtcagaatgttcttcccagtagcagtaatttactgtaatactgtattttaaatggcaggaaaagagtatagaattttcaagtggctggaaaaattcctaactgtatgttaaaaatgactcaggagagttaaaaaagaaaaatactgacaagatgagagagaaaaaaagaaaaacttagcttgggtagcataatatggaagacagaacaataaataaacaggaagtccactgcactaccgagtttttgaagtatgacggacttacatgaagtcccatgaagactgttgatttgtttgctaagagaaaagcaagtaaacgatgccagatattttatggatagaaaattaaatacccgcttcttataactcaacagagttataacttaatagagaaactacttctattttccactaaaacctgattttctttatcttctatattgttcttagttattctgacatggtcatttcccctgtgtcacctcagacaacttcctttaacactaactcctttccctgcctccaatttcccccataaaaaccatgctacgggaaagtgtggaggcaaggagtgtgtgtatgggagggtaggttggtggaacaagaagcaaaaatcagaaacgtaaggtttttagatgtttgtaacataacgacagatgctgaggtagagtctatctttaggtttgccaaaggttccattttgtgtgtctgttttttgattctctctaattgctgttcagctttgtatgtggctttgctaatgtgtcttctgtagccacattgtcgtttctttaattaaccttgatatcctagtacccagatagcagagttcatcaagcaggcacttggaacttttaacattcatgctgttgtactttgatttttaagagttattgtacaaagtatatttttaaaatgcatttttattctgcgagacttaaggtggatgaggagagggctttttttttttcttgttttgttttttgtttttacatttagcctccagcctccttgtaattttattgtttttctcccaaatgctactctagaaagcacatggtctttctctcaaaccatgctttatgacattgctatttgcagaaatttaactggcagcccaccccaggaagataaaatcctgtttcatccaagtttggttccctcctacacccacacctgaaactatatttctgccagagcctacattctgctaaggaagaaaccaatcttttataatacttcaacatacgtgaattttattttatttttaattaaaaaattacatttctcatccaaaaatgctagatgacatttaaagctagaaaagtgtttccaaataactcacctttacaattaactcttatcaggaccagatagttatttcactgtaccagggcaagcacatggctgggatgaggctgggcagtgaaaggcctccatgatgattgtcactcgatctcttggcaacgtgcagaagcacattatcccacaggatttgctcagggctcaaagtttgtaagagagttactggtacataattggaatgagaccagttttattttcagttaataagatgctcaaagataaatgaaacttcctggttttcaagggagaaaaaaaaagactcttaggaagcttatacatctcttaagtttttcctgaaaacatttttagacatacatttgctacctctaaaacaacttgaatgaattagatctagatgataatggaaaatatttaaggtttaatactgaaaggataatgaccttgcaaaagtgtgtttggcaattatattcaatgtgaaattcttaagaaaattgctcaagataatgaatgacatcacaacgcaatttcactcatctgtcctcagttaaaacactttgacaaatcaattcattaataagtaaatctaatatccctgtactgtcctaccttaaatatactcattatatataatgcaagacaaaattatgtaattttgctatggactaatatatatgtacgtatctttatttttatgtatgtatgtgggtatccacacatacatacatatgaatacattttagggagcctatttaatccttcaaggaggtttgcagattacaatgagttcttgcagcaacaattatatttcacttaatacttttctaagcaagtagaattttaacatatcagcctttcataaaacagatttatgtaactagcagatgctattaattgataatcaccatttatagccttatacatattttaaaatagttccctatacatataacattacggtactatatttagggttttatttatagaatatattttagaaggaattaggtagctttcatttaaaaaatttaattttcttaatttatcctaggccaattctattaatttgtcatcttagaatcatgatattattataataacaatagcttactttgatatacatgtggctcccaagcacagctaaacataagaattgctgggataatttttgaaaaatacagataccagaatactaactgtattgccaaggagtgggacacagctgtctgtattttataaaaactccccaggtgctcctgtgcaggatgggagaaaatgctatcattgcatagtttctactagccagaaataacagttacagaataatactaataactattacaggaacaataccaccaataaggacaccactaaaatctactctctccaacattttttaacctaaaaaatgacaagtcgtgttatatattcctgaatcaccttaatcctttaagaaataaatatatattaaatatttatttaggcctggagcagtggctcgggcctgtaatcccagcactttgggaggcagaggcgggtggatcacctgaagtcaggagttcaagatcagcctggccaacacggtgaaactgcgtctgtactaaaaatacaaaaaattagctgggcgtggtggtgcgtgcctgtattcccagctgctcagagggctgaggcaggagaattgcttgaacctgggaggtggaggttccagctagccaagatggcaccattgcactccatcctgggagacaagagcgaaactctgtctcaaaaataaaaataaaaataaataaatatttatttgtaaggatcaaatattttttaattcaaattgttccagacggggcattatttaagaaaatcagactttcctcctagtttaggtaggaaatcaccaaccaaccaatcaatcatcatcaaaccttcctgcaaaaatgccattctcaaacaagcagtattgacaactgctgagatttgttagaaatgcagaatttcaggccaccctggacctactgaatcaaaatctgtattctgccaagattttcaggcagtttgaatgcacaataaaatttgagaagaactccccagcacttgtgtgtgcccacatccaagctaggtgctagagtacccagaagcaatataggtgtgcagagatttatctttgcctggcagaatctcgctatttgtaatatatacatatatattaaaatatatataacatatattaaaatatatgttatatattttaaaacatatattaaaatatatatgttatatatattttaatatatataacattatagactttggaggctttcatttgaatttgcatttgagtcaaagtcctaattctggctactgtctctgatccatcatgagattctctgatcaattctgtctccaaatatgtaatctcactataagtatcaaacaatctaatgcctcaaccttcaaaatgtagctagaatctcaccattatttccagcctagattacaataaatcacttcctaactcagtccctgcttctatattcactcctcttatagtatattttccaaaagtagtcaagctcagtgacttcaaaagactttaggcttattgttcccattcaaaattgaacttacgtagttatagtttatgtactttaggtgtctgctcaaatggtagtgcctcaaataaacttttcctgattattgcatttaaactaaacttcctgtctatccctctctctctctctccaactttaccctgcattttcctttagggtcctgtggtcctcatcactctttgtaagcaattgtgtcatattattaaatagttgactgcctgtcttcacttggaaatataagatccagaaaatagacactttgtctttcttgtcccccagtgcctataagagtaccagataaaaacaggaagcaaataaataatttatgagtgaatgtttaatcaaattagtgagctaggatattcagtgcatgtgtggttattcattgagtgtgaagtgtattcattgaacacctaatatatgtcactatggcagactaaaaaatggcacataaaatatatgcttttgagaaataaatacatgaataaacaataggcatatattgcacaaaataaattctttgggagttgaaggatgatttcagtggcatgaagtagaagaaagaagacttgttttgagaagtaggtgatatagtgatgacattatcacaagggcaaatagcaagctttagggctgaaatatctagagtattatgcgtgaaacagcatacctgtggaattgacagttcattagaaagacatctagtgactagcttttggtggctttacctccaaaactgaggaatttgtactgtattctgtagataatattttcgagaagatagttatgtgttcataaccgtggtttggggggattcatgtaaaggcaacatacaggatggactggattaagaggctgcaaagacagataactggttaggagattgctcatccgaagcggaaagaatagcctgggtgaaagtgtagtattaggaatttaaagtattaagtgaattaataacattaagtttcagaaaagcagatagcatattacttgcatagggtttttgttttgttttgttttttgctatcaacaccttcatcactattatggcacataaaactacccataaaattttatccttttttttttctttgatagagtctctgttacccaggctgaagtgcagcggtgtgatctcagctcaatgcaacctccgcctcccgggttcaagcaattctcttgccccagcctctcgagtagctgggactacaggcacgtggcaccacacctggctaatatttttgtattttttttttttagtagagacagggtttcaccatgttagccaggatggtctcgatctcctgaccttgtgatctgcccacctcgatctcccaaagagctgggtttataggtgtgagccaccatgcccgtcccataaaactttcacacagtcagaacgataagggtactaatataagctgtgtagataacaatccttccagtgattatggatattatcatttcctgttgatttaaggctcaaatgatttagcatagcagtcttggcaattatgaatctaaaaacgggagtttattatcttagaaaaagccatcacttcacttccagattaagggccttttttttttttttttttttttttttcgaacagtcaatacaagagacaagaatcttttcctatattcaaaagcaactttcgtttattgggtggtaaactgcttacaggcacaagtcttttaatcttcattgcttcctatttctgagcaacagttttcttaacccaacatgagaatattaaaatcgacctggtaggatcatgatgagggttaaatgacataatctaagttaagtctcagtctctatgcctgagtagaaagtcaataaatacatgttgccttctctttcccccagcacctagaaaagtatcttgacaacattaatgctcaataactgcttgccaaataaatgaatgttgttgagtttgcactaactaaataatgactttttaaaccattgaccaataagcattcaaatgatcaggttccgaaaactcccgcgcaaatatcttatagcaatgaacctcaactgcagtcctgaaattttttcttaatctcttctagcccacaaatttctcttcctatagatttgtgtagttacctacttttccccttaatattcattttagccatctgtctcctatctcctagaccacaatttgttgattacttgccaggatatatattttcaatgctcttagattgatagctccatttctttttctatcccttccactcccctcttgtgcatggcaaaagattttctttattggttcccgccttttttttttttttaatatggtgtctcactctgttgcccaggctggagtgcaatggtgcaatctcagttcactgcagcctcagcctcgcaggttcatgcaattctcccacctcagcctcccgagtagctgggattacaggcgcgcatcaccatgcctggctaattgtatttttgatagagatgaggtttcaccatgttagccaggctggtctcgaactcctgacctcaggtgattcacccgcttcggcctgccaaagtgctgggattacaggcatgagccaccgcacctggccaggtcccacttttatttaatgctgttaatttctattttaaataacataatatgttcccatattctgtgctccccaacccctgtattctctcttctatttattcttctttcctacttattttatgaaactcttttctgatctgcactataaaaatattttcatctctttgcccattttgtctgttgcccaaagtattatcttcctaattggattagaaaactcatctttatagggccttttatgtgttctgtgcacttatggttttctgtaaacaaaaataataaataacaggtggagagctaaatatataactcactaggaatggagcatttcaaagaagaggaaaaggctatgtcagaaacattctacatagagtacaccaagatcggtaaaaatgtaaatggtcttcaactgttacatttaatagactaagtcatgctgtttattaatcataaaaagtaaacatttctacttatctacattttttcagaaaggtattgtaataaatattattgtaagtgtgtgtgtctgtgttgtaccaccaaacatgaaacgtctcctctgtcctcatctctacccagttcttggtaggtagagagacagatggactcaatgaaagataattaaaactatggggaacttgctaatataaactacatgacctgattaggattctttagctgcatcaattctgtcttcccatattttaagtcctaccagacaaaggaggggccaggacagtggtgggctggagctggctgcagagctgattgtgcacatctcttctgaactccacattccatgacataatgtcagccctaaaatggccgcaatgggaatattcacagtagggaaattgataaatgccacaaatcaggacttccccaccccccccccccccagagatcctatgataaacatttatttgcacagcattcacccagggcccagaaatttggggcaaacatatgctgcaagtcacttgactataattgagagaaagcagtaagaagaccctagaatctaactgggctaagcaaagcgggacgctacaatctaactgggctaagcaaagggggaattcagggatgaatcaacaagatgctgctccgggagaaaagatcatagcaaagagttaaaaatgagactagacagggaagcttgggaaaattctcccagcaaaaatagggtaactgcatgttctttgtattggatagttgcgtcccctggtgggttagagagggaggttaatggattgggtttttaaagccctaaagtgaacaggatgaggttttaaataaaaagtgactttttaagattcatattgctgcagagctttgcgtgctctgcagcaatgtgactctatcaggtaacaacagatgtacctggtgagactagatttctgtacttaggtacagctgttcctagctgtaacaccaccttgcagccagcaccaggcttttgcccggggcctaacagcctccacttcctatggggggattcacagccacggcccttggatagtcatgggtacccctggatgcctggatgcctaccctggctctcagggcccactaccattttcctggtatcctgagcattttcacaggggaagagcacagtttcagaatgaagatcgtgtgaatgtggaaaagaggaaaaaggcctcagagaactagaacaagcacactcaagtgtatacaaaacatataaacacatggtaactgccccagtccaatgttaggtcatggaaagtataggaccttttatattgcaagtgacaaaagctcaactcaaacttgtggaagcataaaagggaataaactgacttaagtccctttgctctcctcttgtccactggttttatttataaacagttttgctctcatagtcggttcacacaaatgtgctcctccttagcactcaggcaatcagctaataggagagagtgcttacttctggtaacttccgggggaaagtcctaagagggctgttcactggccttgccgtggtcacctgcccttccctgaaccaataactatgagcagagaaataaaattttcttctggactgagatcctctgccagacatggagaagggcctgggccccataatctgagagtacttcctccaaggaaggagtgcaagttagctagagagagacatctattacaattctttagttttgtttttgagacaaggtcttgctctgtcacccactttggagtgtaatggcactgtcacagctctctgcaccctcaatcttctgggctcaagccacctcccacctcagcctcagaagtagctgggaccaccgggtacacaccctgctacatttttgtggagacaggtctctatgttgcccatgctggtcttgaagccttggcctcaagcaatcctcctgccttggccacaattatcttcctaatggagtcgtaggggacttgctgataacctccgtaagtagatacaagctctaataataatcactctatctagatgattacttcttttcttgctaattttcatctttcctggattctatgccttttaaaatttctctctcctgcacatacccagtgttctttatttctactgtttttggaacagttccaatgaggccgctcaaccactccctgccacgcccaactgcagatctgtatcagagttgagcactctcagtggctggactcctaagcagtttgtttctgtcaggctgactgatggcacttaggagatactatgttgatttgccaagaaaatccgtgatctaagtagaaggggctgctttcttagcataaataagctaatacatttactatttaaggtgttacttttattcataattaaaaagtttaatcagagagtgggctaccttctcggtaactctctagagcccaccgtaagtagcttgtgaaatgaatggcacagaaataatagaacaatgatagttaatctaaaatgccatgatggatttcctactaaatgtagaaatacaataatgtaataacaacaaaagggatattcttaataatagcaagtaaccacaaaattaaacattttcctttagttagaattttgaggcttaaataagttttgaagttttccattttaaactgttgcctgatgggaaaaaccaaaagtcagcattaccgtggatagaatgacctcaggatctagcctaattattgctgttactgaattgtttgtttacttcccgtctgagttgcatgatgcttcgatgtggtactggattagagaaggaggaggaattcatgagtgaaatgtttgtcctgataactgggagaatggctaaggtgaaggtttaatgttgtaagtaagcaacactattccatttgcaatgatatgaacttaattccttatcttttaatgtttgtacttttaattatcaaccaactggttgtctgtcttagactaatgaaaattaggtgactttggaaataaagtttggtgctgaatagttaaaagcttgtatccatctgtccctcccttgaccaaagcttccagtttgcctaggactctcttgggttgatgtatgtttttcagtgtactttttactttgtgcctccttgcataaattgtttttatttagaaaatgtagataagctacgtttatgttatgtgtgagagtgtttcacagattgagaaggaacacgtacaggtttgttacatgggtatattatgtaatgctgagatttgggcttctagtgaacccatcacacaaatagtgaacatgctttttgttttgaaacagtggattgctcaccaaaatcagtggaaatgggtaatgaatgaggtcataaaagtagctttcttcaggaatctttaggatctgatgaagctggatatgtgcattgcccaaagatggcttaagaagtctatgaatgtgggaattgacttggacttgatgatcacctttacttagcacacaaaactataaacacttcggacagggatgaaacgtctgaaagtgtgaggaaatttacttcaacattgaaaaatcagtcttacctcaaaaatgattcagtggcccattctgttttattatattttctaattaaaaagaaatctaggctgggtgtggtggttcacgcctgtaatcccagcactgtgggaggctgaggcgggtggatcatgaggtcaggagatccgagaccacggtgaaaccctgtctctactaaaaatacaaaaaaaatcagccgggcgttgtggcggacacctgtagtctcagctactcctactcgggaggctgaggccagagaatggtgtgaacccgggaagcggagcttgcagagtgagccgagatcgcaccactgcactccagcctgggtgacagagcaagactccgtctcaaaaaaaaaaaaaaaaaaaaaaaaaaaaacacctaaataggcagacaacgggccatgtatcagtgaatttcaaacattaggatttccttaaaatgctttataattagctttggaaaaactatctgaagagatgtaagcatgaagaagttgaggccatgtgctatcccatctcatggatctgggcttcaaatgtcaactctactacttactagttttagttcagtctatggtattttggtttaaaattgcattataaatgcacccacatacataggaacatacccacacacaaaactacaaggagaacaaagattcgtatgtaatcatttctttccttagttataacatccactaaggttaatattttttttacattttgtttttctaacattttcttcctgttccttagaattatagcatattctatgtggactggaaaaatagtcaatggttttcttttggtgtttgcgttcttaattcctgaggtgaattacatgctaaaaatgacttgtatgtctgtttggtgggctgccaccaacatagaaagtctgacatattttccgtggaagaaatacttattagtttgtaacctaatatttatttgcaccgtattttagtgaggaaatgaaggcagagtagaaatgaatttgttcaaatttaagcattcactagtactttcatttctgtacttgaacgtacagggttagctgggaaaaatctgtacattggttttcaagccataatcttacgttcagattttgtatgctggtccgttgtgtaaatatgaatttttaagcaatttagcatttcatcaaagtaacacggcacttgattttcattcatccatatgaaaacaattaggaaaaaatgccacttatcttaaatagtatttgtcagattttcttcatcaaacttggtaaatacagatctcttgacattttgatgaattttcatcactctgtggtaaacctaagtgactaggctgtggcccgtgaacagcttttgtttctatgcgacattaaaatgtattttttaaaaaacatgattataatgaatattcaaaattagattcattctctagcatgtgcacaataggtcacaagtcatggctggagaagaacacttactagtcaatctcaaggttttattatttcttatgaatcacaatttttttcagagatataactatcaaagaggaaagccagctaaacatacaccattttgagtttgcctagacaactctgaaaattcatttcatatgtagttaacttaaaagttactgtatttccctagctgtgtattgtcttgactcaaaatttcttggaccgtatgttcaagacagcttgaaacagacattataaatgaagaataatcagttaccatagttcagagcatttcttcaaatactcttcaatttctggttccagcaaaattttatttacttaaatataaatcctcttttttaatactctagagcctcctcctcaacaaaacacctcattttagtacaattgtttttatatcctgtcacaggatgatgatgataaatggaaaatgattaagtatattgtttgtcagatttcttctttcacaattcaataaatattcccagagtcctccctagtcaccttccttgcaatgattatcaaacggaaaatatttgaaattcaaggaggaaacctcgtttttattttggttgttctccttttccaaaaaaatacaaaacatgaattaaaacttttgggagcttacaaaccaagttaattacttagagacattaagtcctttatttggggaccttgagctgttgtatacttcagaaaaaatcactctaagcctctctttccatggaatgtacatttgtaatgaacagtgcttctatgttggttatactttcattatttaaatacttgatttccatctataatgcacttattcaatgaaagtttattacatctactatttattatatgccagaaataatcaccaggaagaatgatgacaagtaaaaaaggaaacaaaagtaaatcctttccctaaatattgcccacactgatcttcatggtccccgaaaattccacactattttgcactttgtggtggtaaattatagggtctcagttgaaaggctaattttattatttgctgtatttgtctatttctaaacttccttgtttcagattgatcctaaaattgcttacatgtttattatatcaaatacaataaggcaatagattagagatacttaaccaaacagaaaaacgtcactggggaacttatgctatgagtgacctacatttttatggtactttattattttcaaagcccttttctcatttaatatgttgttatatattctttccagtaatcctgtgagtaaacaacaacatttgatttactattatctgagcaacacttatgaagtagttgcttttactccttttgttctaagtgacaaaatggaagttcagagagttcaaataacttaccaaaagtcacactgctacttactgacagagctggaattcaaactcatgtctgcctggctctacacagcactattgagaaagaatgataaacggctttatcagctaaagtccttgttcattcactgagtcttttgtatcttttaggaaccagcctaaatctcttctttaatagtgacttctccaacaattaactcatttcaagtgaccaattttctgagttactgtacatgccactcattttgacatttaattacacactattttccaatattatttctgagtgtatgcattcctgacttttctaccctgtgatatttaaatgaaagcaacactccttcatgctacaaagtctcaataaactaggtattgatgggtcttatctcaaaataagagctatttatgacaagcccacagccaatatcatactgaatgggcaaaagctggaagcattccctttgaaaactggcacaagacaaggatgccctctctccaccactcctattcaacatagtgctggaagttctgggccagggtaatcaggcaagagaaagaaagaaaggaaattcaaataggaagaaaggaagtcagattgtctctgtttgcagatgacatgattgtatatttagaaaaccccatcatctcaaccaaaaatctccttaagctgataagcaacttgagcaaagtctcaggatacaaagtcagtgtgcaaagatcacaagcattctcatacaccaataatagagagctaaatcatgagtgaactcccattcacaattgctacaaagataataaaatacctagtaggaataccacttacaatggatatgaaggagctcttcaaggagaactataaaccactgtgaggacacaaacaaatggaaaaacattccatgctcatggataggaagaatcaatatcgtgaaaattgctgtacggcccaaagtaatttatggattcaatgctattcctatcaagctaccattgactttcatcacagaattagaaaaaactactttaaatttcatatggaaccaaaaaagagcctgtatagccaagacaatcctaagtaaaaagaataaagccggaggcatcacactacctgacttcaaactatactacaaggctacagttaacaaaacagcttggtactggtaccaaaacagatacatagaccaatggaacataacagaggaccccttccctacaccttatacaaaaattactcaagatggattaaagacttaacataagacctaaaaccataaaaaccctagaagaaaacctaggcaataccatgcaggacataggcatgggcaaagacttcatgactaaaacaccaaaagcaatggcaacaaaagccaaaattcacaaatgtgatctaattaaagagcttctgcatggcaaaagaaactatcgtcagagtgaagaggcaaactacagaatgggagacaagttttgcaatctatccatctgacaaagggctaatacccagaatctacaaagaacttaaacaaatttacaagacaaaaaaaaaaaatccaaaaagtgagcaaaggatgtgaacagacacttctcaaaagaagacatttatgtggccaaaaaacatatgaaaaactcataatcactggtcattagagaaatgcaaatcaaaaccacaatgagataccatctcacaccagttagaatagcagtcattaagtcaggaaacaacagatgctggagaggatgtggagaaaaaggaacacttttacactattggtgggagtgtaaactagttcaaccattgtggaagacagtgtgaagattcctcaaggatctagaaccagaaataccatttgacctagcaatcccattactgagtatatacccaattaattataaatcattctataaagacacatgcacatgtatgtttatcgcagcactgttcatgatagcaaagacttggaaccaacccaaatgtccattaatgatagactggataaagaaaatgtggcacatatacaccatggaatactatgccaccataaaaaaggagttcatgtcctctgcagggacatggatgaagctggaaaccatcattctcagcaaactaacacaggaagagaaaaaccaaacactgcatgttctcataagtgggacttgaacaatgagaacacatggacacagggaggggaacatcacacaccagagcctgtcagggggtaggggagtaggggagggatagcattaggagaaatacctaatgtatgtgacgagttgatgggtgcagcaaaccaccatggcacatgtgtagctatataacaaacctgcacattctgcacgtgtatcccagaacttaaagtataataaaaaaataggatgaataaaaactactacttcatagcacaaccagctgactatagtcaacaataatttattgtacattttaaaatcactaaaatagtataattggaatatttgtaacacaaagaaatgataaatgcttgaggtaaaggatactgtgtttaccctgatgtgattgttatgcattacatgcctgtatcaaaatatctcatgtatcccataaatatacacacctactgtggtacccacaaaaattaagttttttaaaaagtgacaaaatgaaagcaacttgtacatttatattctctaatgttctccttgatttctcaatgatacaaccttgccctcacaagtgttaaagcagtaactttactatgctcaagtaaggtgtggcaggtgaattctaacagtgcctccatgatctctgttccctggtcttatgtctgtgactaggttacattatacggcaaagatgatggatttggttacattttatggcaatggtgaatgaattttgaaaatgcagttaaggtcccaaagcagctgaatttactcaaaaaggagatgatcctgagtgggcctcatttcatcatgtaagttctttgaaagcgagtctagatgtgagagacaatcttctactggcctcaaatcagaaaacagccacattatgttctgagtatggagaggggtggcctctgggaggtgagggcctcagcctcaaaaccacaggaggtgaattctgccaagaagcatatgagcttgaaagaggaccccaaagcctcagaagatacagtaaccccatctgacaccttggttacaacctgtgagatctcaaagagaggacccagctcatctgtgcacagacttctaacccatggaaactgtgaaataagaaatactgtgttttgagctgttaaattggtggcaatttgttacacagccacagacaactagtacgtaaagttatatccaatgcactataaaacttgtcaatttatgtagaaattatatacacatacacatgtaatttatacatatttgcacatacacacccccctccgtagttcagcagtagcatcactaacttagagttttaattgcaaaactttcattgaagctgtggagccactctacaaaagttatgagagaacatatttttaagaaaattgcccccctgccctccaacccccatcactacaaaaaaaaaaaaaaattagccaagcatggtggcacacagctgtagtcccagctactcaggagcctgaagcaggagaatcgcttgagcccaggaggcagaggttgcagtgagcctagattgcaccactacactccagcagcctgggtgacagagcaaggctctgtctcaaaaaaaaaaaaaaaaaaaaaaaaaaaaaaaaaaaaaccaaaaacaaaaaactaaactaatgattaataatttcagggggaaaattggcattaacttcaatgtttagtgtttatttgtcaaaagcaagacagaagagtttaagtgaaaattggcctaagggatctgtaaaatataaataatatggtgtaatgttaatatttcaacattctgcctaaaaaattttgtagatataacttttaactatcctaacattttcccatcaaattttaatatacaaaacaaacttgcataatagaaacaaatttctcaagtggcactgtataagacaaatacataaaatacccatagtaatttgtgttaagtttataagatttcataagtagccatgtatgattcctaagtccctgtcactttacagatgaataaaatctatatttttcagtctcttgagaacattgtataaaggcaaagaaacctagtgaatcaggccttcagagttttgaagtagcacatacacaatattgctacatggtttatgcaatttcaacatattacccaaatggaattatgatttctaattcagtttgtccttaaggtttcatttctccatcagtgatatattggaaaactcctctaggcaataaatatacacaggatgagttgtaattttccatttctaaagtaatatgtttggtaactgtcaatgtccccagatcaatgtggatgtccatagggaaagtacttatttgcacattaaacataaataacctacattatatgcatgctctttagatttccttatgaaggatgttgaagtaaatattactgaaccattgtcgctttctctctaaagatcatttctttggtttgagttgtaagctgatggtcctcgttgggcccttcatttaatatggacctttgagttgatcataaatcatttatttcagcttcaaaaggacagaagtcatacctgcagcaagaggtggctaggaagatcagatgtgaatgaaggagtttcccaactatgagcccacacataaaccagagttgtcttttactttattataatacataacaaacatatatttttccccctgggaactacattttagcaatatatttttcattattttctattcttctggacattatacactgattgcctttaagatcccttttgtgaagctttccttgctccgatcgctcttcttcccatcccaactttttataaaaaaaagcatgccatctttaggtcaatagtgtaccatagacctatataactttatgctggtacttaactatacatatttgtttatttctgtctcctttactagactgtccacttttcagagcaggaacagtgtctggtacatgatttgttttgttaaaatccagcagagcacataatgagtaactatcattcaataaagtgattttgatgttatcctttgaaaagaaatctatgaatgcatgagtgaataatgaaaattttagcagtcagattttagcagcaaggattatatagacacatctgctttcatatatctctttccaaaagaaatattgttatgaaaacaacaaagtgctcttaagaggtacatgagaaaaaaattgaaacatgtagctactttagaaaggctaagattttcttctgaggtaaagagaaatggctggatattttagcagtagaggtagggttaatatcatttcttaagcctgacctcaggtttaacttgtgattctaatgttaatcattattacatcttataagacgtaagcttcacacctcataaatttagtcagcttgtttctactatccagagccatgttaaagaactgttttacaaagcatacatttctagagttctttctgtgccttttttcaaattgtttcttgtccttctagctaattttcatgtggtacctgccacaaaaccctagaaaataataatgcagatgtttgagtcataagtggtccatctctctttcggtcaacctattacgtaaataaaattgtacccttcctttcacctatttgtacaataattagatcatggtatcaattcaaacaaagaaattgatgtcctgggaactggttatacaaatacattatttcttctctttgaaatgagtagaaggaaagggaactaataataaaatatcacattattgcctacccactaaaggcagcctgaaattttacaaaacagtcttcctggggtcgtctcgatggtgagatataactgcctttcataatactagaagtacagacatcctcatatttttaaaaaatgcttaataagatcttcatctgttgtatttttcagttgagatcttttatgctttatattgtatctaataggcctattcacaaatgaagagtatatgagggaaaagatgaatatcacttcataacaagacattgaaataaactatcctaaattatgaaagcttcccaatgcatgtggcttttttcttcacggcttttctattcaaatatcaaagtgcttcaagtggctttgatgacatacttatgaattcatgaaagtgtttttcataatctgctcacctttggtgcttagaggttacgccgattgcttttatttgcttggctggaaaagaagagctctgagtgggatgcagatacataacacttcaaaacagttccttacattgtcttagctacttttcagaaacttgctggaactctctacccaaacttcaggcaatgataagaataagtgtcaaatattattagttctggagtataactactaatttttgtttcaactgcatagtacgtataaaaaccttggaatatttccagttatcttcactgtcatttagtccttaaaacccagaacagacatttaaaatgaaaaaaaaaaaaaaaagctaccattatattgaggctgcagatgcaagttggcatcgtcagaagatgaatgcttgtagccttcactggcaacctgaccagacatattctatataattaaataacgagcagtttaaaaaataaaattacaacatcttgggcaatcctttgtgaataatggagtaagcaggagagagagaaaaattccaaatgtgattagcagttgctcttcatgagaaattttctccacctctaatatgacttttctgaaaggctttaatgaatactttcctcagttagactgttgttttaaatatcactgtggactctttgcagtgttattaccatatgaagatgacacgtcggtgaactttatcaaatgccatgcagctcttggcatgccatgtctatgtaactcattcgagcccttcttgtccgagttgcagtactcttttgcataaatgttaaggttaccacaattccaaaaagaaacgaattttcagagacctgctttatgaagaaaacggcttttggagaaagcaggaaatactagtacatcaaacaaagtgaaagacaaagtagtttaacttgttggtttgtttgctgaaactcaaaagtaaatatactgtagctcaaagtgttccatttttatctgcctcctgcagtaatggctgtgttacttcggggcttctacttcaataattgatcagggtttgtatagcaccggctaagagcaaaaataagagtgttgctttgaacaaactgctgcaatgttatagcattaggcacagaaacaagattcgggaaatatagatatagaagaaacaggaaaaagatggatacattgggtggtaaacattgcttcaggctagaaagtaatgagaatttttccgtggagagttttgacctgctattcaaaaattgtttcttgtcttaataaaatcctaaaagtgtaatttacttgcaagagggaaagaacaaaggcaccaaaattcttttgataacaacacttgttaaggttgataagttgggtttcaaatgtgtgaagaaaaatgtgtgacaatttgttttaaggtgacaccctaagtgttcagatacttccatcttacactacttatcaagcaggatcctagttgaagcttccccttgtacatttgcagtatagaccatactgaaatggtaggaactgaattaatctagaaaatatagttatatttattagaaaaccaacaatcacagatctctctaatttttcttaagctggtaaaaataagagtacttttttttgtttggttctaatttgttttgcagtctaaataagaagcaccaatacttatagaaaataccttttttctcaacatggagtgttcaaaaagagaatagctatgatataccttatttttttctagacttaatcttacatgactcacaaaggtatccattgttagatgccaactgttgcacacacatatgtgtccatttttttctattttaaagttaaatttcatctaaatttcagattcatgccattaaaatactataacctgctgctgcggtgtgccaatggtgataagatgtaaagcatgattgcaaaactttaataatagtgtgggaggaaactgcagtgaaaaataatcaatgtgatttttttcctgttatgtagcatattccaaagaggttgtttattttatgcctaatcaccataaagaagaaaatcaagcactcaaatatttcatactaaagaataagcaaagaagcatctaaaatatttgttcatatttatatatgcccttcaaaataaaattggtaactaaatgtatcccaaataactgcttcaacagccaggcgtggtggctcatgcctgtgacccagcactatgggaggccaaggtggttggatcatctgaggtcgggagttcgagatcaaataattgcttcagatctcgactttgctatgcacatactactgtaagtaaaaggcaaacactgggatgagaatgtggtgaccaagactagctttttccatagtgagtttttataatgtcatcaaactcacgatcaaaggaatttgggaaatgttgagcataacaaagataaatagatgtcttgactggagaatttctcagggcatttaatatgttaaggacctggaattcagtgttcccaaacatatctgatcatggacacttttattgagaatcccaagggaccagtgagtcctggaacatactttgagaaatactgatcttgacctatagccagcaccaactctgattagctgtgcagtgagaaaatcactttcctccttcaactttctaaattaaaaatgtccttataattcccagtatatttcacaataatggaaaatcctcttaaattattatagtgatacaatactgttttaagtaaaaatgtgaaaaccgttttagatgctgagtcagagcggctgattagactaatcagctaaagggtgtctgtgggtagtagtcccccttcttgcatagttttgtttgggattctgcaaatttctgtatggcacacgctttggggaatttcataaggaggtgaaattataaatattaaatgtttaaatgccaaggaaatgttaaaacttattggaactcttctattcattcagtatatacttatgccaagcaataacccaggaaggaagggcatgaagctgaatctgtgtttagggatataactacctaggcagaaaagacagacaaaaaagcaagtctctcagtgttttaagctgtcagatgaaaccgtagagtcccataggtgcatgtggtaggagtctgagtaaattacccagactgggaaaagccaatgttcacatttgaggtggttcatgaaggacttgaagggattattcaggcagaggaaatgcactccaagaagacaggcacaggtgtggagaaaatcatggtatgtttcatgattccaatagaaagctccaggggagaggaaggaagctggaatagtaaatgaaaatgatgatagtttttatttattattattattttgtagtttattttttttgagacacggttctcaccatgtcacccaggctagactgcagtggtgtgatcaatgctcacggcagcctcgacctcccaggctcaagcgatcctcctgcctcagtatcccaagtagctgagactacaggagcacagcagcacaccgccacacctggctaatttttgtattttttgtagagacaagatttcgccatgttgcccagcctccagcttgtaaatgttatgccacaaacttggatgtttttccctgggcaatagaggaaaccactgaagggcatacctctataaggggagaggcagatgagtgatagagaaacagccagagatgaatactgaaatctgtgttttctgatgtgcttgaatgtataagaacatgaccagtttagaaatagtttggggagttgaaaaattatgtcaactagcaaaattgacggagggcagttcatcctcactatgacattgaaagacaaaataattattagatggttttattctaataactgattttcaaattatttttagccttggaatcctttgcccatggattctgcagtttaaaaaaaagtgcagtgataaagcaggcatggctgtgtttaattggtgatgatgtgggtatgaaaggccccagggaactaccctgtagttctctttccacttagctcccttctttcccaggcccaggtatgccctaggagaggaggcagagtatgaaaatcattcttaatagtgagaagtcatatatttagtcagacatgctaactggactattttgtgtttgaagaagactttctgctttctttttgaattattgtcacatttcagttttatttatttactctataatatttattgagagcatgctttgtgccaggccctaggctggagactgggaaaacagtggtgatcatggataagattcctatcaccaaggagtttacaggctgtaaggaagagggccctagataggtatgaagctgccaatgtgcagtgtttcaggaggtggaagggggtgggagagaaacctccaagacatgcaggtaatctggtcaaggaggacagagggagggagttttcggtgaggtggaaagggcagaaggtggagcttggataggtggggaggtaaggggttgaaagtgaactccagactgagtgaagagagtgtgcaaaagtgctgtgaagatggtccatttgaggacttcccaacttgctggtctagctggagagaaagagcagaagaaggtagcagaagataggaggctagggaggtgggaggaaggggccagattgcagttttgatggctgagttaaagatttcatatttatttgaagttcaatgggaagccatgaaatgactcaaggcagtgcagcatgatgttgtttttttggcatgtggtattgtttctataggctgtatatgacaaatatgtcaaattttgcattacgttctggattcagggattttgcctacctaggtttctgcattacattcaggaaagagctacttaaatggaaacatataaagtcattactctgaaggtctctctactgttaccaattttgatatgaaattagctgtacaataccttcttttcagggatttttaggaatttaacaccttctggagttctcttttaggttttcgtacttttgggatcacagtatttattttcagaataactccaggtcaactaaattcagcaatgactggcaaaatatcaaacataaaaaaaaagtggaaggtgtgctgcttattcgatagcaaaatcctaccaaaacactggaaggtagaatgccattggcctatgataattaaattgaaggggagaacacagcattaaattaattgctcagctggaaattatttagtaattctctgacttttaaatccccaaggttttcttcttgatatagtactgttagacatcttaaaatgtaaatttttgaaggcattactcctccctttcacttctagttctcaaatgtacctttaatgtgtctagtaacaataataaacacttactgagcccttaagatatggtgagcattaatctaactcttatatgttctatctcattttccccttacaattacttccatgaagtaggagtgctattattattctttgagagcctttagaagagataacttacttaggagtataccagtgagtaagtggctgagtagaggtttaacccaagaagtccaatcaagagcagagtgattaagtactgtagtaacctgccttgaaagtaaatagaaataaacatagagctgtatatttcatggtagctaacaaatttctaacatgtggacagaagaagaaaaagactagtaccttcaactcacgtggatcagattcaatggttctttgtattgtaaggaaaattattgtcaaggagcaaaactatttatctcagagactagaatttgttagtgcaagcctatgtgacattaaaatacaatgtgtgaaaggcatccacaatctctccaacaaatagaatcaggatcctctatttgattactcgatgggaagtaggagatgaaaagaaggcattgtacagctaatttagtatcaaattgttaaataataagagtagagagactgtcagaataatgactttatatatttccatttaagtagctttttcttgcaaactctttaaggtaaaatcaaccaaaccaaaacttcactgtaaggcatgacttttgacccagatgtctatcagggaaaagaaagatcacaaaacctgtgcaccaatgccctggagtcagactgcctggttcaaattcttcttcagttccttgataggttgcttaccctttacaagctattcaacctttctaaatttcaatttgtttataaaattagaactaatagtacctccctcactgtgttgataaaaattctgggttccaaaattcaagttctttccactatgtcattctagataatagaaaaccaagaaagaatgccataacaagcaataagtatgaggtaatgtgttctttgttggggatagctatccattttttttcataaatattgattgaatgcccattatatgtcagacttgattctaaaggatatgccccttaaatgtcatgccaacttctaatatttaattaaagagcaggaaagggcctgttgtttttgttgctgtggttgttgactgtagcggagtgttgggtagtgaaaaagatgactgaactaggatgtgtgaccttggtggcaggcacagacctcccaggttggagcctttgggcaagtctcttttctctactcctgagtactcaatttcttatctctaaaaggaaagactaggtaacacactgagccagatattattcacaaatagggtcagattcacaaacttttgatagtcagatacaggatacagcaatgaattataatgggatagcaaagatgaattataggaagagtgggtaatacttctcatcagaaacatcaagcaaacctacaaaaagagatgctgtgactatgaagacagattatgttatattccagacaatcttgggtgcctggaaaggagtctggaattactctattggcagcgaggccaccaaaagaagtcagttcctacctatttctcccatgtcatcaaatgtgaaacccagacctctgtccattttattaaaattatcctagattccatcttgcttctccacggtgcctatggttttgtctactgacaatctatgactaagattctcaagttatactttatgtgtgttcacataaaatagcacactatactttaaaatgtagccagctattcagcatcatcactgtaatttgtatttatagtattgaagctaatcctgtgtctcacttactatgtgaaactctctgaagaatattttgggtgttctcatacaactttgtagatggcccataaatcaataaggaccttctttcaacaaaccagtcattttattccttcttgatttctaaacgtctcagactcacataacccaacattagtgttctttctttctctttgaaaactacaatcagtatgtttaaaacatactgctcatatatacagaagcaatacgtatatgaaaaagacaaaaaaataggactatttcatttaagagagggacattttgtcgtttgggcagatacctgccagtctaggctttctatacttttattttacttattggaataacggtttaagctgcagaaccaaagagaaccaagacaggttggaaacttttcagggtgaaagtgaccagtaataaaccaggcaaagcaagaggaaagagactggaagaaaaaaaggcctgtgggtgctgttttatgggatagtgttgagaaattttgacggaatgaacaaggtaattttaacatgtgctccactgtgtaagatattgagacagagctggggaaagattttgaaggttttctctgtcttagtgatgtaattttcatttgctgtctattatagctgattttatcctaaatttttaatggcagattttttctctttttttttttaataaattttaaaagaaaacaattactttttatgggcaagcagtgtgcaagcacctttgttcaagctgttcataaaccacaaatctggcaacttctaaattggaaaactcagggtgtcattaagagcagagattgccggaatgctgattctcataacaaaggccaccaataggctcacttttctgaaagaaggcaactttggtggcaagatttgctcctctgttcatatgatgaaaccctagcactagtggaaaggttggtggcacacaatggaaaagtacgcttactgaaaaaatatttttctttttctgtttttctgacctttgacttggcaatgctaaattaaaaacggctaagtggaaaactatacttggaaaaaatagaagttgatctaataaatcagaatactgaaatgttcactatcatttggccaacgtaagacaggtagctttttgtttttaccgttttgggagtatttattcattcatttgacttagttttgtccattgatgatttgttctctaaaaacatgcagagaagtcccttcctctcttctctgtgaacacatagaagccagcgggtcctgcttttgtggtcctgtcacatcatccattagatatggcatttatctacctctccggcatcccttcttttggaatttcattgaggggatgaaccacatcccctttttctttcgtattcattatcttagaatagcccctgaaccatagcctactcatcaaatcactctttaagacactgtcatatttgaattgagatctttcacattatccactgctgttgtgaaaatattaggatttcactgatataacaactttataggtgaagctaacagattcctcagaagtttctggcaatgtgtgaggtttcctctaggacgaataacacctttaaatccactcccaatgcattttctgaagttaatttaaaataatatacaatctgtttgtcccagcttcagattccccatgtcctcttctttccttttcggttttggttatgcttagtctaaagtcacatgtgcatttgaaagcaacagaacaaggaattctacaccaaatttcatctcgccaaaccatttttttcccctactcatgtaagttcctaaaatttcttgcttactctgcattaatgctaaattacaacatatagaatgtctcccaatgatttccaaccaaagacatagtacatattggtttccctttctgcttatttaataaagttagtagacccacattgccctgatcagtcacagaactattattaaaattatgcaaaatgtagaatttcacaaaatactgattattcttaactctcagcaattctgctgcttaaatgtttcaaaatataacttgctttcagttagatgatataaaaagttatatagtttcaaacttaagaaatagttttaatcattaaaaatacatataaaccctattttgtatttagcttatccaatattcttcacaatgcccatgcattaatggtagaattggagacaactccatatttgttttcaaataccacaagacttattgtgagctaaatgtctattgagcagaattttacccattgtacataacgacatgatagaaaattatgatgatttggagattcataaaagttgaaagctatatcctaagcatcaacagatactatctgggcttttcatgggaatcatgggtattgctagtgttttctcaaaaagaaagaacactcataagggaagtttatatgtctagaaatgtaggacagaccagtctttagagggaaaaaatactcatctagcagtataatatttcataagaaaaagaagtgtctcgaataggaaagatgatttactttttgtgctattaataaagccttaataaagggatttttaatgtgaatatgccatgatcattctctcctgtatggcgatagagtaatttggctacttatagggtattcatccagacacatgattcttcagtgttattgtataagtaattgcattttaaaggctgtaagctttacacagggtcttatgtctagcactgaagttccaaaaggctaaaataaattataacatcccacctgttgctctgacaacctttaagtttgtgtagaattatttctttgttaagtctgtgtgtcagaaactatgctgggttctggatgaggcaaaattgtataacagcttcatagcatgagtcccatcatacatataagacccattgtgaatatatgatcactagataccttttcttaaaatctctctccttagtgagctgttccctaacaataatattgacaatattaatcacctcttccaataccacacactttccttccttgttttaatctttttttgtaagaacttaacactacctaaccgcatatatgtgtgtgtgtgtaaattagtattttttgttgtattattttgcaagttgagaataaaatttcatgagattagaaaattttatctatttttgttcagtgatatgttctcagttcctacaacctacaacaagcttcataagtatttagagagtgatgaagacagtataattagtagtagggtagatttttatgatgatgtgatagcacgaatgataaaccccgcactggttaaagtttttacaggaaaatcatatttaatctgagttttcatggataagtaggagctcaccatgtggacaagggagcatggagagaggctaattcaggaagagagaagagcatctacagagcatgaggacgcatgttgaaaaacggcagtcagttctgggatagagaataaaggcaacaggtgtcaagggaatttggcagggggtggggtggtcagaaagggtcagagaaaaaagttactgaaaggatcagaaaacaggtagagattggactaagaatgttttatatctttgttagaagtttaaatttcaggcttacagcaatgagaaatctttgaagggctttctgcagggcagtggaaagatcagatttgcccttgaaagatcactgtgttggcagtgtggggggatggatagaaactcgatatttgttgcgttaatgaatgatttctcaacgttactttagaccttacaatttggtgattcttcaagctttactataaatattgacagattgagaaaataaataactgagtgatggagcagctctagtgaggaagacaagattgcacccaatttttcagggcattaaaattggggagctttctctaagcctcttactatttctgcaactattcctaccattacactaatctaggttactcctattaataatctcttttctctgaaaatctttaactgtcttaaacagaagctttctactttaaaaacaaaaacaatttttgacttttgctgtctgccaaaattgatttgctacaaatcaggtttagctatgtacttcttattcattatggaaagtagttaatgcaaatttaaatatcagcactccccaccacagataaaaacaaacttacataaaaaacagattgccaggcaggctttgaggagtctctgatgtacacacattcagaacgattacttgttccaaattccctttcaataacacaccttttattctctcatctactccaatacgttgggaattagttttctcagatggttgtttgaaagtggttagcgtctttaaccctgagtagaaaagtagtataggcaatttggtattctttctttcaaagcctgatataactaatgcatttatcaagagcagaaattaagtatagattgtctctaaactgctatttgtatgtaaatatcaacaagttttttaagatgtaagaattggcttaattttaacaatgcttttgacctaagcctttagttatgtaattatttactcaagtaaaagtttaggtagcagtatagtagagtgtgtattaaggaagtactgagctaattttcttcaattaaataaaacctctctctggccagattatataaatcagctttggcaccatgtgaaaaaagaattcatttgtcattaatgaaatgatattttgtgaaaacttcggcataaattatttacaaatttatactaggttagtaaattctgaccattccgtggaaaagttgagaatattatgcagaccatggcttgaaaagaacactgtatcacatttattcattttgcacattttttactgggtgtcttatagatgtcaggcagagaggagtgaagaccagcaagatcccttctgtgacagcacttacacttcagtaaaaagaggagaaaggcaataaacaaataaacaagtaaactacaaggaatatcacatagtcaaaagggctttgctgaaaatataactaatgaggaaggctgcagggctgctctgcagggctcttaagcggtcggaaaatcattgctgagaacacaagacttgaagttgatctctgattttctcagaaggcctctcttacttcaacaaggtgtgattcaacaataacatcaacaaatcacaccagcagttcagaggttagggttgatcatttaccacattttttaactttatactgttagcattttaaagtcacccagcattattattagcaagtggatttattttcaatttcatttcctagtaatgtgatttaaaactatctcaaaaaatggaaattatggtttcagtagttaaaattattttatgggtttggagcatatgaaatcaaagagctacaattagcctaagccagtatcagttcaagcttcccccacatggttttactaatacccttcaaattctgacttctgccattccagccatatgtctctttaagcagatacactgtgtagtgccaaagtgtgtcaaggacatcactaggttaccaaaatcatttttatgtgcaacttcttgcaatattccaaagtactcttccacctgaaccccaccccaacccctaaaatataattttaataacacacattaaaatgtcatgctgataataaactcagagataaattacagggaatctgtctgtatttttttttaacgcttttggcactaacataatggtgtaagcacatggactcacacacattgcctaaattcagtttctttcatttttttgcaggctttgggtacagagtagtgcaaaaatttataattgttattcagtgcatacattttaagaaagagctagaatgctaggcatatgaatttgtgtttgcaaggtgtatactaagagaatagaattgtacatatatgtgatgtggctttttagtttctgattgcagttttatcaccatattatcttgtgttgctgctggggaaagcaacaaacagtggcttttgccatctcagtgaacggagatctctggaaattgcacctgttcattatatgagaaatccttctgtgggcagagaggagggattcagttttattctcaaactgttgcctaattcttataacttgtgcatatttttttgagtcatgattgtacaatctgctacccattttgggataaaaacactattgaaattgagcatactaactttaaccaagctgcattttttatgaatcaggttgtaaagttgactgccacgatacagtcatgtcctgtacaaatgagcacacacacacacacacactctctctctcacacacacactctctctctcacacacacactctctctcacacacactctctctcacacacacacactcacacacacacacacacacacacactcacaaacacaccagggagaggattacattgaacactcggaagctcattattcttccaaaataaagagttaattttttccctactggtctttccatctttgaaacaccatgagtcacggtgtttcccatttcacaaacaccacggattctttattgtctgtgaggcttccatgtactgcagtaattttgaattggatatgttatgtccaaattgacagtagtgattaagccaaaaataagtgcattttcctttaaatgttagctgcagcatcaagtaacattccctacattatgctatactgaaacaagtcagtcggcaccgaccaaaatgttgatggatatacagcagatcaaaaagaggagaatcattttgaagtgctcgctatctgtctgagacgataggcttctgaatttgtacctctttgcaaaaagagacttcacattattttgtcagtttgtttcaatttgagaggtgttgaaaattggtattcatttttttgatataacccttaaattgtacaatttaagaaaactgactgaaagagataaattaaatgggtagaaatattttcaaatcaaagaccaactgacacatataaaaatgatgtatgtttcttacatggtccacagggagaattctgcaggcttgctatgatctctacaatttgcttcagggcaaactagattctgggatattctattatccctttggtctgtttatcatggaaactgatgtacaaatcgagaggtctttttggtctctttctttctatatggttggaactggtaagaattcacttatctcatgtcctcaccttcggtaaagtgctacagaagagttcagtgaccagtaatcaattattattgagaagcaatcaattgctaatttccataattatgcacatctaaacactatgaacaagaaagagaaacaaagctgcactcccagcattgccttgttagcagtattttgttaacacaggctctaaaaaaagctgccgcagctggtaccacaaatgtgtttccagtattcaggccatcaacgtgattcgtcgctaaatgtatagaatcagcttcttgctaaaaactacaattacaggtgatatacagattgaaatcacagggctggtttgtcgaagaaaattgtcctaatgatgggttttcggatggggaatgcagctcttttctttctctgtgatgggttgtgaaggcagctgcacctgcctctatgctgtattctgccgcacttaatgatatctgatgatatcattaggcaaagtgttcataaacagatgttgagcctgtgcctaaatgctgtcagatgagcggttgctggcctgaaacagtattatttatatagaacatttacgtttgttatgttaataaccccactattagctctctggatgttgcgttaggaatgtaaatgtagttaatatgaataacaacctctttactctttgtgctgcagttgagtataacttttaggctttgggagagaaacaaagatacccccaccaagtccttttgacttcgtgatttttttttttttttttggcaccatttgaaattttgatcagaagataaatggtaagaatcctaagacagatgttaaatattagaatttgattttcctcacggttcataattttgagagattttgatatctgtaagttattttgtgtgagcccagtttgttaccctaataaatcagagtgatgatcatggacactcaattgacaaagtatccatttcaactagaatgtcctaaacatactgtcagatatggacccatttttgttccagctcttttgctgacatgatcatattttttccccagtaacctattggggcactaaggtcatatgtcacagtcatttttgtcatatttgtgttggtgatttaggcaataccttgatgtcatactcacaatgcctcaaaatgtcacatgacaattactgcgtgtgtgtttaagccaaagttgaattttatgcctcatagttaattcatgcagagtaagttatgtaaattctgacagtcatcaaatgtgcgctatttctctgaaataatgttctactctgatagccacactatttttttcgaaagtgcctttgtcattctttatgatattttaactctttcttaaatttccagtactgaaaaattgcacttgcctattttcaggattaaaaaaaaactgttattttcaattgttaatgaagaataaaaccaaacagtgttaaactggtgcttcattacaaccataattagaggttagagtgctttctgaagtgtcagcttcatctcaattaatgcttatgaagtcattcacgttgctaaaagtggtaaaggtgtccatgtatgttggtctgtaggtgtgagcagcaaactagaggtacacgtttacatgtgcgactattctcattccatcttacacctaaggatagtctgaattatttgtgattttaaataatcattataaaatttcaatggtgatagtttttcccatgcctccactacctgtcatttcaatactgatcttctagaaaatgctgaaaatgccagatcctttttatatggagatttacctccaatcttccaaataaggaaatgggaaaagtaaattaagtcagaaggtgttccattctctatgaatcgcctcctgattatgatgtttatgtggagtagatttttaaaaatctgtaactgttcgataagagaaatgtgggtactggaaggaatgaaataactcctaacatcctgaacaacacatacaaatataacatgtcaaaggactcttaagattatcaagttatttagaccctccaaagtttcttttattgacattgttggaagttgttcagaagaaacttgaagattgcatttttatttgttcatctagtcaacacttaggaaagctagccaataaaaatgttcattctgaacttggaaatttagatcgatttgagtgagaggataaaagggactgctgaaaacatcaactattgttgaaaaaagatcaattcatcaaagtctatttaacaggcatgggagcctaccactgtctccaagaagtcttcagttcctgtcttttcctcagtggcagtaattctgatcagttccttaggatgagtgcctatccatggcatatattaattcaccttcattcttaaagatggaaagtaatgcagtcatttagcttgtaattttctaaaataattcagtttcttatgttgaaattgagtgagggtcactttgcatgtgaagatatctctgctgaagccaattaatgcattctattttttgatatttgtatttacctacataactagactttcatgtaaatctcttaatgtataataaatatcttttgtattagtatgatgacattgttaacctatgtgcagggattgtagcttttcctgtgtttcacaacaaactccagagtccgagtgtaaagcaatgaataaatctgaaatctagcaatgtgaattttagcctcagctaagctaatttctatgtatggttgagcaagtgcattacctttctaggcctcaatttctctgctataatatatttatgctaccttactctcttgtttcttggaaggatatgcatatggatgataagatattaagatctgtagaagaagaatggtttgagtccaccatttcaatttaaacttagtggcagttagttgaaatataataggcctttttgacaacacattaaaataagcacttattataaaatatctccttgcaataatattatcgtagttttatttttattttcttaatttttgtttataccctaaaaatggagagagtatataaaaatatattttaccatcacaaaacagatttttggactatcttccctcagtgaaaactactttaagtcaatatctattcatgtttataattagtttaattttcagcatattttttaaaaagcatatctttgattcactgatactgcattttgtgcctcctgtatgtattctaactggaatgaccagggatttttatcatttgcctgagtttcaacatctgtaatagttaggagagttcatgtagaactctacactcatgaacataagaaaactgtttgcctttttaaaagtaaggctagtatcttcagaatggaccataactagtttcatatcaaagaaaagttggaaactgcctagaggatgctaatccattagttattttattttatcatttatttttccaatgtatgaaattatatattttgtgggctgggtgtggtggctcacgcatgtaatcccagcactttgggaggccgaggggggtggatcacgaggtcaggagatcgagaccatcctggctaacacagtgaaaccccgtctctattaaaaattaaaaaaaaaaaaaaaagaaagaaaaaattagccaggcgtggtggtgggcatctgtagtcccaactactcagaaggctgaggcaggagaatggcgtgaacccaggaggtggagtgtgcagtgagccgagatcgcgccactgcactccagtctcgatgacagagcgagactcagtctcaaaaaaaaaaaaaaaaaaaaaaaagaaattatatattttgtggtaagatggcctcaaggagcaaataggaaatattcagccaattgtctcggttctctttatgtatcttactggtctttattaaaatatctattatagtatgtaagtaaagccagtttcaaagtctggggcttatatagtacccagaaggtcatttaggtctttatgagagaaaactggagttgtaaagacaatagacatgctgtagctgtgaaggtcaaaagtttaagaatggatgccgtatgcacaaagtatgcttctgacaataactgcaaaaagttacgtgcattaatatgaactcttgattgttatttagcatgtataaggactactagtctattcttaccattttgtgttggtcttttagtctaaaacagccgtaagcaatcaactaatatattttaaaggttcatcatgattgatatatgtttttgataaggcacattcttctactgggtgctttaatatcatcagggaattgtccagcaaataactgaagacctcaaagctgattttcacctggaaaggaagagaagggggaaaaggggagggagagagtgagactactgaatttctggatataacactataatcaaattccaccttcattaagcaaaatgcttcaatggacaaagtatatttgccatgatgagcagaatttgccctaggtggtcagagtcaccagtttcttgggtccatttcttctacaaggaatggctttttaacctggcgggataggcgatgtctatggtagtggcccgaatttgggcatctgtaattatgttagcttgcaattaagctgacttgtggtgggaggattaatgtcagaagattccccatttttcaatcttgtgtctacatcagtaagatcgaactaattgctaattggcatttagaaaatgaactactctggtaccctggagctttgctgtgatatggcatggaattaggaatatgatatttctctctttgataaaagagaatggtatttactccaggaagtaacatagattctcattatacttttcttatctaaaatataaataaaaggatcagttcactatttatagaacatatttatttacaagatgtggatttcctagataccattatcttggactaaatcataagaaacagacatcattcatcaagaattaagacaaagcttcaccctgaataacctttattgtcctcaactttcgaacaacattacaattctttgtagtttgatttacattgtattgcagtattttaaatgtgcccctctgccccccattgcttttggcaaagaataccctaacatatttagtgatttttagttttttatgatatattttccggggaaatttatagtttggaaaacatttgtttaaagagctttctttatgtactactgccatctaaataaataaatattgttaagaagctactaccagaaaattatgttaagattcatttaatagacttttaaaaaatagatttgcctttctctaccttctagagtcattgaaataaaataatgatctttaaaatgtggttgccttcaaaacacctaaatatttggggtttcatttcaatcactctgattagcatttttttagactagtattttctaaaatgtggcccatactttccatgatgatctatggaaaaattatcaatggtcaaataagtttgagggaatttgcatgtgctataatattttctacctggagagccacaatacaaattaacatcaaggctgtgagaagtcctgaataaaaatatttctttgcttaactcagaatttaaaatatttctgtaactatggaatatccttttatctttggattaaatactgcagagctgatggtcaacccagctcacattgaccaacattttacaaattattttgcatgaaaggcataggcagattatttccacataaataaactgtcaccttaacaaattctaatttcttccacatcctttgcgaattgaatagctaaaatgttactgagttgtaaataaatctttcttaaaaagtgtacaatctttgaaagttccattgcatcatcattatcaaaaccattatttataattttactttaataagtacatgaaattttctgatttagggtttctcctactgttgaaatgacatataacattgaactagaataacactttataaacaatttaaagaaactttttttttcaggaaaagaatagatgtgtaatacattttaaaaaaaattagaaggcacataagcaagaaatgattgacaagctgggcctggtggcacatgtttgtagttccagctacaccggaggctgagtctgaggattgtagggcccaagagtttgaggctgcattgagctatgatcacaccacttcactccagcctggacaacaatgtgagatcctgtctctaaaaaaattaaataataaaagattgacattgaatgtaaggacaaccaagattagtccagccctttaagagaaacttcttgtgctataaagggttttggtgcttttttagcaaagtgggaaaatgcaactgtatacttatgtcttgctggttaatatcccactggtctctacactctttagttaggttaaatacatggtgtgaaggtggttttgcattgctaaagatctttttatttttaattttttttagaatctcaaaatttttactcattcagttagataaatgaacctgtgtccgaattacatgagacaggagatacacagaaataacgcctatcattcttcaacctgaaaccgacaaatgaaagcttcttctcattccagggttctaaaattgtgagatggttgcagcccgatttcataatttccatgtatttgttgattgactgggaaactaaggaaccataacttagaaactgttttagaatgtgccaagattatcctgcagtgtcttaggcatggatttttgtttataaatattttctcagaacatcaataattgtcttttcagttcaaacatattaaaaatgctacggtaacaaattatcattgaagtttgttgccccaaagttgtcatgatggagcaagattttaaggctctagaatgatgttgtctacagagcaattttacctgttcaggtattttttttttttcttcaaacaagaacctctcccttgcattggtggcctcagtaaaacagagatggccctctgaattccttcctgataaatggattccgaacaggaatgacaattatcccacattcatagtttagaatgagaaattcacatcatctccaagtctcttcacactttcagagggaactggtaagctctgaggttcagtatgagaggcagttttgaaactgcagctcctccctccaaggaaccgcgttcacctcagtcggaatgaataagtagaaatctgtgacacaatgatagtggtgacattcgtgcaaacaagtgtctcattgaaagcaaagaagcacattgcttggtaggatccctaagagccctaaaagtatggctgtctacgagcacactcatacacacagtagtatttcagtactgttggcttagctagcaaacaaaacatggttcaaatggtttaacagtcctagaaacggaaggcaccagtttaatgaggtctcctctgcttgaaattaaagtggaaggagttttacggagaacagtattcaataacaaaatattaaatgataaacacagattgcttaaaatcagacgggccattttaagaaaagcattttagctcatcatgatatgtagcaccttatttaaattaggaggtgttaattcgtagcttgaataatatattaatataatatgtaaagtgaatggcattgttaatcacagtcgcgcctggaacgactttgcttctgtgcactgaatgttaattttgcaaaacattaatttcaaagattttgcagcagtgcttttgtaattaaatattaatgtcacatgttattgcagtagcatgtttatgaaagccggcaacacttcaagtcaactcatttgtttttatatttattcttgtacatctgcaatcccttccatttcacaatttcaaagtgaaggccattttgaatagtcaatatgtgaacatttttcattgtaagcgttttttaacatccaacagggtaaatatttaatgttgtgtttttagctggtataatttttgagaaaattggctataacttttaacaactcaaaggtacctaaactgtctccagttttggcttaagtaatctgaaaataaactagcaataaatgtgatgaagctgtgtaaaaatatttaagaattagaaggctttatataaaagtttgaaattagaattgcaattccatacacaggatatatcagcagttaccaattctccatatatttttattatggcactgtattatctcaagaaaactgaaaagacagcctagactttcggttaacttttttcaagttccataactagacaaagaatagaaaaatgtttcttgtcggtgatgtgatttacacttattacatgttctgaagttatacatttgcatgaaaggaaaatcctttttatgttcaccatcttattccaagtatagacagtatacaggtcattatatttggtttgcccacgactattctgaccaaatcactacagctagtaatcttgtccatgatattaccaatcagttaattacagttagcctaacaattaagttatccccatttttgaaccttgacaagaaataacattcaaggaattatattttaaagctgttattttatccatctagtaaagttgtctttacaatcaaatccctagatacattttgtcttttgaaatatggaatgagttatccatagtaccaaaaaaatcaggaaaaatcaagatatattatgtttggttatgggcacatttaacagttaaaaattatatctgcacctgatgttgcatgttaacagctaatgccatttgacagtgatgaaattaaaggatgaagaagagatacaaactacattttacaagcatgatgggtctccaacaatgccatttaaatattatttgtcactatttaaaatgaacctttcccctttaagctatgccattacgctcatttgtcctgtcaccactgacaggctatatgactcacacacaaaaatggtcattaggtactgcatcttcatcttattaaaaaaaaaagagagagagagagaaagaaagaaagcattctgatgcctctaaaagcctgtaattattttcatccgaagagatagtgttgctcggaaggtaatttaataaccttttgcatgtacctggggaatgcctctccagggaaccaaggtgccgacatgccattcagtcgtcaaaacatgacctttaatggttgcttggagagaagttagcgtggaatgttgtacacactgcaatgctaattctgctttctaatatatgcaaaatttagttcttgagcaatgatctttgtaagatgaattaatataggtactgctccaggaaacaaaagaaattgcaacatgaaggcaccaccccccttcccccaccatgatcttttatacttcaaactgaagtagctaacaacttgcacaatttgtattaaaaatagtgcgaaacactccagaagtctttgcttcctttccccctttaagttggttgatgaattctattctatatactatggaaatgtaaaacaggattaaagggattttctttgataagtttatttcccaaaataaagcattggccccaactccctgaagaagaaaaagaaacgcttacctttaatataccctctctgttttataacacaatttatgtggctcgttgaaattactaatgcagttactgagttaattttaaaaaaatccttcatggattttcatgttgaaatatgatattttgaacacttgcatatacaaaaagatgcacaggctgtttcctgtgacaaccaggttcagaaactccttattttggtagtctgatattagatcccgccttagttagaaatgctaggatttcaactcctacccctgacacgccatccgtcaatttattagcacgctggtgcagtaagccactgaacaggctatatcaattcgtttagtttttttctttaaaatgtctgtaatcctcagctctgctttctcaaccggtcagcattaaagatttatgttgcactttttttcatcaccacacctgaatatggattacttaaatgggctgtaaataatttatatctgggaataagtttccattactgaccaatgttgtaatttaatatactgtattatgggttatacaattttagattgttttctgtgtgcattctgcagtcaggcagacaacagtttaagtaaaaagggtgagatgtttgttcagcttattttcatgttcactctgtgtgctcaaatcagcaacagggctaaaggaagcagaaagctactttcaactacatgtttttctgctatttatggaaatctttttttttttaggcacttgacctgaagcaaaatacaaaaacacataatagctattattgataaatacaaaaaaagaaaatgtgctaatgtaggtggctagaaatcttaattcttgagaactgaaaaatattcttgattcctgaacccaaaggttaactttcctctttaatgcttggttcttctgtgcagaaaaatgcacataataaaattataatttatttgacaggtttgaatgaggctactggatcaaatatgtaaaatgttaaagtacaagctatttttaaagcataggcaagtgtttactcttaaagctttaaacaatttaagattaagttgagtatagtaaaaattaataatagattaatacatgaaaatctatgaagacacataagataatgatttaaaaaggaataatttaaaaagatgaattaaaaagtcgaatcagaaaagaaggccagcataaactagggaaaaacatgctgtgaataaagtctgttagatcttgaaataggagaactgctaaataatgcatagttttatttttctatcatttgcataaaccttaagagagtatttatttgtgtaaaacttgatgtatcgagtaaggagaatgaaaaaaatggcattcattttgttttcattttggtatttaggaaaaatattctgttacatatggactacttagacctaatcatctgactgaatgtgatgtgtgccttgagccaggttggaaagggctggctgcagaacagtgccctggtcttgctgcaggcgatgcaggttggcccatgctctgctggggagcagatggtgagccaatgcttgtagtcacacttaccttccttgctaaatccataatccctcactggacacggagccaaggcaggctttggaggcagaaaggaggttacaatctggacttgggtagtgactgccagaactgagaaaacagctcagaaatttcaaatgcttaacaagttatctgtcttgtccctaagccagtgcagcatttttaaaagtaattaagacatgattgaaaatgtgtatgccatctaaatacaaaaatcttcaaaaatcaccaaaaccaatcattaaaagccacatttaatatgacattatgcaaaaatatatttaaaataaaatatatttttgtgattgaaagaaaatatgtaaagtaaaaaaaaaagaggaagcatttattttttaggaaaaggcacttattttctttacaaacctggaccttatagaaggaaaatatttcatacatgtctataaatatgctgcatggatgaaatattttccttctataaggaaatagatagctatgcaacatatctatactaacagattcttctatataagtttttctttcaaaatattaaatgattatagttgatttttctatataggatacttatgtatgtatatgtatgtttttatatgtgtgaatggagttcatcatcaacacagacattataaatcagaaagacaaaataaaaatattgagtgggtagccaaattctaatcatttataataaaagggatagtaagtaccatctgtttaatgtaaaaaaaaaaaccaactgataaaatgcatacatatctagtaaattaaaatcatggagtaattcatataaaacaaaatatgtataaaatgtcaacatattccattagggtgcgattgatttaaacatgtactatctacataatagtatgatatgagaaatagaaaaatcttttgattatgtttggtgctacaccacaattttttaaaatgtttttctattaagtggtaggaacaaaattccttagttttctccactgaatttttgagtcctcattatcttaggcaatacttttttcttgcaaatgattcttaggcatactttcattgaagttcattgactttgagggaatttcttataaccttccttactccatcttgcaacatctacatttctcaagctgacaaaatgctaccaataccctatttgtgtttatgaataacttgagctctccagtctaggactatcatcaacacctttcataatttccccctttttctattgcctctttttttgaaaaatattgtcactcttaggaaaatgttcttaatttcttctctttgtgactcttcttcagaattcatttcttgccagtgccttcatccctcaatatgtccttttctggttatactgttttcttccaaaatcgatgcaaagaaataaagaaaaatgtagaagcttctttctctgcctcacccaaaaattcaagaaatgtgccttgataggagatatgtgcaggtcagtatttataaaaggagatataagaacaaaaatgtttatcataatacatttgggaaatattatgcttagtttttattcacacaataatgtgcctgttggttttaacttttattttaatttagtttacattagaaaacggaacccttgactacaattatatttacagaaagtaatgttttcatgatttcggtaggaaaattttactatagggtgacatcataaagtagtttatcacttcattcccaaacctaaaatgaggaaatatgatatttacaaacacttttttcttttaaaaagggctaattacatagagtttcaaaaaggcctggaaagattgagttaatgtgatttttgttctcaggtgagaaaagaaagtgagaaaatttcaatggttattttgacaatgcaagtttcctataaaatcacatttcagaaggccagactggtggctcatgcctgtaatcccagaactttgggagaccatggtaggaggactgctagaggcctggagttaggaaccagcctgatcaaaatagacaccatctctacaaggaattaaaaaaaaaaaaaaaatagcacattatggtggtgctcggctgtagtcccaagctacttaggaggctgaggagggaggattgctttagcccaagagtttgaggttgcagtgagccgtgattgtgccactgcaatcgcgcctgggtggtggagaaagacctcatctcaaaaataaaaaagaactttgaaaatcacattgctcttaataaatatcaaaagattattctaggacattgtaggcatcaacaacttaaaagcaacaagtcaacacgatataaattttagcaaaaaaaaaaatgatctttaatattagatatatttcctctgtccaagagttttaagcaaagacattggacttgaaaacaggaaacctgagtttgcattccagttctgcctctgaccaactaagaaatataagaagtatttatatctctggaccttagtttcctcacctgtataattacagcatttttctaatgatttctagcattttgattgcttacaaaacagtctgtgactatgtgaaggtggaagagttaagtactaataaatagcacaatacaggtgatatctccaagcaacacatgcttaattatcaaataagagattcaggcaattcttgaaactagttaacaaagtaaacatttatatgggttcttaatgttttatgttctaaatttctcattgcataatttttgatacataaattggaacacattttggccaatttagttgacattaacaatgggaaatgtctctatgtagatctctgaacaaaattttgtaacaccgtccatgtctcagaacattaccaccagaaatgccattggcacgttccacgcatgagttccacatttttagggaatctaaggttccagaattgcagagagagaagctatatctatagacactagggagaaagtgagtagcagaagtgatctacacaagcaaaaaaaaattttttttaaatgtactcaagattgaattagaaatccaatttatcaaaatccttggagatggcttctgatctccagttgaatcttcagccctttgatatgtcacctattagccacccaagaggcacgtgccaattctcatgtagtatataaagtctccaaataattattatcttaactatcaacattattacaaacattattaattaagagagacctctgtatttccgtaaaagggaagagcactcttatggaaaaggacgtattaaagaattggaattgtcagaagttgcatctcttggatgaagcataaagcagagatcttgatgttaatggtcacagaagattctgtgttgccatctgtcaggaattatttaccagtttttgctgaccaaattccaaattaaggagctccatttattggctcaaacctaccctctgtcttaattaaaaatagtgtccatctttactatttatgacctattatgagacacatggactttgggatttaaaaaaaaaaattctgcttcctcttctttagttcaggttctcatcatctattaattgaatttctaccataggttcataaacaatattcacatcagacttcttgacccactctaagccattctcctggggctggctgccagagagattattccaaaatgcaaacagtttttctagttgttcactgttaataatttctctatgaatcccaatagcctttaggaaaaacagttcaaactctttactataactttcaaagttctccgtgatctggctactgcttatctctctagtgttatatcctatgctgaatcgaagttctatccatcctggaagcctacctacaagttaccaaagtttaagttggttttccagatttcttttttaaccaggaatgctgttctacctagccacatttcctcatttttcctccaaaaggccattcctaatcgctttccccaacccccaagtctggttggatgtatcctttttacgtgctcctataataccctgaattatcacaattatacatcagcgtaaaattgtctgtttccctgtgtctcccattagaatacgaacttcaggttcaggggccaggttatattacttttcatatttccaaggcctaggctattctgtggcaaaaagcagtatttggcacagttgtgctctgtcctaaaataccttcttctctgggcttctttggcatcagccagtcaaggaatgtttcttctgcctctttgggaattctgcgtcctcctcttcacctcttatttgtggagattcccagggattgatcttcaacccctttatttccttaatatctgcaatagtctagatgattttattcgggatgaaaatctctacagttagtcttgaccatagatcttcagacctatacatccaactgtttctttgatgtctttatttggatgtttaatatgcatcttaaactaacaagactaaacaagaatacttattttccttcccactcaaaatctgtttctctcttgttatttcctaccataataaatgaactactctaactacttggttgtacaaggtaaaaatctaggattcattcgtgactcctatctgaacacaccccagtctaaataatcactgtgacctctcagccctgtgttaaagccacctgaacacatctgcttttttctgtctccattaagcaatcatggtccatgtcaccattatcattctctggactactatagtaagcttccagttggtcaccatacttatgttctaactctcctatcctacctttttcaagagttgccagaatgatcttttaaatgtgtaaatgaagtcaagccattttcctattcaaaactttataataattttcattctatttagaaaaaaatctgccatctaatcctggtttaatattctctgcatcattcaacctcctccaacattctagctccatctcatcccattcccttcttttcactttgctgtggccacactggtcttcattcatttttttggaacatgttaactcagttttgtcctaaaggttttgtccctactgtttcttctgtctagaaaactcttgcccaggtggggtggcttatgcctctaatcccagcacttttggaggccaaggaggaggatcacttgaggccaggagtatgagaccagccttgctaacatggtgaaaccctgtctctactaaaaatacaaaaaattaattgggcttggagttgcttgaacccgggaggtggagtttacagtgagccgagattgagccactgcactctggcctggataacagagcaagactctgtcttcagaaaagaaaaaaagaatgaaaaatagaacactcttgctactgttctttatatagttttcttctttctgtcattcaaattttacctgcttgccaaggctttccttaagggctatttcaaaaagtagccacttagtcatttgctgtcacaatattctatataccacctatcattatcacatatttctctgcatatcacctatcattttaatactctgcacaacacctatcatcacctctatatgtttgtcaatcaattttgatttatcgtctccaaactcaccaaaatactaacttcatcagatcatgggacttgcctgtcttcttcactgcagtattcccaacacctagaactgggttccaaacaatagaaactcaaaaataattgtcagataaaggaaatagcaattgcatgggaaatcaagtttgaacagtgaaacttatttgaggattactactaatagatggagagtggaagaagttacatgtcttcttctcaaattttaaaatgtttagtaagatcaacgagcaagattaaaaagttcctttaacaaagacaccaatttctagagtagagaaagaccttataaagtatttgatgttgtcttaagaggtaccggggaagccaaatctctttcaactatttttccccatcgcaataagccaaaaatcagagaggaaacagtagcaaaaaaacaaacaacaacaacaaaaaaaaaaaaaaaacattcaatcatccattacataaactaacagatatcatctgaataatattgtaggcacagattcaccttactcttgtgctattatataacagaaatttaattttttccttccttggagttttacttggaaattattttgttctctcacagaagtagtttaggattcatttaggagtgggagtgagaagtgggagggacagcatttcattatttaagaaatatttattaaacactttctaaggagcttacaatctaataaaaatataaaacctgagcatgatacttataatatgtgctagacaattacaagtatgatattataagtaccaagtaaatgctgggaaactttagaagagagaaaaattatgccccaatgaagaatcagtagggttcatgtattggaaaaatcaagaaagcttggttttgaagtacgcacagaattttaccatgttgcagataggggaagaaagatatttcaaggaaaaaggactctcacagagtacatgtactaatttaagtagttccaggccaggcacggtggctcaggcctgtaattcccagcactttgggaggccaaggcaggcggatcacttgaggccaggatttccagaaaaccctgtctcttaaaaatacaacaattatccaggcatggtagcaggtgcctgtaatcccagctacgcagaaggctgaggcacgagaattgcttgaaaccaggaggcggaggttgcagtgagcaaagactgggccgctgcactccagccttggcaacagagcgagactctgtgtgggaaataaaataaataaataaataaataaatagtttcattctaacaagacacaggaaaggaaggtggaacagtagtcttagttcttataatatagaggatgtagtacacccgaataaggaaaagaaatgttctaaagttctctgtagcatgtaaaacaactgaccacccaatttgtgttaaaaccttatgaccctatctcctatactttgtcttatcttgtgcctttttctgttttcatctttggcttctcttctccagtcctaaggagtaaaataaataagaagctaacctgagccatctattaggacaggatattcagcaaatgctttggcacaagactctgttgctttaggtcttagggaaatctggcaatcatcctttcagatcaaaatctctagattcctgattcagtttcctgctgctaactttctggtggatagtttgtgtgacaatgctgatccctctatttgcacattgccgtaattgtcaggcatatcagacatactttgccttttaagcactcgaaaatgtgcaccatgatctagcaccaaccatcacctccactttgaaatctcactcggatcttctatgtatacaccacacaaatcaccagcaagaaattacagagcctggattataaacatagaacttcccgaaattgaatcttgccttctcacttaggtcatacaggaccttagacaagttttttaacatcgctaattctaaatcgatttatatgtaaaatagcaataatcatacccacctttgaaagaaccaactctgtgaagttacaaccacaactatttttgcttcaatgcacaaatattccgaagatcaatgacagaaggtgtgtaaaacaccaggtacatactaagaacttaatagagattagcacctccttgttttgggtttttcgattcttctagaaagcttacttcacatttccagctgtctaatttttactcttatttttatattcagctcctatatattctaaaatattttttgaatgaccaattgaaaagaagttttattaccactaatttctccattttccaaattccctaagcattttatcagaaactctttaatcgtagttttccttctctgccttggttatggtagcacagatagatagtctctctcttattatgtgttgaggtccaattttaattttgtatcctcacagcattaaatatgctattttttcaagtaacagatcctgtatctacacatgctgaatcactttttttggatgattctttctgatgttaaaccgttgtcaaataatgtagattgtggaaaatctgtaaaattatatctagtaatttacctaataaggtctatactttgctatggacagctagatattacactaataatacatgaattttcttagtttctagttaacaaatttatatcaaactgcctaaaatctattcaagatcaccaattcaaaagaataataatttgcacatttgataaaaattccatgaggaaaacaaataatattttgctcctaggtcaaagttatagtgttgataataaacaaaatactaaaaattgtgcattttggtatcgactttttgtgaattttctttagggaatttgattaatgccttctagactaattctataaaaatctatatgtttcagtttattatttgaagatttatttaatagggttaaagaaatgattcaagtaaacttagaagcaaaataaaatcacacacaaaaatctattggctctttaattcttaaaatccaacttagaaaaaacaatctttaaaaaatttcagttggaaaaatcgtagttatgtaattattcattcctcctgaaatttaaaataaaatacataaagggtggtctgggtatttctctgtctgtggcaacatcttttaacttgactctgctatcttagtgtttacttgatttatcttaaagatatttttcaaagtgtcctgtatcataattggcaggtccatgacacttgcaattggctctaaaaatgtttatagtagccaagatgcagtagtagcattgtttaattttacttttgttttaaatagaatgaaacatgtaaaagaaaacttcttcaattgattagacattacataacaatcttaatttccttcaacagttttttcctattctttgggtaatgtatgtctgtgtttgcttcatcaacctctccactatttgtggacaatgaagatcccccaaaattaattttatcatcacctctacctttgctgtcaataagttatctcttccatctctgagggttctgacctcttgcccttcctacagttgaaaaatgttgttttatttatcttcatcatcctcacaattttctctttatttgccatctttcctttatcatgttgtactcccttgacttcattttataatcctccccatcctgttttgagtctcacacaacttatcctgcatattgctcttccttattcctgattatttttgtattttcttgttcatactaattggctccatttttatttccagtatatttataactaaatggcattcattgcctttgggcatacattaatttatctttcaggattttccatttactctctgcatcttttctttatatatttcttcttgtaacctccatttcacttcatttttctcatatgttttggtgtattatttttgttgttgctttttaaatatcccttcatatctgtaattcatgcttcatgtgttattaggagggtttataaaataaaccactgtgtatttgtcacaaacagcattaatttgaatagtctaaaaataggtttggattcattgtactgcaattttccggccaccttctttacagccatactatagggcttaactaaataaataattagaagctaattttacaaattaaaagaactacagatattttaatttatttacctgaggtcagaaaagggtagtttattgaaagatcaatggacaaaggcaaaacttatttcaagagagagatgtttagacctttggaggtaattaactgataagaaagtggtgcatatatgctaacatcattaatcttcatacttttctatgccttcatgcatataataaaggacacatttaaagccagatatcccttcttcaagaaaatccttgaaaagcacaaatttgaggcaaataaaaatgtaccaaataaactacagtgcaatgtggaaaatattacatgttaaataacagtatatttagtgtgtgattggagtaaagaaatatgaagagcgtcttagacgactttctagagcaaataacatttcagctaagtatcaaagaatcatacacacattgccacctggagatgaggaacagtgttcagagatgttgttccacattataattgaaagggagacttaacagggagagaggcacgaaagaaaaataaaatatcagcatatcttttactaagacatttggaattttcctacagttcagtgggagtcattggagagtttaagcaaagaagtgacatgatcagatttgattttggaatgagaactccagtagacatgaagaaactggacagcaacaccacagccacttagagtggtaaaataataatatcaatgagacagaatgaggacacaaactaaagcagaatctgaaggaataattagaagatatgtgagagtcattaaaaggttcagtcaagagaacttgaggacacttaggcgtgggggcagaagaaagcaagtgagaagcaagtggaaagcaatttttccataggattcaaagccacccacttaatttcaattagaaaaatagagctgtgaaatggctattaagtttaatttcatccagatagattctccagtttgcattgatgattagatcactactaccttatgacagtgattacctaccttatgacttatgattaacagttgaataaattaaatgtatagtcaacagagaaaataaaaataacaatattagaatgatactttctttattgcataaatgaatagtgacacattcagacttcccaatgtgcagcaagggagcccaaaaaacaataaaaaatattgcacagacattcatgcaaaatgaaccctgatggtagtaaattctaaaaatggcagaatttagttttaaatgcaatttccacatttgcatactatgtaagaaggcatcttataactatgttcatagtatattgttcatctcatttccataatctaattcagtgatacttatgctcttcaaatagtattcactgatcatattttatctcttttttatcttaaattatggttctgtgaattacagaccacatcagggaaagattgtaaatatcataaatataatgccaattttcctttaaaatggcaaattatataaaatatattttctgctttttcttacaaggaccaaaagtagacaaacctttgagcttagaagtggattagaataccttttaattacatagcatataatttttttaattcctcagtttattaaaagattataattttgaaaaggtaatcctgagtaatgtagagctgttgattttaaacagacttcaatttagtcaaactttcttatccaaacttccaaagtttccaatataattgcaggttgaatttgccatagataatgcaggcatttgggccatacatataatatactatctatttaagctatataatccattgttatatactgagaccattttagtgcaaggtattctaccaggcactttgcagagaatattttatgtaatacaacaacttttcagagaacgcagtattctttttcttcttcttcttttcctcctactttttcttcctcctcctattattattatatcaatttatttactgaaaattgaatttccaggaagttatataatttgcccaatatttctcccccgtagatgtaaatcctgaattgggattcatatctgttttattctaaaacgcatgctcacttccactgaattatgctgtcataaggtagcaacatcacaatcattttgggacagtaagaagtagataaggagtaggtcttaaaacagttcttctttggtgcaaaagaactacatcattttatgtaataaaaaactgaactgtaagaaccctaaggaatgataacacaaaccttaacaaacaggacttatgcaagcataccaatttcccccagagatgtttagctcatggtgtttctttaataacaaaactcaaaaaacagtgaatttcatcaattacatacttaagatccttggcatgtcttgctttttcatttctccagcccatgtcaatagtactgagggggaatatcacactctggggactgttgtggggtgggggaaggggggagggatagcactgggagatatacctaatgctagatgacgagttagtgggtgcagcgcaccagcatggcacatgtatacatatgtaactaacctgcacattgtgcacatgtaccctaaaacttaaagtataataataaaaaagtagtactattgtatcaagtcatactgattatattgtatatacttacagcttttgtaattatttaatatatatttgatgccttatgaggaaattatctaattagaaggcaacatcttctacatcgtttctaaaattattttattatatttgttcaacaatagttagaattcttaactctgacaagcatctaccaagcaggatttgagtctgttctatgtggactagtatacttcatgatactcaaagcaacttcagattccttttcccagtggtgatgtgtggtatttgagacaagcacacttcctttcatttacttctttctctactatggtatcttgtaaacccatgttaaaagtttaatgtttagtttttttccatgtttcaaatgattatgaaagacaagataccttgtttgcttaatcatgactttttttctcctttgagaccacttggaccaaagtgactatcaaaatagttgtacaatgtgccctgataaattggggggaataggttgttggggaattttatttgtttttatttattgttgtttgttgtggtcattgttttgactgtagacacctatttgaggtctacttttgaaaaagaatattattggatatagaaagtaattcaaatattattggcaagataaatttattttactttaagttccgggatacatgtgcagaacgtgcaggtttgttacataggtatacgtgtgccatgggggtttgctgcacctattaacctgtcatctaggttttaagccctgcatgcattaggtagataaatttctgcaagaagtataatgagaaggacaaattgatgaggacatcttctctaacaatgaagaaagagttttatatattatttggcaatctctagagtttctacatgagactccaagatggcatattgtccgtctttctatctccctacctacctatttatccatctatctgtctgcctgcctgtctatctatccgtcttcgtctcctctccccacccccaacacaaatatgacagaaatgaatacattcagattatatacatacagattcagtttcatctggtttgatttggtttggtaataatccatacactgagctaagtgctccaattttctttttcttttttctttttcgaggctagcttgttcccctgttttggaaaatttcctccttactgaaacatcacattacaaccaatattatactttgccaaatattttgttgtaaattctgatggcccactcttaagcaatcatttatatgtgtacttctagtacataagacttcattgagttttcagtttgtgcattccattatcatgaatgtactgagaagcaacttaatgatttattccttaacccaaacacttaattttactcctttgacttttacaaaaatatcattagtctttcaagaataggaaatcttacaaatcaacactaaagaacttactcatgtaaccaaatactacctgttccccacgagcctatggaaataaataaataaataaataaataaataaataaataggactagtcagctgggcacagtgactcacacctgtaatcacagcactttgggaggctgaggcaggaggatcacttgagcccaggatttcgagaccaatctggcaacatagtgaaaccccatctctacgaaaaatagagaaaaaaatagccaggcatggtgacacgtgcctgtaatcccaggtactcggaaggaagaggtgggaggatcacctgagcctgaggaggtcgaggctgcagtgagccgtgatggtgtctctgcattccagcctggcgacaaaaaataaaatggagtagtcgatttaaaaaaaaaaaaaaaaaaaaaaggacccagagactccaagagttctatttcaccaatgataccatagcttcttaatctactcatgtacatgtgactgtgcttatataaatttgaattttaaaattgcttgtagacaaattaagatagaaaaagaaataagatatcacattaatgaatgggtattcataaatttatatataaacttcatattgtatattccaaagggatctggaaatttttatatttttatgggagttaggaagattctttctttaccactttcattacattatttcattaaggaatctgatgaaagatatggatacttgccttagaaaaaatttcacataaacaatgtcaaattgtggaattcctgaagctcattcacaggcctccctggagtctttgatttcagtgttatgtcagttaacatgtattaaattcctgtcatatgctaagcaattttaagaaggcttgaaaagtttgggcacaaaaatgatatgttctagatgataaagataaagtatgtgcacctcatttcactgatgagtagtgagtggacaccttttaaaagcctatgacagtgcctgtacataaaaagagattaataaatgttaaccatcctctctcctcttaaaaaaaaaaaaaaaaaatctagtgagggagatacacatttaagcaattatattcaaaaaatagatgagacagataaagagaaaatagcacataattacacagtacttacaatttcatagtcccttttatattggacaactttataaccccttttgtatatttactcatctgaatctcaggtcattattagtcaggtactgttattcccattttatagatgaaaatatcaaggactagagaggtaatgaaacttgctcaagattgcacaagtattggcagaaccaggactaaaagccaggtaatgtgttccaagaatccatgtgcttaaccgtcacatttgctatctcataaaaatacaacaaaggccaggcacggtggctcacgcctgtaatccgagcactttgggaggccgaggcaggtggatcacgaggtcaggagatcgagaccatcctggctaacacgatgaaacatcatctctactaaaaatacaaaaaattagctgggagtggtggagggtgcctgtagtcccagctgcttgggaggctgaggcaggagaatggcatgagctggggaggcggagcttgcagtgagccaagatagcaccactgcactccagcctgggtgagagagccagactctatctcaaaaaaaaaaaaaaaaaaaaaaaaaaaaaaacacagaaatgtctcaagcaatatggaatggcaagatgaaagagcaattacttttgttggtagtctaggaaaagtctcagagaagcacatcaaatttgtgttaggcattgaaagagtagaggagacatatagtacctagggtgggatgtcttattaaatataaatatgacttaacatacttagtgtaatattaataaagttctatgtctcctaatgaaagaataaaacataattattgagttactcatgaacaagaaatcccaaatacatgaaacatcctgtggacctagcaaacctgcaaaaccattttcctgaggctaaactgttttcagaaatatgttagctcttaaaaacaggtctataacaacaaatcccaaatattgtgtatctgtgaggtacaattattctgttactcacatataactgatttgtacttttgttatttctcaaagaattggcaaagggtgccgcaacgtaagtggatgaaagccattataatgggtgaaataaaatccggtggctaagaaagaacagatttctaaaggggaaaatattattcagttcctagttttaaaaaatgggatatagaatattataggtggattatgggatattgtcactggaatgtaccactttcacctggagccacactatttggtgtcattagtagctgcttattctcgccattttccccaccccatttctttcccactgctaccccaccctgccatatcctgcacagagacaatccattctttgattcttctttggacaataagagtaatttttacatgtcagcactcgtaaatccaccctatgaccatagtaggttgttttttgggggggtttctgtttgcttttttgagatagtgtcttgctctgtcactcaggctgaattgcagtgatgtgatcttggctcactgcagcctcaactccctggactcaaaattctcctgcctcagccccctaagtagctgtgaccacaggcatgcaccaccacacctggctaatttttgtattttttgtagagatagggtctcactgtgttgtccaggctggtctcaacctcctgggcttaagcaatcctcctgccttggcttcccaaagttctgggattacaggcatgagctactgctcctggccataggtacttctggaaagagttgttctaccccaccagactaatgactcctccaggacaggtatgtataatccttttcccattttataatctcagaatttaatgctgttaatacatgtgtgccaaaatgattgattataaaagggaaaataaatgaatatatgatcatcacagattcactatgagggtgaatcaacagtgggatccatatttgtaaaataaaacaatgaaaaaataagaggttagaaagaaaggaaatttggctagatatgttaatcacagatgtggacattaaaatgtagtctaagtcatcttatgacaaaataggtactgatatatgacagtttatatttttaaaaagcaaatgtttatttaatttcaaggttaacattagtgatgttatgctaaaatgtgtgtgttcctagtaataattgcattactaacatctatctagatgagagctctctactataatcaatagaaatgtcattggcctcccctcctctcttcacctctcattctgccatttctccctagagcactattaaatgtaaatttcccaaattcttttctgtgacttttatggcctgaaagtaagtaatctgattggtgatgaaaattcagaacaacatagcccaagtaccctgggaatcacagttctgccaagcacttatgaactaagaaaaatatactctcttgcacatgtggaatgtcagaggaggaactgtgcggctcactcagctcactaggtgttagaacaacagtgcaagggtatccagtggtgacatacataaagacatggcctccctgggagctccagtgatttagaaatgaaatcttagactgccctgtgaaagttgaagatcctgttgctttacaaaggaatggatattgcataacttgaagataaagagagcaaacccactgataatactgccatggttaagtgttcttactgaaaacttctatcaacactatggctctaaagagttcattccggcagccaagaacagggaaatgccagctgagaccccaactactccaaatgctcattaaatagattttacttttttcggtgatggttgtttgaaaataggagtgtttatgagaagcgcaagctctctttaaagaaaaagtagaaaatgacaacagaacaagctcacattgtaaaatgcactatgcaaagagaaaaacaaacaaatacacacgcatgtggcattctttgtcatctctgacatcttcaacttccgcgtttcccattggttgcaatcagagctggtgtttagaataatgactgctaggttctgtaagattctcaacattacagatatatttcattatgcaaccctttagtattctaaaagtggaaggagaaatgaactaagccattttaagatagatttaaattacaaagatagaaaagcagagagatttttattcattctgagctaaccaggaaaatcaattaactaaaattcctgattgccagagcatgctatgtaatttgtatgatattaactttggttttacttaccttcaattgtttatagcctgtcaatgaaaatatttcctgaacaatgttcaagtattaacattcattgatagaatcaattcactgcagcctactctgtctggcttgcgtaaggttggtgtagaaaacgaagcttccaaaatcaggatccggaccagaaggaaagctttgtatattatgagctaagaacatttatttttatcaatttcagatatgtatatggtaagacttagaacacatagaataaaattcagaaagtaacatgtaccgtggaagctaacactaagcattagaaaatttgatcttaattagatttattttaaagggtatgccatataaaatctatcattaatattataataatttaatatttaatttaaattcatactttaatttactcccactttcttctggctttctgtttctcaattttatatttctttttgagcctataataaaacataaacctggtctcagctcagtttaatattttgagatgtcgaatatttaatttcacaaaacatactttttccactcctcaaatgcattccttttttgctttttagattgcacatatactgtgttttgtattattggtaatggtaaatactttcctgtaatgccttttaaatattttgctcagtaagtaataaacaagaacttcaattcatttgcctggcattaaaatgagactttgctcccttattgaggaagtacaagttttggatttcgtttacaaatggcatatatggactgctttccccaacatttagtagggttttcaatgacaggctaataaaatgtatcttaaaacatttgggtaaaattgtaatcctataaagaataaatactttaaaaaaaatccagccaatacttaccaaatgaagttatatactgtacaagagaatttttaagtaggaagaaactttagtgatcatttattctagtttcttgttctaattaacatactttttaaaaacctctttctacaaaattgaagaataaaaaattgctagcacattttcagtatttttttcttttcattattagaaaaagtgttttgtaatacataattatttcagaaaaattgaaaaaataaaataataatgcccaaagtgtctattattaaatatattacataagagttacatatttttctgcctttatttacctttacatatacattgttattttataaattgggatctgaagctagttttgtttcctattttttttcactaaatttagagtgtgaaagttacaagtcactaaatacttttcgaaagacaatttaatttctatgaagtttataataaatgtaatacaacaaatacagtgttaaaaaggtttgagttggagttttgtaattaatttacagcaataaattaacaaagtagcaaacaaaatattatagaacatatgcctttgcatcagaacttttttgttcctgattgagtatacatcagtttaagacatttcagtcttctcaatgtattgctcaaaagcgaattctttgaatgatgtttataaataggctttttttatatgtactttacatctctctctgatttaaatagtcccttttcccctcacaacaaatataccaaaatatagtctccagttaaacattaataattaatttaatacactcagaatgtcataacacttaatgagtagaatactttggctttagaaacagcctttggagataaatgcagaaaggaaaataaacataatgtttactgaaattaactagaatggtgaagggtccccctcaccaatgccttggatgcatgactttgggagatatgtttcaattcagcaaagcaggtgatctagtaatagtggctaatgtgattagcacttgtgaaaataaggtcataaagcacaatttctaagatcttttagaaataacttgtaggtggttagaaattcaaagccattcttgagtctggagatacgaaacagtttattaaacagatattaaagtacttctaaaactttaagaaataaagacacttttctatcagtctcatctggtattaaggctaatgttatgtatccatgttacctcttggcatattggggtcaattcccagttatctatccaaaatagtaatatactggatcaaacccaatatctttcctgttctgaattctctctctgataacagcggtagtttataaaagagctgtagtcactcttaatgccttagagaaagaatatacttccaaaacaaaaatcaatgggaactttgaatcactcaagagtatcattttagccagttttttccaacatcttcctaagcaccatcctctaccagttctgctaaaagtagaaacattgattgatgtgttttatctccttccccctccactgccatcctctagcagagattctagaaagagaagaaatgccctaaagacaggttgcttgaggaaaatggagaagtcaaagatttgaattatatccacaaactggataatcaatctctaaagtattgaaagttgactgtacacaaaaagtgcagtagataaatattacagtttgtaagttgaagcatgtaaaatattgaagggaatgggtggaatctttgatgttacatgtgataaaccttggaaccaataaggttttttttaattatttttttattttttatttatttattttttaagttttaaaggtttgaaccatgaagttttaaatgggaatttcaaaaatttgcaagttaagcatccccgatgacttgttttagaacttcaaatttccacatatgcactcattaaaagcagagatgattaatcaattgtctcaagtgcatgcatacatgccttccatgtacatgactaaactaaaaatgggagtgaaggttgagaactcagtctgtgcaccacatgagtaaatcaccatccaagcatccaagcataaatttgcctgttgttgctgatcagtgcttgaattcatagtaaaatgacccacactgatcatttaacaaggtggttttttaggcatatatatatatatatgtgtgtgtgtatacatttgcctgttggtgccgatcagtgcttgaattcatagtaaaatgacccacactgaccattcatagtaaaatgacccacactgaccattaacaaggtggtttttaggcatatatatgtgtgtgtgtgtgtgtgtgtgtgtgtgtgtgtgtgtgtgtgtgtatgagagagagagaatcagcttcatcatggtatagtttacacaattctctctttagtttcctgaaaaagaatctgaagtttctaatgtgaactttcattgtttttgtcttctacaaagatgtattgtcaactatagagaaaagtgaacaaccaaaagttgtcataaaaattaaattgaaaataaaggaatctgaaataattattaataaatttccctttttcaagtaaatatacttcaaaatttaagtaggaaaaataatgactatttttttcaaagaaaaagtaaaggaaacaaatacacaaataggtaaattttaaagacgttcttactcaacatccattaaacaaatattttattgtgccaggaactagattctcattttcaatcctcaaaatttgcagtggaacagagcaaaaagaacaaaattacccatttttgtatgtatctactttgtgtaaagcagtatagtaggtactttccaaagaaaatgatgaaggaagggataaaaagaaatacatcaggactgtggttatagccctcaagcagatctaatctaattggagaattgagtaggcaactgatagtgtaaacaaaacagataaagcagattaatgagttctaatgtaatatgttagtactctgcttcttattagtctcctacttaatctactatttgaagtaataatgtagtatagtaggaagaacgttactctgtggtttccattcctggctctgttactaacatttgggctgaccatgggcaaatgacttaataacaggaatagctaccattgatttgattgcctgggtgctttgcatgcattgttttgttcaatcctcacgtcaaccatatggtatcattctgactataaaagtgactgtaagtccagtttgttagagatagtcctgcttttgccctattgtccaagtacacttgttaccagtgtcagtgtctccttttaccctcaagagtgctccagtttggatgatataataaattttctccatttgatgagaaacttgataattgcaatctaacaagtagtagaaacagatttgatccaaggctgttgatgcctaaagcccatatacatagccactctatatatgttcattctggttaaatagttgctgcgcttccttgtatatacataaaatgaagcctttaaagtaaatgatctccaggattccttccatctctgaaccctaggactccaagtacagacagacacatatgtgtgggctcatgatactgggatataaactttacatcaggcttagcgaacagaattaggaaacaatgatgaaaagaaggctagacagaatgggacatttaacacattatagaattcataatacaggtgcggctctgaatacttaacagaaagaaactagcatccccgggcaatgtgaatgagagatgaccctggactgttagttaagcgaagctgtatcttggtgtgtgaatgacacgttaagaacatggtataatgtggcatcctggttcttgtattttgaaaatacttgaatattgtttagagtcatttgcatctatttaaaacaagactaattgtattaaaacaagtctagttgcgtgtatttaaaacaagtctagtcgagtgaagtcttcattcaaattctctttttgctgaatattatatggcctacaaagagttgtttggctttgctgtgattttaaggtgcacttcagatttatattctccccagatgattatattttcctggggaatgttgatgcattcccgccagctttgacttctcatattcccttctttaccctcatcttattggatgtctgccatcaatattaaattgtcttaatcctgatttttctacctattgctgcttttgcagttggcactgattcttatgccccttgaaaggtacttgtgtggcaaaagattgaaaaaaaaattggcagttgttgtcagggttaatgtagaaaaataaatctcttatattgccagtttggatttacttttcatttttaatggccccaacagatgttggaggaatcctctacttcctgcacacttccatttttacagctggtactgcttgactggttcttgactttgggggagcagttcctgggtgtttacacagtgatttacaggcaccctctcactatagactatgaccatcctcttgtgtcttttttcccttgcgatttttcttgaaactgatgtaactctcaatgcagcacctcacaaagtttttctaacccagtgtttcctgagcaatagattctttccctactgtgcagcattctgaaatgtgtggtatgttagattttttaaaaaaagcataaaggggaggaggtacaaataagaggtgattttcaaacttagcaaatcaggcaatctatcctttttgatatctctctttgtatctttttcttatgttttcccaaagtattcatcacaattttcatctaggtggttcacttctcttgatgcttttgctttttcctaaaaccaccctcccttctttcctttcttgcttctttccttccttccttccttcctttccttccttcctccctccctttccttccttcctccctccctcctcccttcctttctttcttcctcccttccttccaccagcctcagtgtcactagcttccaaaaactgtactaatatcctaaggctactgtaacaaagtaccacacaaacaggaggcttaaaacaacagtaacctcttgtctcactgttttggaggctagacatctgaaatcaaggtgtcttcagggcacgctcccactgaaacctggaggaatcatgccttgcctctctggtttctggtggacagctgccaatctttgacagtccttggtgtgcagctggatcatccaagcctctgcctttgctgtcacatggtgttctccttgtgtgtcttcacattctctgtgcatgtatgtctcagagtccaaatttcccttttggtaaggacaccaatcatattgaattagggtccccttaatgacctcattttaacttgattagctctgcaaagaccctgtatccaaatccggtcaccttctgaggtactgggggttaggactttaacatatcttttcttgagggggacacaattcaacccataacaccaactaagaacagaattttcctcacacttgcttccgaaagaaatgttgacagcttttagcaattgggaagatcccgtgaggctgaaagtgccatcgccggctgctgtcttgtctgcgacttttctgtgctgttcacttgctctcttggtttgagagttcccgtagcagaaaaggcagagtcagacacaaaactctcataaaaagcatttgcttaagtgacagattcgaaccacagcctttcaagaagctctttagtgaactgtataaaatttgcttggtaaacatcctgacttgagaaaagaaaaactatcaagcattgtgagaaagaaaattatcaagtaccagtaacactagccatagttttattttcttcccaaattcttacgtagacgtgtgtcaaggttgcagaggataccaaaaaagcttatcaaccctcaactgtgatgccctgtttcagtaattaataaagccatttaaaaagtcttttaaattatactagggataggaaaaaaacacattagaaatgacatttcagaactattgcacaatttgcctaagaaggcttcaaagttttcttctaataacaaataatgtataattgtcattgtcacttctattggaaaatggaggaaaatagaacacttttctcaagcagatttcttggctcacttatataaggttagcaaggcaatacttttatttgaatgtatctttaagaattagaaatagccatgaatattcttgattactaataaaattgttttaatgtcaaaagaattatatttacaaatcctctattgttaataatgctgctataaacctatgtggaatccaaatcgtctctctcggaagtgctttactgaaagtaattatgccaaatatggaaagtatacacaataatttgtataacattctcgatattaagccagatcctcgcagttctcaaacaattcttcagtatgttaatttgatttaaatttttaaaaagttgattcaggaaactgtagaaaaacaaaatagttaagccacttgttcagtcaaaaccagtaattatgtgcctaaagtattttgtctcctaattcatttgctttgacatcacatagacctagtcttatatatggtagcttatactagaccataaaaggtgttacgcagtgaaatactaaacaagtcacattggacaaatctgataaaatcaatattctaggggcaggatttacaagatggggtcttagagtctatgatgaaatatttacagcaataaagaaacaggtattggagagaaaactaaaattgacagtcacctgcatgatcttctggggccaccctggaaagtccttgccatcctcctcagacaagagaaaagtcatcattaggctcccgagggtaattcaaccttgcagatgactattcctctacttggaaatagtttgactatacgtaagtgaaaaagactcttaagaattttattttaaaattttattttaaaaatctcaggacatttaaacgtatgcctgttgattttttttttcttttcgttgatttttcatggagttgatggagataaaaagatcagcctggcagcttgctggcatggaactggagtgtttagggtttgttttgcctttttgcaagattggtccacaagaactttaaaaggagaaaaagacgatgcaaattaaatacgttagaaacgtatgtcccatctgtttttatttcatttttagaataaggttttcataccttcttttatttttatattctatgataccacactataatgttggccacctcggagactaactaaattagctatcctgaccatatggaaaggaaaagctttaccagctaaagaaataaatttaactcaggcaaaaaggcctatgtgttttagagttaaaaaaaaaaaaaaatgttgctaagtacatagtaggggaatgtaacccacctgcataagtaaaatttgaaaagagatttggatattcaaaatagctgtctcttttcttggcgtcattcaggaatcacccatatttgaagtgtccttctgttgtgctatcatctggatgtatttgtaagtaaactcacaatcagagacatgaaggctccttgaaaggccatctatttctgcctctgcctctgagaaaaattaatcctaacctgtccggggataccttaccttaccccattatgggggttggggggaggaaaaaagcttcagtgcattcagagaaaaaaacttttcccctaatatctttactttggaacactgaataagacattcctttatagaaagatactttgtttcattctacaaaagcccatactgtcaagcacttgatagaagccctaggctaccattttattttacctagagagaagcttctcataaattcaccatgtaaaattgatgactgcttcagtaatctaccaatcttaggtttttatataaaccacagtgagggaatagagcttgcagaagtcaagcatatgttttgtagccacgcaaagagtaaaggagtgtctgcctgatctaggaccacttttgagttgacacatgcagttatttacaatgattgagaacgttgtagttcatgtacaactcatgaagacaagataaatagatgggtagagaagcttaaactaaaaaaaggtcaaccgaagtgttttctgtcacttgactgtaactctcagcacaggaccactcaacttttagagtgctgaagttaaaattctctttatttcaacagaataatagctaaacttataagtgaaggcatatgttttgagaatttttctgtatacattggaaagcctttttttctggacactcttaccagcaggcatttcaccaaagttcataccaactactaaaattacctgaatgtattcaagatgtgtctccatatattttttctgtactaaggaaggtggaattatagtagtaattccttttcccaaatcatgggacactcagtgtaaccattatctagcctgtaatataactttccaactctcagatatcaagctagtaggatggctttgaagtaccatattgttctccgaaactaaagccgtttgtttgtattagatgaaacaaactaatcaagcaaaagtattttttctttagaaaatgtagatgtcttagataaacattgatctagattttttaggttctttgattcatatctgtattaatattaagataaccagaagagacagaactataagaccagttaaaaggccatctcagactctagcagttgtgtttgatagtggaacacagtgttgatgctctgaactacataaataaatacttcctctctgtcgtttcttaggacatcttaactttcatattcaactctaatcattgtcatagtccagtttatggccaagcataaagaatgaatagtttccttaaaacctacatgatgtaattcacattatcaatagagggaggaaacgcagatgaattccacttgaggtatattacagcctgataccactcagccaccaacacagagctgatatatcatttgtgtattctcaggttggatgttataaactagacaaaaatggccatgggtttttccaaggaaaaaaatgttaaaaatctaaatagatatggccaaatatgcaattttccactatgagttagtaaaatgagccatatatcaaaaaatagaattttctttaatttagagcttgttttgtagttaaggaatacaatttttgcaaatgccagtggggggaaaaaacgagaaagcacaacttgtcttggattaaaaggagaaaaatcaatgcctactgaagactcatgcttgagaaagtaacatgtaaataaatactaggctcttcaggtaaagcaaaattcaaaaatattagtgagaaatagactgaagttagaataccttttttcactcacataataaagggccaacagcacacacatgtacacatacaatgctagagtgtctacttctgtgcatatttatcttcaaaatggccagcttataatattgtataaaggttacctgtttcacagtacaaatatacacaacagagtacaagcatgcacaacaacctcactactttgccatgtaatattttaccacaaatagttataaaacattaattcctttttggtttcttttgttgttgttgttggttgtttattttttttttggtgggaacatggatggagctgggggccattatccttagcaaactaatgcaggaacagaaaaccaaatactgcatgttctcacttttaagtgggagctaagtgataagaactcatggatacaaagagaaacaacagacactgaggcctacttgagggtggaggctgggaggagggaaaggagaaaaaataactattgggtactaggcttagtacctggatgatgaaataatctgtacaacaaactgccgtgacacaagtttacttgtgtaacaaacttgcacatgcacccctgaacctaaactaaaagttaaaaaaatcattaattcctagggaaaaaagatgaaaaagagttcagatagtgattgcacattttgtaatggtggaagttccttttgtaaaggaatttaggaacattgatgaatgttgaatgaaagtaatttttatctgatgtcctgataccactgataataagtgacaatgattttgaaaattaaacagaatgtaagagtcccaactcaggaatctccttcacatttgtcattatatcttatctttgatgagtgaactctttaaaaaaataaagattagctgccaataatactgataatataaataccaattattgagcacccattgtgagccaggccctgttgtatactcttttcaattattagtcaacagattcacaaaatgaattggcattgtattgacattttacagatgaagaaacagatacacagagcaggtagagaacttgcctatgcacatgtagctagtccactgttaattaccaggtatgaaccaggccatagagatgaaaatgaatagaatgtattattgaatcttcccaaaatagaaaaaaaaaaacacagctactgatctttattacaaaaagtgggaaaaaacagagttcttaactgctactccagaacccttgtcagtacccttatctgaaggtgaaagaatacacatacacacacacgcatgcaagcacacacacacgcatggacgcacatacacatacacgcatgcgtgcacatacacatacacgcatgcctgcacacacacacacacacacgcatgcatgcacatacacacacaagcaaatgatatttagaagatctcttaaacaggcccactgaaatgcctcaaagactacctaatgctttcccttttctttctaaaatgttattaactcatatcaacactactaaatactgctaatattccactttttggtatgcctatgttactgtgcacctgacagttaagtgaggtacttaaaaagaaaactatttgtttccaaaattattcacgttatttgtaattaatatacaaatacatcatttaattaaatattacatgaacttatgaaataacagtgttcaaagaagctgtcatttgtatgaaaaccaaaggtgaatgctttgcaagacttgataaataagttgctaaaagaatttttcccaaattagatatgagcaagacaactgtgaaaagctgcaaaagaaatcttaaaaatccagaaggattctgtacttggtttactttgtatgtatcactgaattggcactctaacgaaatcaaaagtagaaattatgtgatacactacagatgggtttatgggagagagacagcacaaacccccaaacttgggccttcagacaaagaaaggctttggccctacataagagtgttgccaactaaatatgtatttgctctaaacttaataggcttagggaggcatcgtgtatgtataaactatacatacatacatacatatgtgtttatacatacacaatgcctataatgattcttcacttaatttttcaaatttctcatcaagtattggtcttaattgttccttttaagagtgcttctgtaagtattaaatctaacttatatattccattaatttgtaatttaattgcgtgtccaatgtacagcagtaacaatcagaatcttcacaaaggccagtgccattttgtaaaatctttttaaaggattaattcagttatgttataattaagtataaacatcgatatgaatactttcaagtctccagttcatattactatatgtcaagtggagaattaatttttttttaatttggtaaactagtagtttagatagcttcagtgtaggtagtccctaaaaatatctgggtagactgtgaaattgtctcatatgccttgataatttcagtttttaaaaggagtagcttaatatttctattttctgttcttttactcagacattattattattattattattattattattttttattattattattttacaaattgtatttagtatgtgtttttgaaacacaaaactggcatgctggtgtatctggtgaatttactattaagcccaggtctgcaccagatgggcaggtgaaaatgtgattatgaggtgtgtggcgttatatccatctctgtaatacttgactctccaggtgacttgtacgtctgttacattcatgaattcactttacggttattcttacagatactgaaagaagcaaccttacaccacgcaaggtctatggaaaacaaaaacttccctcctttaacacaatcacaataaatgtttcataacaaccagataaatagaaacatgtcagcattttccccggcaggttcagaagtttgatgctgaaatactggtttgcacatctagaccaagactaaagtgagtttgctatttcaaaggaaaatgcaaattgaggcttaggctgcacctttctgtatcactgttttggtaagtccacatggggcagacaaagccaaacaccagctaggtggtagaattccccaaatattcatctgtgctgaaaccttcaaaagtcaggtgcctggagagctcatttaatgaaagggttatctctgccaaccagtcagtagttgatatttttttcaccagaagttgtgaaatattatttatgtatgtagaagacaggggcttcctgccgttgttgtttacttgtgtgtttgggcaagtttcctcctttccagaaagcaagttttccataaaagcaactttgcaatggccctactccttttgtttgataccccaggcaaaaagcttttcatggtattgaaataattttcatttaaaaacagggagctcagatgaaccagtcctttattaaaaaaaaaaaaaaaagcagtaaggtatccttggttaactttttagttatttaaaagtagcttgttgaagattgaatatttctatgtttcactagagcctttaaatataaaagagatatgagactatatctgacaccatcaggcatattatattaaaatttatgaacaacttcatcaaaaaccactttccctctcctgcatagagacagatttgctctgacataaacgttacatggctggttgcagcctcagattaatgcgaagaccctggcgattccttttagacgttattttatgaaataatacctgtcagctgctgcctgatcctagaaaagggggcaggttttccaggtcatcttaccatctgtcagctaaagctcatctgtccctccacattaccacctgatctgtgctaacaggcctcacggggaggcctgcttcattggcccagtgggaaccagggaaagagactgtgagaggacatcacctgtgatgctgagatttaattatcgctgaagtgatgaagatgtgcacacagattgaaatgcttttgaataaattcatggagcaggagatgctctgccccactctccgcttccccctcccttccttttctccctctttagccccaactcccagccaagtgtgcttcctagttccaacacaaagcttgcagatccccccaccgtggatatttccaagtacacccttggaaaacacatgcacacacacacacacacacacacacacacacacacgtgcaaagagagaaatacacttgctaaggtaccaacccaaagggagggaacaatccttgtactccggggaaaatttgcctccgctttttacagcaaccctgattattttctgccaaagttccttgttatcaaattttaaagccgtattgattgttgctggcttgaaaatcagatttcattgtgggaccagctttttacctagggttttactcagtttgtggtaacaccagcacagagttacctggggtctcctgtggagagttaatgtgaaagttcacagtggaggtggaagcgcggtagaatataaaaggtaaagaagggcatagaaagtccctggaaacccctgtgactgtgggctccctcacgttctctgaatcaataccctgcacaaaagttattacaggtccaggcctttttgctttcaaagctgcttaggcagtatgtggcattaattccctcctgtacaaaaatgtagttgataatcacctggctgaggaaaggatttaaggctagaacagcagatttcctcacagattacagaataaaacctagtttcttgggataaatcaggataattaactgtagtgaagtatgttacccttgttgattcatgtccatgtgatacctttgttagatgcaaccacagagaaacatttatgccattatgtgaggcgagatctgatttctaccaaagcatgctatgcagcacaatacaagtttttattttcttggttttggggagcctgccttcagtctggaggccagttattaagcaagcacttaactcaattgattcctaattataaagttacaagagaaaatgatacactaccaccagtcccctttcctgccaccttttgagcaaagttgcatggccctgaactgctcttgactctgtggctgtcagaagttacagaatttccttcccaccatcacttgcagagcaggatacccctttccctgagaaggaagacttggaacagccgaagaagacccaagggttttttctagcacagtggtaaactgaaattgtatatttcctttttctttttaagggaaatcatgagcaaacattgccttaattcacatttcaaaaatgattactacagatttcaagacatttatcatgttgtcattggaacctgggaaaggttattcttgtggtacttcaggtcacaaaaaagaacgtattattagaaactaacacataggctatccaagagattcctgaggggaaattagaggtccactggctttgacaaaaaaaacaaaaaaaggtgacaggaatgaattaggtaacagggacccacagaaacttatcatgctctgaatggtcagtttccaaagtaactccaatctattacatgatacagttcttgtgagaacacaccggaaatatacttacagtccctgttatacttttccaaatacttactacttttattctctgcaatggcatggatttttatgaagctgccattttccaataattttagagaaatgttaaatgtaaataagtatataatagaaaatattttaaaaagaaatattatcctgccaagtcttttgtcatttgatccacatcatcaactttcagaaatatattatttgtaaaaatatgtattgaaattatatcttctgaaagacttatatgtcatctattttttcaacagatgtagatttaaaatcctatacatacaattgagtgttaaatcctacctatatgatgtggcatgttcaagtaatgagtgtatctccacaatatatccccttagctcacagcaacacttacatatatactctactcatagaagacaaatgagatttattttggatagctttggatgagtgtggctgtttcagcagcttgaagtaatgctatgaaatcagcaagtgaagtagagatggatgaggtattgaagaaacataaacagaaaattaatgaatctgctgagagttttttgttttgggtttttgggagtatagaaaaaattctgtacagtacatatgtctctaatgatataatcttgacctttgggtgactggtctagttttcaacaaaagtcattatctttggagaattgttcagtaattagaaactttttttcaaactaactcattgtagatgtgcatctcaagacagaaatctccatagataaaaaaaacctcatagtcaatcttaaaaatacagagtatatgttaagtgtgtgtaaaggagaagaagagggagaggagaaggatgattttcagatacatcttagctttttcccctcttttataaaatacattgtttacaaagagatgatttaaagccttttattctaaaggtttctgtccctgttttcagttttggattgctgaaattgaagaaaaataaagttaaacctagacagctcaaagatctacccagccaaagctagcttcctctctcttttgcctagattataagatttagattattataaattttataatccagggactatcattgttaatattgcattttatgcattaagtgctaggtcttatatcaccaataataatttgtccactagatagacatcattattaatattattaagaagaatgctagttatccataatttatcttttagaaaatctctctagataatttacaagaaatcttatgttattacttaattgttacttaagaaatctaaagtgagctgggcacggtggctcatgcctgtaatcccaccactttgggaggcgaaggtgggtggatcatgaagtcaggagatcaagacgatcctgaccaacatggtgaaaccccatctctactaaaaacacaaaattagccaggcctggtgctgcgcacctgtatcccagctacttgggaggctgaggcaggagaatggcttgaagcttggaggcagagtttgcagtgagccgattgtgccactgcactccaacctgggtgacagagcgagactctgtctaaaaaaaaaaaaaaaaaaaaaaaaaaaagtgaaatttggaggaaggacattaaggtgtctttcacaggactgtcttccccgttgggacataattaaaacagaaacacttcaaattgctattaccgtacagccgatctgactgtaggaagagcaatctactgaaaatatctactcggcaagcaatacttctcagtaaacatttgtcagcattggcattcttatgagctggaggatggaacccccaacagggccatgtccatcctgcttctgtggtttaggaagacagcaaatattaagtgtttttctaaaaactccacccttttctaaagcaaggctattaattattggtgcatatacacagtgatcactaaataagcctacaatacatacaatgacaacttaattagggcttttcaaatggacttctttgctcatccagtgcgacacacacttaacttccatacaactttaagctacaacctcattaccattctgcataaactaattgactcttagcgatgaaagcagccacaaatatgctagtctgtgaaagagagggagatgtccaaggtgactcaagagctagtgacagccaagacaagaacacaaatgactctctcccttgttggaaagttgtaaaaaaagaagactgcaaaattgtggacataagaaagactaatgagaccatggcaagaataattgttaacagtgcaagcatggtttccaagagaccttgactctacattacagatgccttataccctctgtaagtcaccaacccagagggatcttttaatggtgataatgataaagagaaattctgtcaacctctcacattccaaatggccactttaatgactagtactgtcttctacctgcggaaaacaacagaaattaaaatatgaagactttcccaggttagggaagccatgtttcaggaataggcatctttttttaaatcctagttgaggacttatggtaaagtacaaagaatcatcccatacacttcaatgtcagttgtatttcacattttgaaatgcttgttagagttaaggagactggagaaatcctaggttacatgataaaatgagttttcagagagcaatgagacagtttattgatcagctgattatcttgctatgtcttatgaggaggagaaaaaagattccaagactccagcctgtatcatattttcaagaaaaaaatttgaaagtggtcgaaatttaccattcagaggatacagtgaagaaggcaaggagcaagaaagattgctatgcttagtctgaaagacactgtctttctggatcacctactaccacatttagcaaccaaaccaaacataaataataaaaattcaaagcacatagattataaaacgtgaataatataataattttaaaaatgatagttgtttacattaaaggagcttaaaatttattgaggaacagtcattactatataagaatatcaaagaggaattaaatcagattgtgggaggggagcatttcagcttgactttaaataattgagtagatattcaacaagcaaggaggtgagagagatttcaagtgagaatgagtgatgtcccaagtcaatagaaatgttccagcccctcttatatttctgacctagaactaagaattctctggtgaataaaacaaagtcgatgacttcatggtgtttgtggtctaaatcaaaagaaggatactaagcaaataattaaatattcacacatttgcagagagctgttcaagaagagtacaaagtacaatgggaacacacacatagttacctatagaagatgttcttgtgatataaaaagcaaaggaacataattagtgttaaaggctgtctccagcagtatctagtctagagggtgaaggaagactctcctaaggaagagacttttaggaaaaggagaacaagtaaccatgcatgagtgaaaagagaatctaaaaggtttacagatagaaaaagtatctcattcagtggccctgtggcaggagaaagcatggcatatttgaagagctagaagaggtctggaaaaagagaatgagaaagacagaaaggcataaggcctgtgaggtagacagaaacgtaatacaggtccctgtcagctatactaaacatgtttcacttttatctatgaacagtgagatgctattgatggttttggcaagcagagacaaggtgagttggtcctggtgtgcagggtacagaagtcaggtgtactggcagatgaagatgatgctagtcaaaatcagaaccagaactcaaaaatcccaggaaacacaagtacttccttcatactgcattaatcgatattgtggaactgttggtctttgtcactacaccctagacactgtcagcttctgagcaaatttctctcttaaaattttaccacaaatcaagatactttactgatgttctcatcaaaaacgaggtaaaaggattctgtgtttttagttttttttctgagtctattttattccgctgtgtttgggagcaacagaaagaaactaaacatttatattattgcttctgtacttccagaaaattcttccatttcaacagagtaagaacgttattagtaatatcagaatttcatgaagcaaaccatagcatcttctctgtgccataactacattttcaataacataccaaagagtgtaaactgatggccagcttaactcaggaatacagcatcacctgttaagggttttaataagcaatgagtcccccagtcaagtggtccccagagaccaacaatttaatgatgctatgacagaccaagtaaagtgtttggttcaataataaggagcttattgtgtgcgtgtgtgttttttaagtacgctccatataaatattccaaagaaaaagggatttaagtttttttttttttttaatctaaacgggtatctccagcttcctgaatggtttcatgaacttcatgctaaggaaaactatcctaggaaataactatccattggaatatctgtcgctcatctagatgcacattgaggtccaaatggctcaagcatattcagtcaaggagatgaagcatctcaatacccaggacctttcccaggagcacactggagtgcatttaacaattgtgattgtaggaatatgtatatagctctttgaagtctgtgaagattatttatatgaattatctcaatatttctaacctgcaacagtaaaggcgatgaggtatagtgaggcaatgactcacctaaagttagagatggaggaagaggaagaattctggaaaagtctttgacatttctttttgaaaatagagttctcctcctccacattatttcctaatttttcagtgctgcaaagagaaaaagtccacagactcctctttgccagttcaagggcaacctatgtacagatggaagtagatccagattcatggcaagagaatacaactggggtcagaagacataaatccctaaacatagtttggatgattatttcatctcaatgaagtagttgtgaagatcactgatttatgtgaacaataatgataaataagaatgacaagaaagacaaatatggacaataataatatgagatatgtatgtgtgtgtgtgtgtgtgtgtgtgtgtgtgtatatatatatctccaaccttagtttcatgtgataaatgtgtgactagtacttacatttctggtcatttgttttgcatgaacaattttttatgtaattttaaaaattgcttattaaaaaattgctaaatctcttagattctaaaggaagagaatataaagttgatgtattagagatactgtgtggaaacaattaatatgttaaaatattggcaaaaaaaaacgaagaagaaataaaatataaccctagcatttttacttgcagtcttctcatttttgcttaacttttttcataaatagcaatttaacaaaacctaacactttaatgtgacaaaaccaaacactttaagaaaaactgagctctacagtgtactatacctgataaggtgctggatgtcaccaacatcattaatttccactgagctgaaatttctctaacatgcaggtctatctcacaatgtttcatcttcatttagaatatttggagtagtcctctttaattatttgaaatgtatatagatagattcatatcttcaatgaattgattataaaaattctcaaagaaagcaagaaattatttttctgagtaactggatgaaatctgtaacctgagtgtagactctcatcattaactcctctctgccttgaaatgttttctttctgcttttactgaactcttaaatctgctttttaaaagtttcactattgtacaaaagtcccataactatgagtcatctttatttcatcctcccacttagcaaatgtaagagcaagaatcagatttcatactcctcagcctaagcagttagactccaaggtggactcaagaggtgctggggaaggcaattctgttttgtgatttaggcaaagttaatgtaccacctcagttatgggttaaatgtcaattgccataaactctaagagaattaaagtttcctagaattttgtatcctctaccattgcttaaactcagcagcccagctggggttttggaagctttcagctttgagcttttgtagttgctaactccgcttgttgtaaatgcaaacctgtatttccatctgcagtgttgttgatttcctccagaaaacactgaggcacactcagttcataggcacagatgactgggttaagagcttcctccaagcataatgctgtatatgattgaatgtaaacgaccaactctgatcatcacccacacagtggaatggaaataagagttgccgaatgatcctgaattttctggttcataaacaaacagaaaataacaaacctaatatattgagttttatgtgcagtttggccatgaaacaaactttcttccccttgcaatgtttaatgagaagcatccctctcattgcactttcactttagatttaaacttccctatctcaaataatcaattgtttataataaatgaaaaaaatcctcatttttttttttgaaatggtttctggcatctaattacggaggatttttgacctggctagacagataatgttaacacagcttcaatactaaacaagcctgaacatgtgtgtgcttgacttttattaaactcctactgaagaaacagattaattggaggctgattcactggtgaacaggcgttaaagacagaaggaccttctcacattttgttctgttatccaggcttatgccatctcaggttggcaaggagatcccaactgtagtgttttgaaatataactgaaagaaattgtagaataacaggtgcaaaaaaaatgcaaaccacttataaaaagttgatctcattcctttctttttctgttgccaactggccacctgacactttatggactgaggtactgcccagataacatttcacataataatataatgtggaggctgactatggaggtttgcagctgtcgtaattatcccttatacaattattacttttttttttatcctttgagacattttttctttagaagaagaggggtacaagctgtaagtaaaccatttcacttaggctcaaagagcactgaggcaaaaaaataaaaaaaaatgcccttcttggcagctttgcttctatctaaaaaagctggaattttattccctgaggtttcttttgttgtttaatggtttatgttccataagataagcaaagcaaaataataataataacgataatgataaagcaacaaggaactaagttgctggtgagttggaaaagggccttgtaatgtatttgtggagaacattacgatttacagggttttcccacgtattatctcattcataatatctctgtgaaataggtgccaccagatttttacagctgggaaaaaagcctcttaaaaaggttaagagacttcctacagtcgttcacagagtaagttaggcaaccagaactccaacccagaccatctgactccgggtctgcctagggcttttctaggaatgtgcccctctggaaagcccctcaagccttctggatctgatccttttcctctatcagataaggacattggtgggaagatgatcttgaaatctccttccaacttcaaaatgtgatgttgaaatgtgattataaactactacaattataaaaataagcaacagattagtcaacaaatatctgttgcaatttgactccaggcaagggtgatctgttcagatcctcaaagtcacatcagcacacacccaagtctagttcatatcactaggtggttctgtgaactggttgttttttgacaaagctccattagtatcatcattttcttctgtgtaaatacatctctgcaagccattaatataaacaatgagatgaatgtctgagtttaaggatttcagtgttatatttttttaagtctcaactgttagaaattaaatgttacaatagaaatttgggtgggttacagattttatcatattttaaggaatttaggcttaaaataaggagaaaatacaatttgttgaaagtgaatgattgaacttttaggtggtggctctacaggaggagtttgcacttcaaactactttatttgtaaatagggtaaaattcatttactttaaagaagcaagaaagaagagttatctagttgtttgtttactgagaccctgtatcttttcaccagagttttgaggtagtctataacttacatttttgtaattaagtgccctgagatcacctggtgaattatgagctatcacataaaaatatgcaagtgccatgcaaatcctcatatccattcacttcaaggtaggatacacatgcaaaattgaaatggacctatactagatatacagataaccaaatacgaagggaggcctttattttcagtaattacctttaggaaatacgttgactgtgctgtctacctttaacttatggatagggtgttccgtccttcttatttaaattttatgctggatgacaaatagttaagatgacatatagtagagaaaattgcagggtattgtttagtctcaattctccccctataggggagttgagtagacttttctatatatgttttcaacagctgattggggacttattgatttttgagtacatttcagtgtagaatgaaagtccgagaactcagtgaactttttcatctctccacattccaagcctggtaaaaccattccgcctgctaaatgatgttataaatatcaagattagtttcttctgaaatcaccagcgccaggtgcattccatttctcatgtcatataatattctgttaccagtgttcacagtttaagatttaaagaatgtgtagacaaaaaaaagagtaaggacacataaatgtgacaactatttacatatcctatataagatatgctggaaagcaggattaataatttctttttagttttgtctttgttttgtttaggtggggtaggatgaatggaggtagaaataaatatttataaattagctattatctctatcataaatagatagaaaaatttaaatatattacttgcaaaaccaatgttattgtattttgttagctgcacttccaatgcataaaaatctcagcactcaagatgtccccataaaatctttcactaaacctttgttttaaagtatttgaaaggacatcattccatgtgggaatattacatacagccactgattcaacagtaactgagaacttatgtacaaaacattctttacatattgacaaatatttctaaaaaatgaattggtattttttgttgttgagtgtttcatgagtgacctttacctctgtagacatatgcagttttcagttttttgggtgagactttcaaaatatttttttagagtgttcaatgttagcagtgacatttttacagtgatttcagagccttgtagtttagaatattctatttgctttatttctaattacttataccatcctcgttttaaatcctgtgcagatgtaattgacagtgatgatatacaatatgtatgaaatgagctttttcctatcggtggtgtgtgtcatgcaagactccattgcaatatttacagttaaactaaactttttagaacgagcaaaattgcatttgttttgcagatttgctcatcattaaatgtgaaacatttcacatttgtctttttgagtaattggctttttaaaatgataaggtgctctgaacacttgttatgtggataggtctgacgttgtatcccagaaatccatatgccatacagacagaacagaagaaagatattcacaagcatgtcacagattggactaaagcaagccaaaaacccaagtgccatggcattaacaatagcaccagatttactgtcacgatcacaatctgtgctgcatcacagacagaaggagaacttttgataggtaacacctcagtgtttttttaatctttttggcaaattatcatttatcattatatttttgcctgccatataatattattacaatgatataaaaaatgcaggatacgtttattaagccccaacaaaagaactgacttattcagtcaggccatgtaggattaaagagagaatgagaggcacagatattctgttgttttattacagatcaaactaaagttggaaaaatagacaacagcaaaggtactagggaagatttagcttcttctgagttcgcaaaaggaaatggcttattagtgacagagaaaacaaaagaattaacctgcttgggaacttgaaaactctgatgtttccaaaatatgtggttccccaggataaaaactcacagctaattttattttctaaattggaagggggggtgggtggggactattttgagatgtgaaactgtccaatcctttctgctctgtgtgcgtttccccatgatgcagatatgaagagaccacaattcacaggatgtcccaataggtactaaaaaaagatttacaaaatcacagcttgagaaagagcctcatgttgggctgattgaaggaaaaaccccagaaacactgcacagagattcctggcatctaatagagtagagaaacatcagtcgattgtttttcttaattgaaggtcactttgggacttcgatgaaaattttttttcacctgttagctgtctacctggctaaggacatttctagaggacaacctatatttttcttatagaagaatatattcttaagtcatctggttttgttaatttcaaatattaaaacctagtttctcaaagatttaaaaggattcaagtaaaacctttaaaagtaattagtaaaatgctaagctatacaagtatagctatgtggaaacaaaggaatatcaatccataagttaattttaaattcagttggctgaaatattatatattctaaagtaaatctagtttatatcattttcaaaccatatttttccaccaaaattgtaattattttttattttttttctttttagccttgaaaccaataagaccgtttgatttctagtcttgtattaatttggagacctgggtatattattttctttcaacactccacttgccaatgcctgtcttccttaaagctctgaggatttatttactgtggaccacttccagttcacatgcctcactttcatgggacttaatatatttcttctaattttcaaactccatcaactcaatttaacttatttttcactaactcagagatagattaagtattgtgatggttagaaagaggcacataatagttactattttcaaaaatacatatgtattactagggatcaaattagaaaaaaaaatacaacccaaaacaaaaacacaaccaatttcttaaactgtttttaaaaattgcataatacataataatggagaaggcatgcccagcaatggaagaaatatatgcgtgagatatgaaaacagaccagaaaaagactggagtttcagcagtcaagggaagagtgcatgtgtatacgtgtatttttctgtgtgtgtgtaattttaaatacaattatttaaattttgtaaaataatcgttctataaaatcactcaatccctttgattgttgagtttctattatgagtatatgaagctaacataaacagcacttaaattttcaccagagacaactatccatgcaagactctcgggagctgcacacttggtaccaggatgtaattttttttttttaaagaaaaggaaggggagccacattactcaagacatattcaagtgagagtagattgcaatttctctagtttaaatggaaaatccccataatgttaatatttactggctttggagttgttgagaaacatgatgtagctatgatattaaagttattaaatattcagttgttaaaaggaagggagtccaaagacaacatggtggcaaattttggcatcagtaggggttagaatatactgatgattctgaaccttgaaggacaagggaaacataagtgatcatatactgcaggcaaaggagatggagaaaacaagaatgatagagttcaagaacaagaattggtaaagacaatgatagtggcaatgatagaattatgaaagtccggaaggcaaaacattctatggaagaaatttgtattgaagaagtaaaatttgatagagaccctaagatatgtatagaatataaatgaataaattgacagaaacagatgggatcaaattatagcctgaaaatgttgtatgtatcatttaatctaatacaaaaatttatattttttcaggagcatgtttatcacctaaagcatgggtacttctaatttaaaataagtatctgatactgcatgtgtgggtttcctttaggttagtattagttgattaatatttgatttaaacagtctttgttcagcttaaataagatgtaaactatgaagtcatgtttgatttagtcattcagcagcaaacacttatgaattcctaccaggtgcctgacacaagctctagggatggttctgagaagctctggcatagagcaaccaaaggaagatgagtgcctcatcaggcaacagcattaaggaaaattggtgaattgcattgagtttataaaataagaaaaagtaaataacgggactcgtgatcatgctcttaaaattaatgaaaattattattacttaggtagtggtgagaacttacacattaaaacagagacagatgatattggcatacgcagtatgatgtttctcaaagcctgcctgagatgaaacccatattatcaaaatttacaacttctacatgaaaacaatctgtaggttagatttttctctctttgcagtgattccaaagtatgaaaataataggtgaaaaatcaaggtgaactttacaatgacagagttaacccttgctaaataatttgtaatgcaaataaatctttttatcaaattctatatcaatttaatgtgtgataggagaaagcattttatgaagtatattaagtaagtttgatgttataatgtataccttcctatagcaaaacaaataaataaatgcttataagccaggtgttttttttttctgcttttgcttttgctttatttgttttgtatcgtggccttaatcaaattttgcttatcattttgtgttttttatttttttgatttcccctcttatgagaattcattattcttacggttatccttgtacattttagtacttgtttcatcaacttcagtaaaatttactccctttataaaacataaaaaatttgtgctccccttttcacattgtcataaactacatatagatttattagttatattttttgtcaagttgactatatattttcttctgtcactctaattctcagtaagttttagcttaaggagtgtccctcattttatataacaactttctcacttgaagatgtttttaactgttttgattattgattggttggaatcaaatgtattacgagactcacattgtccaaggccatctttttgggtgcctttgtgtgtgaacatacacttgactacatacaaagtgcttgggtaatgcttcatttctaccaggaccctagactttctccatcgtttcttgcataagaatattgacataaagaagtctgaagtcagcatgttttgctctaataagtgacttcatatttctgccttgaggtccacaggacttttttctttgtccataaagtctggtaatgctgcaagatcatattttaggattttaattctgtggcattttttcctagaacacttacatcttatctacttgtaaattcaggtttttctctatttcaggggagttttcatctgtcagatctttgaatatttttctgtttcattttatttcaattttctttttcaattgtaccaatgatgagcatcttacatgtcttttgttgttttctcatatctattggctttcataaatggatgtacctcagttaataattttttactagtttgtattttgatcgtagaattttcaccacatgcccatattttgtaagctaatgttgttcaattttaagagtttataattctagttttaaagtcttttttaccaaaatattctttagaagagtgtttgtttatatgctatgacttccaagagaatggattcttttcagctatactatttgcttttaatttctaattgtaggacatcatagttaagaggtgtggctttggtggatcattgatactgtctttgtgtcttaagctacagttaatattttaaaatattcttctttatgatatgtgtagacaattgtgtttacatcattgtgttctttaaatccccatgttcctactttgtcaatctgtcaatttaagtttgtcactttttccatttatttgtcaatatatgttcaaatttatccttgtatttctgaccatttttgctttatatactttatttaatcaggcattattttattttctcacataaaatgcattttaccaagatagactacttctatggtagcactaggcatcataatacatgaatttcatattctcagtgtcttagcacaaagtttatttcttgatcatatcatagttcattgagtgtgttctctgtaaggcaatgaacaccatggtcatttagggactcaggtttctcccatcttatggttccatcttctattagtttctgagagtcctctccattcagctaaaggaaaaggaaaggggatgaaagttgtacaggagaacatcaaagggccaggtctggaagtggtggatttactgtccgtattctgttaagcatacataactacaagggaggcttagaaatggagtctagctgagttcctacatggaggaaaaaaatctggtgaaaaatagaaatatttgggctaccatttattcatgcttatccctattatatcttttgttttctgaatattgaaagtttatttcacattttttataacatttcaggagtatacatttgcatccttcattttaagcttcattgttttcttagtttaatctcttgtgaatagtgtattgatagatatctctctctctcttaactcagcctcataagctctattcattaatgggaaaatataacccattcatattttttaagatgaagtgtttaatatttctgtgattttattttatgctaattgttaaaccgtaagtagtcatcatttcctttcctattttctacctttagaaaatgtaatgactttttgggatctattttcatctatgtagtggtttagaaatatcattcactgaatgaatcaagattctgagcatgctttttcactcctcagtggaaatgaaaacaacagcaacaacaacaaaccaaataccctgggatgttcttcatgtagatattggttttttgttgctttgatggaaatgtgacaggagagtaggactaatgtttgtgttcactctaccagtaggattaaatccaatattctcttcaaaatctttgatttcattttttttattttgtgtattttaccctacctgtcattgtacctattctatttcttgcatttttagtgtattttaatttttggtataatttttcttgtaatactgaattcttttgggctctcagtatgctcgttttatatttttgccaaattatcttttcctttaccatttgcatttattcttgtatatttgtttcagtaggtccaagttttcctagaaaaaattgtgtgtgacattttctcctgttttctggaataatttttcttctggtgtgggtttttaaagtctgacttctgtgtgtgtatatatatatatatatatatatatatatatatatatatatatatcctttttcctctcactcttttctgaggaagtaaaagcaagagttgtaatgtctgtgcctgtgcctgagccccacacagaatgctctctgttcattaatcttggtatagaaagggttgatttcaatttcaaactatttaatctgaagaaagttgtgaatttttctttggacagtctctctccctctctcccttcctcccttcttcctcctccttttcttctctcttttcatattcttaatctgcaaactacttttaatagattttttctataaaaatctataaaatttttatataatttttttatataaattttgtgcgcttttctatatctggacttcttttccttcctcactgaaactctggaccacactattaagatctcttccagctttaggctgcatatatctaagcctactactatctttgagaacatgttatgaaatattacaaattatttcacatctaaaagttgagattagattaagaatttcctaacatctgctgtcttagaactcccccactcattatgctaatagttctcatatcatttttgccaaaggtgatttcaaacagattaaaaactccacagacattacttatactcttgaaatacatcagtattgtgtatgtgttcaagtacttctattatgtaaataattgcaaaaaagtaaaatatcttctttaaatatagatgatatttgaagcatttgattagaatgtatacatatctaaaacattcattttttaattttcataaattagaaaatatcaaacttcagtataattaaattaatattttaaccattcagctaataaaattttctgtggtttgggaaggaagaatgatagcttaaattaattccctttgttattttgagattttttgttcatttgggactatagataaaagaagataatgttctcttcctttaaagcttggattgaagggtgtatcttacatgtattataaacaatataaaatattctgataatgacattgtttaattatgagtgtttgacatagaaagcaatgatctctgacactttttattttttcagaataaattgaaaatatattacctggctacctaaccaggtgccaccatgttaagcaattttattatagtttcagagaaaagctagcctatgtaaagcatgttctttgaagatacaagtctaacacattgacacatatatcatacacccacacctaccaatagaaaacaacaacaacacaacaacctcattaaaattaatgaggcaaatggtgctatttttgatgggacactaatgagagaatcttttttttttaaccaaatagaatcttattaatttatgtcagaaacagaagtggagacacagtcatattagaagtgttaattccgcaagggaatatctccaatggtcctttaactgggcttaaccacttatttaatcaaacttatttagcttcatgttaacgttacatgatttaagatcattcctatatcatagtataagctctctgaaaaaatgttattattcacctatatacccccagtacaaagaataatacagtcatgcactgcataacaatgttttgatcaatgacagctcatatatgtggtggcagttccgtaggaatataatacagtatttttaccataccatttctatgcttaaatatattgagatacacaaatacttaccattatgctacaattgcctgtagtgttcagtacagtaatatgctagactagtttatagcctacaagcaataggctataccatgtagcctaagtgtgtggtaggctataccatctaggtttgtgtaagtgtacactctatgatattcccacaatgacaaaattgtgtaatggtgcatttctcagaatgtatccctgtcattaagtgatgtgtgactgtactttgaatgctgtaggagcaccctttcttcccctattctaaaataaaaatatattttgtttcacttttatagtttttgaatgtaaaaaaaattaaataaaactgagatgttgatcttttaaattgaaccaaaaatctttctgaaaccagtgttggtacacatcattttgaagggtactatataaataaataaaaataaaatcaaattttaattaaattttattataccaacatattaaaagtaatggtgaattccattataaaatggtatattccttgtaatgtgaacatctgttatttgtcttgatgacaaataagatgtcatcatcacatcacatgaagatccatgtgatgtttcatcaactactgatgtggacacatgtgcatagtaacaaattcatctttgagatgaatgtaaaaaatgtgcttaatatgcttattaattgacaccaggctacgtgattgtctatcacaatacacccacttttatgtcagcattttctcatatttgagatagaatacctatagtctatcctggaggggaagaaagcatgcaaaaatgcatgaacattcattctgcaaatacttagttgagcgcctactttgcatcacagagtggtatacatatgtgtcgagcattaagatatgtactgagaaatagcagttaacatacagaaaaggactctgctcccatggagtttatatcctaatttaatgagactggaaatgggcagaaaaataaaatatgtagtgtatatgtgttgctatgacaacaagaaaattaaaacagagagcagatactggaaatttaaatagggtggccagagaaggcctcagaaaggtgacatttgagtaaaatctgaaggaggtgaaggttttttttttttttttgaaaaagtatagttaggttttgttgatgacagggatttatatgatcatgatagcttcaatcagagtaaaataaaaaacgaaaatatcgtaggaggccaggcgtgatggctcacgcctgtaatctcagcactttggaaggccaaggcagacggatcacctgaggtcaggagttcacgaaccagcctgaccaacatggaaaaaccctgtctttattaaaaatataaaaattagcagggcatgacggcaggcacctgtgatcccagctactcgggagactgaggcaggaaaatcacttgaacctcagaagcaggggctgcagtgggccaagatcatgccactgcactccagcctgggcgacagagcgagactatctcaaaaaaacaaaagaagaaagaaaatatagtaggaaagggtacattaagatacttataaaactatatattttaaagaccatagcaggattcatattttaggaaccatggcctttagttctgtatttaataaatttaacagaaaattattctctaaatataagcatttaaagtaatcattaacttgctgtttggagatatgcacattaatcaattacttttctatcaaaacaaacaaagtttacatcattgtgacatggactttgcttccgttaacttctctattatagttaccatattgattactagttatttgtgtgttttgttattattctatagctttattgaatataaggaccctatgtgttcatctttttcttgtgtacaaaagcagagtaacgcatggcactcagtaataacttttgaataaattgattcattcattcaataaataagtattgacatactactgttttaagaactggagatacattggtaactaaaacagaaaaaatatctggattcatgaagtctacatgttagtggaaaaagtcaataaatcaaataagcaaaaatacatgtcaattaaaatctattataagaaaaatcgagaaagtaatagcaagtagtgagaaagtatatactctcttaccttttatacctcccagaggcagtgatattgaagatgaatcagaaagagagggaataatttgagtcaaggggattcctgaaagaggaaaccagaagtccaaaagctcaggtcttgctcaaaggcacagagcaagaggctgaggtttgagaggagaggggtcaatatgataggcaaatggtcaggtcacataaacctgtaaactgtgatcgagtgtttcaatttgaaccagtagtgtgtttgggccagagaagtgacatgattctgtttatatcttttaatgattgctctgtcagcttggtaatgaaattgagtgtaaagggttaggaacggaggcaggtggaacagttcggaagctctatgtcgtgtttttaagaggtggtccctgtgttgatctagagtagtagaaacaagggtgattaagaacaaaacggaaatggattaaatataatagtacgaagggaagcgtcattgaaaatatctggttggacttttcaaatacatgatttcttgtaaatgtattgatatatataatggtgatatttgaattgtatcactatttggtagcttttaacaaaaatttcagctatcaaagtgaaatatttatcagaatcaacctcaaattgttattgaggatgagtgctatcttttcacaggtttcttgtgaaaattacttttaattgtagtattaactggtaatttattattgcttctttaaattaaaaatcacctttttggggagttcttctaagaatttcttggtctttagtttttgtatttacttatggtatagctaggacggattttttaaaaatttatttatcctggttgaggtttgtagtgatttttgaatctgtggcttaatgtgtttcagcagctttgaaaagttctcagccattaggtttaaatacagcttctcctctctctcctcttttactgagaccccagttatacatctcaaaaccttttcttatatcttatgctgttttcacaattttccattcttttgtttctctgtgctccaggtatgcatgttttattctgacctattcagtttatttttctatgtttaatctactatcaaatttctcttaatttcaactattttcaggtctaaatttttattttattggttatttccaattagctgccaaaacttttcatcttacttatattttgaaaatattgtatctatatctggatcatctagatttattatggatccaatttcatcaaattctctatttgttgtcaattgtttattaaaaatctttttgaatcaagtgtaagacattacatattaaaaagtacagagataatttaagaatctggaggatgatattttattccagaaagaatgtgtttcttttccattttttgcaggccctttaggttaggagcagatcaccttaatccgagtagagatgatgtttattcaataccgggtttctgcctttgtgagggatggtatatttctggtttgctcttctgtttaaggcatagtccttcaggatcccaactgaatgcctcagggcccctttaccttggtagaatataaacggcaattttgtttctcaagccctgtgaggctgccatcaactctgataagcttctcagcctatcacctatagcttttaattaatttttattgattgattcagacagtcaatcaataacagctgtaataatagctcaccgtaatcttgtgaactctttcacttaagtgatcctcccacctgaacctcttgaataggttggactacagctgtaagccaccacaaccaactaatttattttttatgttttgtaaagatggggtcttactatgttgcccaggctgattctgaactcctgggctcaagcgatcctcccaccttgacctcccaaagtgttggtattacaggcatgagccacttcaaccagcgtactcatagcttttcaatgcagaatgcctcaggagaagaagcaagaccaaactgtgagctcatctgtccaggattccattctcttcaaaatcttggctcacatgttttctatgtgttgttagctcttgagtgccctagatggaaggtaggtagttgtgtgtgtgtgtgtgtgtgtgtgtgtgtgtgtgtgtgtgcgcgctctctggcagaaagttaatctgaagctagtcagccattgcctgaaacgttttgcttgatggaaaaaaatgacagaatacaaaatatttttagaggactattaatcaccttattgcatatatttaggaaacaaaaaatatatatgtatatgtatacttatatatgtaattaaatatttaaaaggtataaaaatcaaaataaccccaaagaaaatgtactaaaaaatttaataaagataaaagccaaaaacgaaatgatgaggcagcaaactaaaaatgaagcagatttgatcaataaaactgaaaagctgttcccttaaaaagaaacagtagtaacattgaaaatatttgacaattatagccaaaaagagcgaaaagaaattatactggagataagaaaatggctacaagtaagaaatgtcttacaaaaagtatttgcataaaactccattaataactcagaaaacatagataatattaattatttttaggaaaatttaagcctagaaaattaactcaagaaattgaaattttctcaatagaaaaaatttgaaaaataataaaatatctgtacctgaaagagcataaggaacattttttatagatgcatattaccaaaccttcaaagaccaagcactctccatgttatataaggtcttacacgtagaaatatgaaaaacaggcagggcatggtggctcacatctctaatcccaacactttggatggcgaaggcaggtggatcacttgaggtcaggagtttgagaccagcttggctaacatggtaaaaccctgtctcttgtaaaatacaaaagttagccgggcgtggtggcgcatgcctataatcccattacttgagaggctgaggcagaaccgctagaacctgggaggcagaggttgcagtgagtcaagatcacaccactgcactccagcccgggcaacagagcaagactctgtctcaagaaaaaagaaatatggaaaacatcccaatttatttatgagaattgaataaccagaaaacaaaatcaagcaaggatagcaccaaaaaggaaactaactgcaggctgatcatgatgatggtaggatttcaaaatacaatattagtaaccaaatcttgttgaccaagtgaaatacttatattcagagtgcaagtatctctaacaggatgaaatttgttttggtatatcctaactaagacacaataaagaagaaaaatcaagtgatcatctcattcattgtttaggaaaaaaaattgataaaattgaatacctgattttagagaatagtggaccacaatagaaatagattatcataggaaaaaatgacttatgtaaacaaattttaaaaccataaaatttaaaacctctttgtgactaaagatactacaaagaacataaaaaaaggattggcagatgaaaaaaatatatttgcaaggagggaaaatataagacagcacctcgaaatgcataagaaatatgccaatagataactaaaaaaaatttaaaggcaaataattaaaattttgaataagcttatagaaaaaaaagtttaactttactaagagtcagggaattgcagcctaaattgggacaccattctcacctatcatgttgataaatattaaaaagtaaaaagattaatcatgttccgttttaaaagaatgctggtgaaaggcattcttattcaagatgatgtctaggtgaaaggcaaagttatagcagcacaatttgtaattgcaaaaatgtggaaccaaaccaaatgcccattaatcaacgagtgggtaaagaaactgtggtatatatatacaatggaatactactaagccataaaaatgaatgaattaatggcatttgcagcaacctggatgagattggagactattattccaagtgaagtaactcccgaatggaaaaccagacatcgtatgttctcactcataagtgggagctaagatatgaggatgcagaggcataaaaatgacacaatggactttggggactcaaggggaaagggtgggaaggggctaaggcataaaagactacaaatcaggtgcagtgtatgctgcctgggtgatgggtacaccaacacctcacaaatcaccgctaaagaacttactcatgtaaccaaacaccacctgttccccaataacctatggaaataataattaaaaaaaaaaaaacctagatgatggattgttagttgcagcaaaccaccgtgacacatgtttacctatgtaacaaacatgcacatccttcacatgtaccctggaacttaaaataatttttaaaaaaacaaaaacaaagggtgaagttacttggtctcgtggcatataaaataatagtctgtattctccaagtctttcatttattctttcaataaatagcactttctctttgccaaactgaattaaaggtcctggggaccctgcaagccataaagaggcaaaattagagtttctgtcctcatagagtttgccttctaaggagaatccttgctggtttcactcgattgcagttggtctggtctccccgttgttctttgtcctctgttactctgtcatgcttgcctggattttgttgttgttgtcaatttgctttggtttgttttctagctggtatcaagctgctcccactgccaaagttggtaagccctttcttttgttttacttctgaggtcccttctttctccagcctcttggtcctgacctcaggttggagcttttagtgcatctgtaattgttctcacgggcacagcaacgcaaacacagtaacacaagccatttacagactgtcttagtcctaggcatagaccctgcctctgcccttgcttccctgcctgccacttcccccaccacccccccacccccacgcccccacgcccccacgcccccaacaccactccaccagaagcttaggatcaggcaacagatttctctcagcatactgtctcacctctaacccctcttgggatgggggtcaggactaccaattcgcttttcagggattctggcaggcgttttcactctaatagggattctgcgaagtctctgtggttgaggtgctcctttccttttttgcttcttagaagttgccattgaggtgaaaacttctttgaaaaagttggtctaagaggtattggagaatgtagtgcctgagtaagcagaaagattcaacctgggtctcggggggtcttaagtcaggtctctttatccccttctacataggatttaattgctgcagcctacaataatatgctcattacttgtcacattttctaattgcattttgtaatttatctgtgcctgatgatcacacctgtgcattatggagatataccacacatgcttatgcataggtgtgaacggttacacatactttcttctttctcctgccattcttttgaagagtttctcttatttcacaaaatgcactaggagaagagcatctgggggaagtaaaatgagaggggtggtttcagatacaccttgttctgtacttgtctgtacttaatatggataattagatactctttactaggtactttgccacagggttttcatggattgcatttaattgttgccacattcttatgcagtggctaccctttttaatctctacaggtgagacagaagcaccaagtagtgaaatgacttgtgcaggactgagcttgtgaatgacgggcacagatatgaccaaagtggtatctgccaagcccatatgtttcaacttgagcgatactgtctcttgctgttctgctacttttatgttctgcttctgcactcaaagttataggctttcattttgttagacattataaagatgtaaaagaaatttaagccatagtccaaaaattgagaatgccatatgatatatccaaatgtcataatattacatgactactaaaaagattgtttatgaagagtttatagtaacttgagaaaccaatttttggataaaggtaaaaacctggatccacaattggatgaaagtttctgcaactgctgatggagtagggtttcacctgccatcatctgtagaacaagaaactcaaactaataggaatagtatattttgggtacaataatactattttttattgtcagaaaatttgcatggctttggattagtaccctagtagcacctgttagcttagagtcaattgcagagactgtgtcctgtgagaaacacatgctacaggcccaacaacaggaagaggataaagggatagtggcctcactggagtcatcaggacagccccgtggtaaatgatgtgatagaaaaattctccccatctacttgtgctgagcctttcctttcttggagttgtagtttctcttttgctgagacacctgttgtcctcaagttcttctccaggcctctctcaaaattccatttcaaatacctaaggctaagtgtaaatattcaaatgaaactgtcaaaatttactaagagatataaataaaaccttgcaatagtgagacatactttcttttctgaggtggaagtcttactagttttaaattttttgttcgtcccaaattaatatagatataatatacaatcttatcaaattcccaataggatcttctggaggaagagaagaaatatttaaagttcacataaaagatttagggtccttcagatgatttctaagaattaaaatataaattggaaaaattacaaagaagtaatacctaaagcttacaatggaaaaattaaaaataacacatttatatgtaaataaggttgtcccatgaacaatgtggatttgaattgcaggggcccattaatatgagaggggtttttttcccaataaatacaggggtctctctgtatctgatgtttccacatctgcaaccaagagtgcagagggaaagagcagtattcacagaatatgaaacacctgatattgatggctgacttcttgtatcgaagatttgctttgggctaatggtgggactcaagtatgtgcaaattgtggtattcacagcagccctggaatcaagctcctttgaataccaagaaacaaaaataatttcattaaaagtgccattcaaaataaattggggaaaatttatgtggtaattgtcaccaaaatttaataaacttccttaaaactgcattccaatcttaaaaatactaaaacttaaaaatgtgtaagcacattagtaagaaattctaagaaaaaaaaaccacaaatgcctaattataaaagaaatgcaagcctaagaaaaaaggagtttcttataaaattcacaaagtatataatgtgttacttcagagaaaatatgaattgaaatgggcttatgctttaaattttggtgagataatacaacttggaacaaactttctagaaaatgattagtaatgcatttcagcagcctttcaaaattcttttatttgacctagtaattctatttctaacaatctcttctaagaaaaacaaatcagaaatcttaacaaaaagtcatgcttatgcagcgtgggtttatttaactaaattgtggaaaaataggaagacacttcaatttattaaagtaaatctctataacaaaatgttaggaagtcattaaacagatgctttcaaagaataatgccatggaaaagccttcatgatatgttaaaaaaaataataagatacgatattgtatatttaatttgacctatgtatgacctatatatatatatacaaacacatatatatgtatataaacataacatatgtattaaagagtctgaaggaaaatacattaaatactaagagggatattttgagtactatgattagaagtgtttttagtttttatacatttctggttttgcatattttaagtcttcgagtatgcatttatattcagaaatagtttgctttaatatattttcctaagaaaagtaacagcaatatctaaacaaaacagcaatatcattgaaaatgtatagaaaaatatcatcctttcacttaattgttttaaaggcttcatctaaaggaataacttaattaaaattccagaccttagacggcaggtttagggaattagtttgtcatccaaagaggcttcttaaggctcccagaatcacactacatggcaattgacagtactgccgatataagttttaaggtcaggtcaggatacggttactgaagtctcacttacggacaatgtggggaaatgcagttcaccaatacataggcatttacccaagtttctcaaatgtagtggcagttttagaacacagcaatgataatgggctaggtggaggagactcaatttactcatttttttgagcctgcaaattttggaaaataatgacatggggaaagaaagggatgaacagaagatggaaaaagaaaagagagcaatcttagagcagcaagcaccttgaattgtagtcttgaaggcagcacagaagaattgagatagctgggggaattgtattgtgtatctgaagtacaccagctctgtttcataggccttgtgccatcacatcatctgggttacattacaaaaacactctactcctcacatagcataagtctctggtaattttggtgcaggaaggatgagtaatttttactatatttaattatcattgtggtaagtgttctctgaaagccttgatgtagctgaagcctctgcggtaatttaccaagaagtctttggagtccgcttagaatcttgccatcctgggcccttcgatgaccctgactttttgtgattttgcttaagatatcctatcaggtatctgcctgatgtcatgggagcataaaggcatgtgttgatggcaagaagaccatggagtcttattctctgataatgtttattccacatctgtgatttgtgtcctacaaggctcttgggacttaaaccacatgtgctatatttgcattaatgggaatttaagaaggagaggccataacactattaaaatgtttagctttcgctcccatcacacagacacatgctagtaactactcccagatcttgtatcatggtgctgcaggatgcaacgtggagtgcactcattgtttcaatacaagggacttgaaaacaaatagctgccatctctgtctctgatagtttgccaggcttttaacttctttggtttttccctctccagatcatggtgaggtatctcagatgtattccaaacagcacattgccccatctttgtttcttcttttataaaggaactcttgctttaaggtatatttagaaaacctagagtctaagccaaattctgaagaaccacatgataattctactttcaaatggcaggaaaggacttagtgcagaatcacccacacagggttattgatcacccaggcctaatagtcacaaacgtgacaaatatgctggaagtttttcctaggtttaaatatccaactgttaaattacatatgaagatattttgaagcatcttataaacagagaggcagggagggtgcagggtgggaagagaaaagaaggggaagggaaggagggacaaagggactgggagagaaagagggaggaaaagagaaagagagcacatcaaggaacagggcatgaagatcacatcttcattactccctaggccagagtttttcaaattgcaaattctgtgatcctttagtgggtcacagaatcaatttagtgagttgggaccagcatttttaaatgaaatcaattaaagaaaaaaagaaaccaggatagaagatatattacatcacatatagtaaagggaggtattattaaataaaacttttgtttcaattatatgatatatatacatatataaatgaacatatgcacatggtgtatatatatatatatatatatatatatatatatatgtgtgtgtttcattattatacattgaataatagatgaatttatgtgtagaaagatacctagatgacagaaagagagagagtgtgagagaaagagaaagggggggagagagagcaagaaagaggtactgattggcaatgattacttcttaacatgtttcatgaacaaaaatgtttgaaagccatcaccagattatacctccaggacagtggcttctttaaatttggaatacgttcttcccttagtgcctcctccacctgcattcaggtaaattaacaagctgcatataagtctcatctaattaagccacaaacttttaaagaaaatgttgtggatgaaactcagtgaaatatgaatccaatgctgtgagcctcaagggtagcagattacaaacccaatactggttctcatgatagaaaaatgtcctccttaatgtcctactccccaggatactagagaatgataaatggcacaatagttgatagtaagcctcagaaattgagggagaaacttactatactgatgatctttagatatcatttattcagggattgggattattgtttgagatcatgaaaaaacaagttaatggcaatggaaccatcttgatgaagcaggcaaaaaactatagttgggacaactactatggaaaagtttgagctgataatattggaaggaagtgtgtcttctggacagaatacagaacccaaaaagtaagataacaaaattcagttcaggctgttagggtgtgagttccaaccagaaataacaaggatattttaaagaccattggatgattgctgaatacactgacatgactcattttcagatattcttataactatggtgccttgaacgcaagtatggattatttcttgattacatgtgtaacaattcagatgggtgaggcagatggaaggtggatttaaagaactcagtgaggtgcaatgaggatcagggagatgctctgcagagccccagttcctaaaagggggcctggcaaaaggacactaccagccgagagagtctggtatgtgagataaaccaccagaatagggaaccacaagccggaagcaagaagaggatacagctacagaaatgagctttggcaaagacaggatatccaagactgtgcattctcaactctcaaggcctgagatcacgtcaagtcactttgggttatagcaaaggtctttattcaaataccaagcatctcaaggtggagcatctaacattgaaagcagagaagcatctgttgagttgtgtaaaagaggaaaagatcaggaaccagaaagagctggagaaaccccaggggcccatggaagaggtattcttcttaccaagatggtgtatcatcttttcagatagatgcattgatacaaccttagaaggcagtggtatgttgacagttatggaagttgcaatatagagccagctttaagaggatgtcttccccactgtgacactgtggaatagctcactaatacaggttctcagtgactaatcattgctttcctctttactagtataccaaataaaatctgttttctacatttcataagcctttcattatgtggataccaaaaccctttagtattaacctaagccaattgagctatcattcattctatacccctttattgagagctggtgctattccagatacttggctgaatgcagggacatgtggttttgtggtcagggagcttaatgtgtagaaaggtcaagacactggatgtgtacagtagtgagatgcacaccattatgaagttagtacaaactgctggagggatacctcttttttgacctctagatgttataaaggactttccggaataggcagtgtctgagtagtttcctgaatgaagaggtggagtttgcaaagtccaggagacaatcaatgaatcagtcaataagtgaaatcaaataataacataatattttaagtgctaagtatgtaccaggtattatgttaagttcttctcctggattgtattttatgtagcccttataatggtcctatgatgtaggtattattgtttttctcaggttataggtgagaatatagaaacacaaaaattttaaataaattgttcaaagttatgcagttaataagtagaggaattgaaaaggttagagacagagaaattatgaaatgttttgcaacatacattaaataattgaggttttatccttgggataaaaggaatccattcagtggcttttaagtggcatgtgacagatatggatttaggtagatcatctttctatggtctagagcagcagactccaatacagcataattttcaaatcactcgtggagctctgtaaacagacagactactaggccctatctccagggtctgattcttttaggtcctagtgaatgtgagaatcagacttacaaagatctccaaggacaaagttgatgtcagtcaacttaggagtttactgatgagtggatgtaaagaatggattgtaactataccatctgtcattaaggaggtcagaccagaagtcacattggtccgaattgcaatagagttacacattagggatctattagttttacaaatctaattttttttaaaaaaatgagaaatggtaatataattctggagcgtgtctgtaagggagaagaatcatgtcttacaggaaaatgtttggtaacaccaccatttaagggatgagtgaagggaaaagattccacagagagggcatagggacagcttcttcatgtcctttagagatgctgtatactttccttcctctgaatctttgtacaagcttttcctttcacctgtgttgtcctcttaccctgccttttcttctactaaatctcatccatccttttaggatccttctccaacattcatccctgggtcctccattataccctcaaggaaagtttgatttctttcattgaaaaccattatgtgtcccatcttgaatccttatgtaattgttgtttctaatgttttcacatgctggtcttttctcacactagattagaagcttcttaagaggaagggtcactgctaacttttttgtatacctcacagttcttagaattggaccaatgacaggtattcactaggcacctaaatggttattaaatgactctcagtattgtgtgtgttggctagtgatccatatgtcccagagacacaaaataggcctggtttataccagttgtcctggtgtgttattaacagtgccttttgccttcagcattatcatagtttcaacaataaattatatagtcaccctactgatagtgctaccaatacattttttaaaagtctagcatctttaagtggtaacatttcaatacaaatgtcattttgttttggggagtaaggagtgttaagatatttttgcacacatttggcatggagtgatatgtcattccagatgtctccttattaggtgggtggcctgttgctcaattgacagatgtcattgtctattatagagtcacaggtggtttattttaataaaaataccattaaattatctctatttttctgttgtgctctctttatatatagagagaaatagaacacatatgtacacatgtactatattacatattatatataactttatagtatgtatgtacatatatgatacgtatcactacatcatatgtcactatatgtgatatacctatatatcatatatagtgatatatatatgaacatattacatgtacatatgtactatatgttttgtaaaccactaactatagttttagaaatgtcagatgctttttcatgtttggtttaaagataacccttttgagtaaacagttaggaatgttctccaaacagcagaattacaatttttccacattctcagaagaaaattttcaacattttcaatttatttaagcctctcattcatggaaaaagaagcattactactcattcatgaacatcttaattacatagatagttagtttcattcctaatgaatgatcatgctctttcatggagagcaaaatctagattgtcaagctcttggttaaacacaatttcaaaattatgagacaccaaaagtaagtttgtagtattacacttacttcttgaattatgcagtttggattctataaaaaagaattcactggttaatttccaaatctccacctaatatttgttcctctccccaaagtatataacttgacagcagagaaggaaatagataccgttctttcttgtgagccacacactctgcaagggccattcctagttctgctatttcccaggacagagtatcaggaatcatgtgggaatagttcatatgtgtgtgtgcctgggctaatctgtgtttactagtgtagtacagaggggcactgtttatgtctgagaaaatagttataaatcacacttcttctgatcacaaatactcatttatctttagactatatcaccacctgagttatttttatgtaaatattgcacctcttaaatataatgatgataatagaggctgtgaatccttagatttgctcaagtgttccctttttcaataactgaaaatatttaaatcccagaagctttagcatcctaagagaagtagcagacagatgtgtcaatagagtgagacctacagaagttgtgagtaatgaataagtcagagtcatgggcttctgtaagggaactgcggtgcatttcctaggttggtatgttctggctatgctgcgaaccgtagcccagaaatgactgactcagagagagtcctcagctgctttgctcctttcagctctgtcatcacatagaaaggtctctttggcaaagtgtcggaaacaacacaaggtgggcaagcatctgcagatttcctcactcagtcagaagaccagctagagtcatccagcttctggaaatcagtaaagagaccaactttgggtagcgagtccccaagatcacagagaatctatgttgtggtggcatcaccattccttatttgttggcatccttgtctggaaactgcctcatttggctataatttaacttgaagattaaagcacagattttcatatgtatcttctgttctctgaatgtaaaattatgaaatacacctacattcacttctaagtggcagtattgtaattgagcagatttttgtttttcactgaaacctggagttgaattgtcttgagccggaaggcattcaagttgctgttttttacttagctatatttctctataagcatctaattgtttcaaaaagtgaggtaaagtatgtgaaaacctgaatctaatgcaaataagtctgtacagcactaaagctaacaggtgttctcattaatgtaagcagacatggaacaattcttgaatgttttataaacactcataatcatggccaaatatgttacaatagcataaagatacatactgtaacatcttttattcttgttgtacactctcagtacttattaataggagactagtggcaacaatacctacttctgcttaagtcactgtatcataaagttagctaatacttctaaataaaattaacaacgtaactactacctcctcccacagtttgcttatttattaatattaacagtgttcttgtaaaattgctacaatgctgatggacagcaatgagcatctttgcatcactgagtttctctaaagacttgacccattaacctaagtattagctctttaaaattttgaacttatgttccagttcccatactgtcaactcccaattaccaaagcctatatttagggtgagattcttagatgatctagtatagatgatccctgtaaaatacttgggtggctttggaatataatcaagaacgttctattttagagatatgcattgaaatatgactcttgtgcttcccagcccttccaagtttaatcctattgtctgatgtctaggacttgctgactgctgggaaaatatagccttcagactgccattatcaatcttcaaaatagtttgcctactctactcttatgaagtgttttcagtagacgtcagtattacattacttatattacctgaaagaatgcaattgtattgcagccttcaaaattttatgacaatagagaatgagttaaatatattatggcatatcaaacaatgcaatataatgcattcaccaaaatgaataaagtagataaggtttgtctattgattattttcttagtgttccttatgtgtctgttgttcagccatgcatgtagacaattgtcattggcctcaggattattatagcatagtggggggaatggaaagaccaacaaggcattgcaacataaaccagtttgtgctaagataaaggagaagcaggatgttatgagcgcacttgggggaatatctatttcaaagaagcctttactgaaaaggtgacatctcaaatgatttgaatgatatgacagaggatgtcaaaggggtctaggcagcaggaacaacctgctctaaagtatgggacagctggggaaccaaaaaaatcagtatggctggattgtggaaatgcagaggaaaatgtggagcagcggaagtgcagagtgggtcagtgccagagcacacaggggctggcatgccaaattaaagagtttgcactgcactgcaacagctgtggggagcctcagaatgatatcaagcagaagaatgggatgatcatatccaagtttcagagggatcactttggctgcaatatatagtatggacttgaaggaaaaacatggatgagacagtgaggaaagcaaaggatattatgactaaattctcatgagagatgatggtagtatatatagtaaaaggcacaaaaattttcataataatatacatgatattttcattaaactgtaaacatacataatgtttcctcgtgggtcaaaaaggtatgtagaaagagacaacaagtcagtgtatcttgaaggaagggagattctatgtttgttaatttgaatttattaaaacttttaaaattgagcattacctacataaggacagtaataataaaaataataccaatttgaaaacaatgggggcagcagattcccaagtgtcatgtgactgtgactaaatgagtaattgaacacagtgaatatagctcaggcaagaaggtgatctgtggttggcagggagtgactggtgacaaatcccaggatgattcatttatctacagacaagtacacccccccagtttaaaaattaagagcaataaaagtctaagttgatatctttatacaccaactgctttgattagtctctttttgagtcgtttttcatatgagcaccacaggcaaaagttttggtgtggctgctgcaaaactgtggaaattgctaaactatctactaattacttggatagtattctttcatgaatattgagaagactgtttctcagtacttaaaatattttaacacaataaaaagaatgaacatgagggttttttttttttttttgcttgtttgaaataaattttgggtttagatatttgttaataaacagaaagttagagtgggcaagtaatatggggtgtgaatgttcactacagggacaattttattatgcagaacaaatctctgttgtacgaatgcatggacaaaattatttgggtgtcaaagtacagctcaatttcacttaaaaagcattgtttcttgaaaggttggccttaaaccttagattttggaatgtactggaggtctgtcatgtacgtaacccgacattgtttactttccattaaataagaaattgcttacatgggcaggttattttgatatgatgacaccactgagggttccaataaatgtacatgcaaatcaatcaaccccaaacacattgaaaacatatccaataagcgtctggaaactaatgaacgcacatttgttaacatagggggagttgtggaaatgctgagatccattggtggcctggcttatttagtagcatgtggatttaggaacatttcacggagtcagaagaaacagagtaattataacataaggttcaacatctttagatatgtagaacattttccgttgcttaaaacaaatattccctaagaaagtataaaacatttttctgacttgcaaagtttttgcagtctatcatttaaattacttaaataaagggagctttactgctccccaaagctgagaatataacaccctccatgcatattagcttgatcttcttgacagaccagaaaagtgtttgtgtgtgccaattaaaacaaaaatggatccctagtggcttgttcctcatacaacttttgaagactgctatcattgtttgctagggtaaccctggataaggctgctatccaaagtaaacaaacttttcaaaactttcatgacagatggggattacaaatgcattttaataagagagttgccaaagtaacttttttttttttttttgtaatcagcatatatttacttaacatctagcaacattgggaacacaaggcagatactttctcacaaaatgctttaacaagtaacatttttggaaaggcaaattgaagaccttttacatctaactgatattttacccttagttttattttaactttgctcaacatgttaagagaaatgttaggaattactcaaaccagactgtaatttgagacagacattcagcctgatagtgtaatttctttggtggtcataaacacctttgagaccaagtaatttagctattagtataaccatgacaaccttcatttgatcagctatatgtggagtgatgcaagatgaaaaaaatgtgaatctgtgtgggttttgtaagcattattacttcgattttaggtcttgatatctccctatcatgtgtatattttctgctgggagtactgaatacagatatggacaaaattactatcacaaaaataattcatattcacttcaaataaagttagtgtatgttgatataactttttatttttacttaatttaactcaaatataaaaattatatcatgaagtccaaagtctctctaaacataatagcaattaaattccattcctcttatttatgtctctctagaaccactgtagccatattatttaacatgttttagggctctttggatatttggcatattttattatgcatttcctgcatactatttcagtttcactaaaatggaataatccctccttaggttctaatcaaaatgcgaaaggtatttgttcaagtgtaggattgctttagtcctttctaggatttgaaggagttgtagataacccaattcagtcttagatatattttttcatagcaagagagtgcttgtttttggaaagaaaaatcagagctaggattttgcatgatcttttaaaatcgggctatctttagcctaactgcaaggaaagaagcaactttgtctaaagttgctattccaaatttcataactgaaaccaaattatcacggcccttttcctgttcaaacacacagtccttgactgtatacaactgtttgctgagaactagtgaactagaaatcaagatctttgtaatctcttaattctatcatttaaaatgatgccaatttgatagaatggcattctcattttcctcatttgcttcattttcttcatttgcaaaattactttatgatagtggaggaaagctgcatttggagaatgtttattatgtgctttgagatcattaaagctgatatcactttgcataccaagtggtggtattcatatccttaatatactgaagttctgatacaatcaacgtttaaagaataacgtatcatgaccaccagtttatgcatactttcatgatgtaaatgtgcctgcagtaactactccttcctctgaaatcttgacatgagcattgtgtgtgctgctcacattgggactcagtatgagccattttctattgttatttatctgtatatgcatatgtcctatttatccaaacagattgtgagttcttgagggtgggggctgtgtatccctagcttctagcaatgtgccttgtacttaatggatgcttaatcagtcattgttaatgattagtaggatgttctgtcatgaacgcatcctctctattcttctgtacatgaaattatttgtgggatttattctgcaatcagaagggtggggctctcaaacagggtagcaccatgtcactcattatctcttacatctttggtaatctccccatgtgcatctgaagtcagttggaagctggtaatattttaccatcaaatatgttttgctgatgaggtgtatctatctataacattgatcattatttctgtttggttattatttataaaagattggcaataatgaaattaaaatacctacaatgtttactttgtgtagctatgcataattttgattctttatctttatttttcccaaattctacacaatgaagtattattcttagaaaaaagaagttctaaaaaaggttttgtttatattctagtaaacaaaagtatggaaatttataatggtataaatgccattctacacattaatttctcatttaaattaaaaaatctaatagcataaaatcttactgccagaatgaatattgatgagagtgttacttaattgacaatatttaaaagaacaatacttaaatcaacataaacactacttcttaaaactcttttaagatgttttaaattagcatagtaaagctccatttaattaaaatctaaaacgcaaatttcttcgctcttcatcagtgaagtctggacttgcatctacctgcctccatattaagaggaaccgtaccaaggacacagactattctaagcccacgtgaaaactattgttgaattaattcccaaaagccttaaggaatgtgcccactctgcatgttgctcagtggacacgcttctataatttcctgggcataaatttcttaccagcaagaattcagatggacccttatttagtatgaaaaagttcaagacaaatttccccagatggatacttaaagatatgcattattgacactgcacacttcattaaggttactttggtgccctgatatattccttcaaaatacgacctggtgtggtaatgagggatttcaagaaacatttgcctaaattaggtttctaagcaagatggagaccagcagctcttatctaaacctgttatgttgtctataagttcttccttcatccccttaccccagcatctgtcacggaggcaaaacatatagaaagagtacattagcacggcttaatatcaaagcctttatgtctgttatacatcattttagattgtcatcataagttgttcaatcaaaagatttagtcagagctaacattctttactgatgtcttttttccccaagagtgttggaaattcgattgttcaaagtgcaaatatgattcagcaaaccatttatcagaaatcctaaagaggtaaaataaaaaagcgggttgaggaacctgaattaaatgggctttaccagtcaaagattttgaaactactttcctgtgagtgactggaatagagcagaacaaagtcaattactgactgtaattaagaagtggatgcatttaaactgtagagagcagtagcagacttctccagactgcctggtaactcgaaagattagtgggaagacagaggaaaggatgtgaactgcatctctctgatagtatgttttgaatgaattgcattcatatagctctctgatctagcttctcaaaatgaattcgtaaatcactgattatgtatgattaatgcagtaatatatttggacaaaggaacttttaaaatacattttgcttttggttgtgttagcaatataagatcccctttgcattgcatagcatgcaccaaaaatgcaaacgcactgctaaagtacttatattttatcactgtttgaatttactagactgcaagctgaactatgttggctctttcgtaaaccctcataatatagcaaatctaattatgtttgtttctcgtacttcttaaatgtttctttttataattttaataatggtttatttatactggcagagaaacattacattgtacattgtgctttggctaattcatttgtctttgtgtatgttaacaaattatgatgttagaaatacattcataatcaaaatatttcactacagattaggatgaaggtagaggtctaggacattactagttttcttgtgttagaaatgaccttatatttttagattactatttcttaggcaacactctataaagtaaatatttggaactttatctgagtagagaacattgcaatggtgttcagataattaggcaaacatcacctgagctgtcttttactggatacataaaataggaggctgttttgagccatcctaaatcttatatgcagtttcattttaaaaagagagagaaagactgattggcctcagtaatctgtcaaattctagtgtgggcaattaaatctttttatttttaaatctttcacttcttataattgtatacactttagacagttcttctcacagttatagagacaacatttgatattggaacccatctcaatcaagaatggttactttgcagtactgattaatattgaatctctatagagtttttctaaaaacaaatgacaaatgaatatatatgcacatatgtaacagatttctttcaaaaccccaaaatcattgtcattaaatgttgccatgagaatccttgaaaccttcagaatgagccatttggggtagtaattgtcactttaatgatagaattatagagatggcctaaagcgtgatttgtgattttctgaacctgtgccacatttcagcgttcacctcctgtttagagcaaggaaggctgagaagaggtgactggctcctgattgagtattttgaaatgtcagtcctctaaacccctgaactctgtgtgacagtagttgggaaatgttcatcttccagttgcaaggaaaagtcaataatacaaagggaaaatcttcacagttcagattgatggccaaatacaaaaagcatgtccacacccactctaatcaattttttctctaagttgcccgttatgtgtgaaactaagagtattgctctgtttctgtagggtcgtatccttttctcacaagtctggggagaaaaagattcactgtaatgaaaaatggacagttacacgctaaatattgccaactacttagcagtctgagagtcaggaacctgaatgttcatttgataaatactctcccagagaggttcaaatatgtaaatgaacttttattttaatatactccttttgtggggaaattggtttttttattactttcctatagatctctgataagaaagtagaaatagtcaaatgttattcatttcaatgaacttttggaagtctgcaattagtgtttttggtaaataaactgttttagagctctccataaaaggaaatcaaatatagagatactattagatttgaaaaagacagacaggaaagaggcaaacgtgcagaatgaattctgacacacccgggtgcatttttctgcgggttctgacttaagtgtgtactgtctgcagttctctgaacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattggtatgtatttgttttggctgttacctttattaattaaaatgtagtcatttaaatcttattgctcaggcatataacacacacactcatttaaatagatcctatggactgagagggattaagttcttttagtttaaatagaatctactaaaaaccttttcagcagacaggatttgtagaactgtcgtttaatttctctctttcaaaaatatagtgcattctttctttttttctgaaataacatagacattcatttactggaggctgtaaaaagcacacaagcacttaataactactgatttttttttcattttcagtttatgcagtccatactacatactcctgtaaataaataacatatttaagactcactgttataataccaataaataaataataaccctttgtactgatttttattattcttccagctaagctagattgttcttcttatgaaaattacatatctagaacttcatgaaattatcctaaaacatacattcagagtatgttttctaagaatgaacttatttaaaaccactcattccatgctgagtctctagaacaaacatttaattttatgacactaatatttgcaaaattttgggaagaaatattcttaatacggaatacaacacaatagtaaaagattttctgtgtgattttcttgatacttaattgcaagctttcattataccattttgggattaacactttaaaaagtaaaataacaaatttactttttcctgttattagtatattccccttaaaggggtgtgtgtgtgaatgtgtgtgagtgcacatacatacatacacacagtttgttgccattgaggatggactctggaaccagactgctagagtttgaattctagttctatcatttgttacctgtgtggccttaggcaaattacttgcctattttggcctcattttcttaatgaggaaaataaggataataataataccacctactctatagaattgttgtaatgattaattgaactaatgcatgaatagtgcttagcatttagtaagtaccatcatatacatatataaactattattagagtattgagcttagcatagaggacctatcctcaaataattaccttacttcaaatttccccataaacagcaaaattgaacacaaaattctatggtgaatcctttctttctagtaaaattattcagtctaattatttgctgtttccagccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatataaatgcattgaaatgagatttaagccaaactcatcatactcatggaagattcgtagccatttcctggccagggatttgtgcactggagggcagtctgggcactttgctcacatcattgttggtaatgccttttgagaaaataattgttccaaggtcatggtctctgcttacagcaaacctctgaatctctgagtaatagccatggtgttcagatcagtgattgattttgagagtgggaaatgtcaagcatctccaaccctggtatcctgactattttatttgcatacattaaagggtatgagtgaccaccagtgtggtctaacttaagtcaacaggctatgccactttccacaccttcagaccaccagaaacacttagaaacgtgctttccagagaggctgatagaaaatatgggatgtgaattagatgttctccaaggtcacacctagttctaatattctaagaattaaatttagagtaaaaagaatggtctcactacttacacagtgatcttgagtatctttcttaaccattccccagactgcttcttcctcaatgaaaaggggttattaaaatatgcaacacatatctcactgagttggtttgagtctcaacctcctgaaagaaaaggtagacatctggctgggcgaggtagctcacgcctgtaatcccagcactttgggaggctgaggtgggtggatcacgaggtcaggagctcgagatcatcctggtcaacatggccaaactccatctctactaaaactacaaaaataagctgggcatggtggcacgtgcctgtaatcccagctactcaggaggttgaggcaggagaattgcttgaaccagagagtcagaggttgcagtgagctgaaatcataccacagcattccagcctggttggcaacaaagcaagactctgtctcagaaaaggtagacatctttggaaccagagaaaacctatttcccaaagtcttaaaaattatagtattttgggggagtcttctacctggctgaccccaatcttgcaaatcatcatttttttcctgctatttccctctgacaaaatatcagtatactgacatcctaaactttagaatttaaagagaactcagtaagttgagaagagctgctaatggaatatatgtgtacatatatacatatatacatacacatacacacgtatgtatgtatgctagatgattatttgtacgtgtacatatatgtgtgcattaagaaatatatgtatatacacatacatgcacacaaagactcatacacatatgatagggaagagagaagctatttatatgtgataacatatttgccaaagttgaattactgaagtctacaaatctagaaattgcatgagaatttaagagtagaagcacccttttgaaattaagtctttatgcaaaatcccatgccataattttcaacaactgctagacacatttacttagccagttgtgctaagttggagtttaagattatcagtgttaatgtctagaaaatgcatggtttatttgtggagagttaatgccatttcaaaagacttttccataatggtacagtttagaggtatttcatttaaagaatgttttcctttcatgcctgatcattgtcttcttttacttcatatggtttgagacataaggtaagatttcagaattgggattcagttgggagtatatatttagtgttaatcatatagacattctgtagtacatataaaagaatatgtgatgcaatgactagtaggtctggaatcttagatataattgctggttcagagaccttaagatgtttctaaaacctgagctatggagaaaataaaggtttgcaaaaatgtatttgagaaacattgaggataatgaattctctattaagtaacagtcactttaaaagtattaagatgctgctgaaaaaaaaatcttagatagaacactcactacttctctttagaatctatttttaattggaaaagacaattatttttctactttgagcttaaactcaatcctacttaaaaacaagggaggccaggagtagtggctcatgcctgtaatcccagcactttgggaggccaaggcgggtggatcacctgaggtcaggagttcaagaccatcctggccaacatggtgaaaccctgtctctactaaaaatacaaaaattagccgggcatggtggcgagcacctgtaatcccagctactcgggaggctgaggcacaagaattgcttcaacccgggaggcggaagttgcagtgagctaagatttcaccactgcactccagcctgggcgacagagcaagactctgtctcaaaaaaaaaaaaaaaaaaaaaaaaaagggaagagatacatgatttattctattcatttcaaaatctaactaattgtacagtgacttcatactcaccttttactttgaagttaaaaaaaaactagaaaatatgaaacatttactgtgcaccaggcactgttccaagtgcttgtcttatagcaatacatttaatcctctcaccaatcctatgaggtagatactattagttaccttattttatagaggagaaaactgaggcatgaagaactaaggtaatttgtacaaagacaagttatggagacatgtttcaaacccaagcagtcttattttagagcctgtacttttaatcattacattataacaaagtgaacaagtaaaaggtaaacttagtttatatcgaacttagacttggatagaaatattatgttaaaaataagattcatagaaatcagtaaacttgaatcaggacccaaaaacttattggcaaaaataattaaaactgggtgttttctttcaattttgatttcactattaaaataataatttaatctttaacactagctctaattttagaaaatgattcttttctgtatcttggtgagtatgtatagttgtaagcctttttttttagggccagtatgttttttgcaatgtaggacacagttaatatccatctattactttgaattaagttcattcaatatgtatgtattcattttcatttgaaaggcataatgattgacccacccacacaatatcaaattagaccatgcatttgaaatagtgattgacatgttttatatttgatgctttgtaaaatatattttttcaagtaggaaataccctgtgtgaaacccctctgatctcagtcctagatttgaacacccaaacttaggtttcttaaaacttgcattcgcttttatgtcaccctttggagattaaataattatatagaatcagagactcaacagtatcctcttccttattagtagtctaagcacaaactttattgtcggttttctgcctttggcttcctgtgcccttgatgttcccatgagttttgccgccaagattgtagacagataaagccagaattacttttttaaaaggcatgtgaacatcattagcagctaacaggtggtgatttcgttgtccagtttgtctatataacatgggaaaaatatgttctctcaatgagtgaattcagaaagttatgtttacatatacttttcttttaaaaaatatgattctaacctgccaacactattaagaacgaatcagatattttaagatatcagttgagtctaacagacaagaagccagaaaatttaatgcaagggccaaatcactgtgggaaactcaggacaccagcctgggatgagagtaggagagcagctctccagggagggctgttatggaaagtggagagtcaatcaaagaagatgtgaacatatttctctgaggaaagagaattgtcttccactgacagcaaagagggggaaggcccaaatataataaatcttgcatcagataaccttggcgaggtttcttaacttttctgagctttactttccacatctataaaaatgggtctaatactgtccttaaaggatcgtgtgagaatttgaaattagacatgtaaatacttagctcatagcaggcactcagtaagtaggagctcttattattatcctccatgtccccaagcagatagcactgagacagggcttgagcctggtggtggttgatgaaagactggagcagggcatataagcttgccatcctactccctgagtgtatgaaaggtagaaaaagggtaccagaattggatatgggagtcatagctgcaaaaaatctaagtacgagcagctggtctttcccctggcaactcccatgtaaaaggggcaggtagggcattcttgggagcagcacaccaggaaacagtagaaaggagccaagaaacactcttgattctcctaaacccagaaaagcatgccattcagaaattcaagttgatgggaaggattcagcattagccatctcactattcctttacacaaagttctagtttattcattcatacacacattaattcttttttatgaagaaatacaactaaaggtatacaactaaaattcttgatttcactcatctgtgctttcaatttttaaaaaataacttttgtatgtaggttatgctttagtagtaatatatctcatacctatcaattgctaaactgtaaaatccatgagtgtggagaccttggataacttgaaaataaaactgacactttagtattggaaataagcaccctgaaatgaacatgagttagaagactaaagtcaaaaggtaagagagctaaaaggaaatgggttttcctttagctgtctcttgattaagttatcataaaaaacaaatgtgttctgggtgaaatcctaaatgcatatgtggatttcccaaatctacgttctcttaatgacatgtgcaataagggtatatgtaatatgtttctaataattagggtatatgtatttaaatgtgcatttcccagttccatatccccttaatgatgtgtgcaataagacaacagaaagaaaaaacttgaattgagagagttacacaataaaaattaaaatgctacggacttttaacttgtctttgtttaaaaaatttgcctgcaaagtatcatgaccatgccaagtgatgaaaacaagtttgatagagaaaacattaattttttgtactaatctaaataattataatactggtcttctacaactataagtaggctatgttctcaaaatccaattgtaaattggttgcttagacctggtatgttttcacaaggaaaccatgtaccaagccacaaaagcacacttgaactttctgcagtcacttacaatgttgtttctagggaacaactcattctgaatttgctgcacctctggccctgagagctaagacttcccagtagcattgctttcgatctagtttccggtctagatccccacttctgtaccgtctccaccaaagcgattaggagactcagaatggcttttgcttttgctaggattctggtgagccctgaaagtccccagtagtggcagggagggaatttaaagcctccgagccggaagaaataatagaaaaaggagagaattgaggactgggtaggcagcttttgtagcattaatgggaagtgagtccttagcaagacagatgttctttgtaaaaagtatgtgtaatgacagattaagtctggaattgtcccaaatataaacatttgatgaatctaggtggtgcataggcaagtgatcatgatcctattgtttcatttttttttgtatgtttgaaaagttctccagttaaaaattgaagtaaacgcacatacccacacaaaagtaggtatgtccatgtgcctaattcaataaaagaatatacatattttctgattatgacctgaacctttcaaagaaagatcaaattttctgaatataagttacattaagacctctttacatgaaacattgataactcattgttttcctattttcctccaaaaccaatatatttttttcctgtgaccattgagacctttctgggaactatgtaattaagaaaacttttaagatatttattattatccaaaattaaaaagtcacacgagtttcttggataaatatgtaattatcaattgttaaaacacatactgtgaagcctgttctggaggctcatataaatacatattttaaagttttttcttattaagaattttgtgtaaaacagtctaatcctgccaatgtatgaaaataataagatgaacaaaccatctgccaaggaaatgaaaacagtattaaaattgcacagataaaccatatctagttctgaagaaatggaagagctctttcctggaaaaacaaaaaagtcgtgacatttttgtagaatatcatgggttattatattatcaagaggacaaagttttctgatttgggtgagagggtcactcacccttttttttttttccccaaaataactagcgccactctggtaccagttttattcaaaaccctcttgagaaaaataaactattgagctaaaatgtggaaacaaatcacttcatattactatacttataagacagacaatatctaaagaatagttgagtgtcacttgtcttttcagttgtttttcacaggttgagagttacttatttcaaaatagttggtaaagaaaaaaattgaaaaattataaatgacatttatgttgttaaagctgcaagatgtaaacatcatgagaggaaaagagtaaaaattagacacatttgatagtcaagcatccacattaatttatcagaatagtattatgcatgaaggtcccaggcttcactatggccctgtgtgactctagccattgttctgacatatgttcccaagcagcagtacctactttttctgggacccgtagattgcactttcttcaaaacattcagttttcaatgaatcatttgataagaggacttcattatgagctgagcaaagaatgtcctgattaatctcttctttcccatctaaggggctgatctcgccctctgacctgtggatgtccattgtcgtgtatctcatagcatcagctactctgaaagtccacctaaccctctcagtgctcaagcactagatcaccctatcttccttctgaccctggcaataacaccatgagcatatttccccttagatgaactgcatttaatcaatttctgatttcattaggtcaaatggcatcttgctttcaataatagggcaaatccagagggctctttgctctaactctcaagcaatattttattggcattaatacactactgtgattgtaaacaaaagaaaaaaaaagatctttggtatcctcagaaagtgtccttttgtttattccatgactttaaaatgggcgtatattaatgttttcttataaagttaggcatataatcatcattcattgttgtcacagcagatttaaagaatctttgctaaagctgacatttaagcatttaaggtgtttgtacagtgaatccatgtgcagagcaaaacattattttgaatgcaaatgatcacctctttctgtatacaggatttatttggtcaattcctttttgtttctgaagtatggtaacttacgctactttccttcaaaattctaaagaagtaatttgctttttgatggatttatttggatgtcccaaataggcctaataacatgcttgggggaaaaaaaaaatccgttgttaacacatggaatctttgagattttcttgtaaaataagtttcttattactcatagtatagccctcactaaacaaaatcagatattgctttcacccaaaagtattagatgaacccagaaataccagatgttttcatcaaactttaataaagtgagatctgtaacattaggattcctagctttcttcaagaaatggctcatggatgacttgagaaacctaaagcaatctgccaatacatctttctttggttatttaagtagtacctgaaatcagttgttcctgctacccaattttcctaatgtaaataaatataccctatttgtatacaaaattaattggcctaaaaaggtagaggactagataggaaatgccataaccaagtagaaaatataggactgggattttgctgtcagataaggtcttctccaaaattgaagtcaaagattaagaacaattatttttttttttttttttttttttttgagaaggagtctcactctgtcacacaggcttgagtgcaatggcgtggtcttggctcactacaacctccgcctcccaagttcaagtgattctcctgcctcagcctccctagtagctgggactacaggctcgggcaacaccacgcctggctaatttttgtatttttagtagagatgcgatttcactctgttggccaggcaggtatcgacctcctgacctcacgatctgcccaccttggcctcccaaagtgctaggattacaggcgtgagccgctgcacccagccagattaagaacaatttctaatgactgcattggaattattgctcttggaattagagtccaagtttctgtatagaaagctcattatgatctgtgccccttctccagttttttttcatcactccctgacccataatttatgttccaggtaaatagtccctataatacctgatgcacactgctacatgctgacttttaccttgaaatcagggttatctctttacaaagttaacatcctttaggactcagcccagatcatacttcccaatattcccatcatccattctaacaccctattttatttgaaagagttactgtgattcatagttattcttgcagctcttctgtgggctctgacttggaattttcaagtttctattggaggcaataaaagaaaaagaaactctgtaatatataacaaataattacagtaattttgattatttttataagactgagaatacttttctctagtgtcagcttatttgtaaaaatccagtttaacacaaaagttatcaaagtgttagccctcagaaccctgttcaaaaggttgtatgagattgtgtaagaaatttgagtctgagagtcagaaaatttgagtacagttcttaactccaagatatacagccatatgactttgacaagtttcttaagtttcttgaaattgagtttccagataaatataatatatattttatataattataaaatattataaatgtaaatgttgattatctaaaaagattatatatgtatttgatctagagaaaatgtatatagtggatctaaaatatatcaaataactttgtagattatatattatgttataaaatgatttccatctgggtaaattctgagtaaaataatcatgacttttgtttgtttactataaatctaccaatttagaaatatagcaagaatgtacttttgcaactgttgaaacagttgccaaaatgcagcataaacaaatgcgtaattttttgaaggcttaatttcttaatatcttcattattttattgactctggttaacatatatccttttaccttttgttttcttaagggatcctaagtgtcatggggaataaatgcttggttttgtcattcctgagtgtgagcctgacacgatggcaatctctagagattaaagtttgtcaagtgtctgttgccatttccattcttttttttttttatttaagttttagggtacatgtgcacaatgtgcaggttagttacatatgtatacatgtgccatgctggtgcgctgcaccccttaactcgtcatctagcattaggtatatctcccaatgctatccctcccccctccccccaccccacaacagtccccagactgtgatgttccccttcctgtgtccatgtgttctcattgttcagttcccacctatgagtgagaatatgcagtgtttgggtttttgttcttgcaatagtttgctgagaatgatgatttccaatttcatccatgtccctacaaaggacatgaactcctcatttttatggctgcatagtattccatggtgtatatgtgccacattttcttaatccagtctatcattgttggacatttgggttggttccaagtctttgctattgtgaatagtcccgcaataaacatacgtgtgcatgtgtctttatagcagcatgatttatagtcctttgggtatatacccagtaatgggctgggtaaaatggtatttctagttctagggccatttccattcttatagaaaatagtaaaataatacaagggtagaattttgacagagagttatgtaaattcacttaaaagcaaggaaagattttatttaattttaatgtttaaataatacatattagaatcaactcagtgtcatgaagcatctggtgataaaaagatgggttttgttgactaaagtaaacatattatacaaatcacatggatattgagccacttataaggagtaaactgaaaaccactgaaagtctggtctcaccaaactatagtgtattgatcagctggcaagggatgcccaccatgttcactgtatcaaaaggattgtgatatctgagttctggggagtaatcctagctgacctagcttcagtcattagcttaaaccaggaccactctattccattagactgcaagtgcctggaggtataagccaagaccttctgctaattacccctccctatccccatcactcagaacagagtctgaaacctagtggtgttcagaattattagcttggctcaaaagtaattgcagttttgccattttttaaacctcgtttacttttgcactgacgaataaatgtctgagtgagtgaggaaacaagtgaccgagagcatgagaggggaaccctgaagaaacccttacagattttatgcatgaggaatgaagggaaaggctgaactgtgaggcactgtcctgttgatgggtgttttggtttgggttcctccagaagcagtccctgagacaaagatttgatcacaggtaatatatttggaagtgatccctggacacacataggtaggggctggcagaagagagccagggaagagaacatacctatgaaggagaataaaaggtttatggagtttaatgctgctgtggaactctagcagtttttcagatggagaaacaaggaatgacagagaagagcatggatagacttttgtacaggaaggaaagaaccatagagcataaaatagttgaagagcacaatagattggtgaggctggaatgtgcaaaacattggggcaacaactggagatcaggttggaaatgaagagtgaaccattggcaaagggtctctcacggaatgctaaaaaattaggacttttcactataaataatgggagcctagtgaaagacttcaatgcaggcaagagacatgaacagatttgatttttagagtaataattttggggaaaatgtggagaatggcagagataggtagcacagagtgagagatcagaggtaagaagatgaattcagagatcagaggtaaggagatgaattcagagactattagaatagaccatgtaccatatgctgcaggtccaaactaggcagtaggaataggtgaagaagaaagattccagagatatctgacttgatattgataggttttcttgacatatattgtaagtcttggcagctcccaaatacccattgcctctgtggtttggaaaacaaccatcaggatgccaaggagctaagcagaatctcattctttcaggagcctactagattcttgttactctagatataatccatggaccaacaatgacaatatcacctaggagcttgttagtaaatatggcctctccagcccaaccccaaaccaactgaactgaatctgcattttaacaggtgattcccatgcacattaaaatttgaaaaaaacattaccatatgacataaataacttctttaaagaggtttttgaaagtccagagccaaagggtggcctttgggacttggacaaaagacctactcatataaaagagctatcttgtcggcctttgtgtaaaataaccctgcatatggttattatattggtcatgctatgacaatgcatgattttgaatggtggctatttaatctcatcaatcccttccaacccatgattacggactaaatgagaaagaaccaagacttacactgccttgtaacttttgcctgtgccacacctaagtcagaaattctgaactcccacatcaaaaagtcaacagtcccagccaaagaacagcaacaatatcaaaaaatgattctgagcctaaactaccctcaccaaaacagacaaacaagaaaccaaagctccaagcaattccctggaaattatccattaattccctggatagctcaatgtgcaaaatccatttgaaattctacttatcccttatcttccatttgactcttcttttcggaacacataatctcacatgtagcctctttttgttatttcccttctcaagcaagaataatagtatttgattgcttaaatttctttatttttatgttgttcttgagtacttgaattcatttcccattggcctttcaggttagatgttaaaattctggatgagcagcaacgtagctgttttactcgtagactaagtttatttgctgcacctgccaaaagaatcaaggcccaccaggctgcacttcagtcaagctgttttgaaaaattgcaaagaaaacaaaagtaggcccacaatttcacaatttagttatcaaaaaatagaggaaagattcaaaataaagtctgattaaccctcttagtagggtgagatttcacttactgggaagaactgataatgattatttctgaaataaaacctcattttttttcatgtctacctttttttaattataggaaatggaaaccaaaatgggcaaataatcattcttttctcagtaagaatctttctcataaatttgcccctaaaatgtccagtcttttaaaaatgttttggacagtaatgagacaggtctgaaagagatgccttaaaattttagtagtgcctagattcacttcacttatttacctttcttactttaagacagcttacataagaataattaatctttttttttttcctagtgagtacctgggtttgttattgaggtttcataattaatctttttttttttttcctagtaggtacctgggtttgttactgaggtttcatgcttttttttttttttttaaatcgggcataaccataattgatttccacggaagggtttggctgaagacccaaagaatttttgcttaactcatttttattgaacgaaatccagaattttagtcaagaagcattagatattaatcacatatgagtggggtcattaaaatttcctttaccttccagaactgcaggtcattatggaatcataagaagcagtgagctcacttaatctttacaattacataaaagtgattattttcttaagtcttacaagaagctcttaactattagttgaagagcatgttggaatattagaacatctgtgttgtgttattatagatgtgacttgtgaattaaaaaaaaattctctgactcaaaactcttagaagttaccctttccagcttgaatagttttaattctttaacacagtttgggagtatatattttttacctcgcaagtagagaccttgttgctgaaatataaattccagtatcatttcttaattattacactctcaactttatagaaaatcagaggaacttcacaggttctaaagattaggaaaaaaagaagaagaaaattagaggagaaatgcaattttttttactgcacttaagaataacagttggtgacaatttaaggtgagtcagtttagggaaaaactgagacaaatccatcctctaaattattgttgcctgtctccatctttttcttgtaaccacttctcatctttgactttgaaacccaacagtttaaacttggttcttatttcagtgggctaatcccctttcataaatcttgctcaagagctgaaataatttgcacatcatttaaagagtatttgctttgaaatattcacctcaagcccttttgtatatcctctctctctaaagatttgtagtatttgttttgttctctgaggtataaaagacctggataaactttattcctgttgtttcaagattagttaacgaaaatgcatattaattcagcagggacggaaataaacctcagtaaagatgatcatacattcgcctctcggggatagcaaagtacaaaatgtcagtcttcaaatctccttggacttgctcaaaagagcatttggggatttaaatttccagaatatgtctacaaatgtattttctttgttgtggagaacagaagctatactgattatttttccccagaaaattgattctaatttgtgtttgaacaaaaattaagccatctagaaagtagcacttcaagaagacagaggaaaactgccactgaaaaggtaaatttaacattaaaaattatattcttgataagccactaaatttttagtttatttgtcatcagatcccaaatcccaggatagtttcacagaatttctgtatttttttctatgaaaaaattagaattgaaaggacctcagaaaatcaaaagtagacatatttaaatagagttaaatgttcctctgcatttataagctcaaattttaaagtttgttggtcagctcagaaaaaaaatacaaatttctctagataatatatttgtttcatatgttaagatgtgccctgtgtttttcttaaactgaaaatgaccataaacttttggcacttaagtgcttatccggaaatgactaagtggattcaggagtaataaatcactcatatggatccagccacccacagtcttgttccacttctcttctttacaagtgtagtaatagacatttccacagtcctcagggtgccgaactttgcaccattaggaaaatctgcaagtagcttgatttatcttcctcactcagttagctaagacccaactaactaaaaatcagcaggaatgaacttgacttgttaaacttttttaatagggagatgcaacaattacaactttcctcctttgccacttcaatttacattggatgtgaagcccctggtgaaaaatattcagatgagaactcaaattataggtgcatggctggatgatgctgactctaggttttcattatacacagagaatcgtctgctgtttgcaattaatccagacacaatcctcttggtactttgggaggaatgcggaagaaatagccattttataagttgtaaactcctaaattaccctaaattagagacactattaatcgaacactttgatataggtaggatctgcttattgtgtaggctcatcttcccctgatggagcaatcaattaaatatttaggatgtggaataccttccgggttggataatgcatttcatttaaattatggccctccaacccgaaacattaaaggggatcttaacggatggaagcacattactgtctcttggattgggcgcattaacactttaaaaatgaatgtgcttcccaggatttcctatttgttccaccagctgcctgtggatgtgccagataaacagtttaaggataagtatgtaaaagatgcatgtgtaactttttgtgtgctgaggtgcacccttgtagcaagagtcctcaactgtggcccctttggatttttttttttttttttgtctcaatgctgtagcagtctaaaatgagagtgctcatttgatcatgggagagtaggagggaaagccaacaaaagatgtaattagacttctgacaaaggttctgtctgtgtttaatcttttatcatttctacctataatttatcctaataaatagtgattattactagaaaatattgggatgatatagtagaattcaaaataagcataagctttcccattctaaaaatatttggcataaaggaaattatttaatttttacccaaggacaattactatgtcaaatttatgaacagtattgtaagaacagagttgttatgtctcccataccacggaagcatggtatagatatggtaaatactttagagagcttaccaggctgtaggcagcattctaagcactttaatctactctcattgaatcctgtcaaccctatgcagctcagtgacattattatcatccccattttatctattaagtgactgaggcactgaaaggttaatcaatttacacaaagttatataattaagaagtagctgagttagaatttgaaaccaagcagtctaacttcacagcctggaaccacaaaccactgtgtagcatccggcttctggagtgaggttgatggtttctgcaatttactagctctacaaactttgagccagtcacttaacctcactaagctactgttttataatcttaaaaatgtcaataataatagtatctacctcacagagttgattggaagcataaattagattaagtaatgtaacgtttatagcattgtttgggagaatgtaagtactcaataaatgttaatcataacgttagtacaagtattttcttttcttccatagtatttggaaaagttctcctaatttggttaagaaaatgttatcttaaagataaatgattgaaattcctagagattaatgtattttccaaaatgtctttggacttacaggggaaaaatagtatattgagtgccttacagaaggctataaacttcctgaaccatgagtctgttttcattcattttccatttataaaagtcttgattcactattaacataatacataaatatatcatattagcttactgagtgaaaacaaatttatccaatcggaaaaaaaaaaaaagatgttaaagataggggtcaatttctttgtttcccagagacaggcttttcatatcaaatctgatagaacacatgcttcagaagggagcagaaaactcagctaactggtataattatgtaactcaaatggtcatattgagagggttaaactttggcaatagaatgtggaaatacaaagttcaatgaagttgtaggaatttaactgaaaagaaattacttatcagcattttgatggggaataaacaaacaaaagaaacaaattggtcctttcaaagttgggtggaaagaatgttcctgaagccttccttagtaatcaccgtcattgagaggccctgaggactcgtatctgtagtaattgatacctagtcctcatgctcaaggaggaagacaactggtatttatgggcttgtcaagaaaggaattagttggaattcctttttctactccatctttcactagtctttattgagccaagtttattgtaagttaggggtgaatcatacagatacctttactctttcaatatgctaagaaaacaattgggatgaaaagagaatctgatattttaaacaccaagcaatgtgttttatttggctgggaatacagtcttatgggcaatcactgtatatttatctgtttgcttgtttatttggaagtcctaccagtggagtaaagctcctcatctattgagctctgatcttcttccactgaacagatagaaaggaaaggccttagacagaattataataaaggtgtatgaggcaactcaggctcaaccagaaagatcagccaatcaactctgaaaaccaacaaagatgcaagttgcacagagcaatactcctcctaatatttttcttacgttcataatatgggtggattaataatttttctgtgttgtaatatattcataatacaagcggattaactcagattaaaatgctctatatctggtgaatgagggaagacaaaataggccctaaaaatgggaatgcttatttagggaacaaacaaagatgacgtaaactctaaaaagctggagtactcagagcaagaactcagttcacacattcacatcacagacatttgtaggggagttgctttgtgcatgcactgttttaagcactggagttaaagagactccaaatgttatcaattccacattaacaaagagagtttgttactggaaggggctcccaatccagaccccaagacagggttcttggacctcgcgcaagaaagaatctgaggtgagtccacagagtaaagcaaaagcaagattattaaggaagtaaaggaataaaagaatagctactccatagagccgttctgagggctgctggttggctatttttattgtcgtttcttgattatatgctaaacaaggtgtggcttattcattagttttcaaggaaagaggtgagcaattcccggaactttttagaacatgctaaaggacatactaaaagacatttagcatgctgatgcattatagttagtgtataaggagcagtaaggacgaccaaaggtcactttcattgccatcttggttttggtgggatttggctggcttctttaccacatccttttatcagcaaggtctttgtgacctataccttgtactgacctcctatctcatcctgtgactaagaatatcttaaactcttgggattgcagccccagaggttttatccttattttacccagccgctattcaagatggagttgctctggttcaaacacctctgacatttatggtcaaattttaggtagctatttcccattctctaacaagttgatttaatttaaagatgattatacacatgatgaaatactgttaaaatattcctgcttgattttattaacaaaacgaatatagtattttgatctaatttacatgtctagctcatattgaattttttaagaaatttcgcatttacattaggtccaaactctcatctatggagtattaagtagcgccatgaccacagtccaccaaagtgtttaaaaggaaaaaagtttaataaatcaaaatgctccaatcttgagtcctggtgtctttttttaaaatcccaaatggtctggaggctgacattatttcctggctggccctaggagggaggatctgtcacttgttagtaatagacacagagttaaatgacctggagacctgccattaggaagcaaatactacccattatttaagtccagaggagggcagctcacctgagtatccagctgcactgtaataatgacgaatctgggtggtagagccagaagcctcagcttaaatcctgacgctgccagaacctacatttggcttatgcaaaatttcctcaaagactggcagtgagggctaaataacttagcccctgaaagttctcagaatagtgtctggagtatagtaagttttcattaaatgttggctattaacattgagacttctgttagaccaaatataacagtccatacaacttgcagaatattgaaaacaaaatggtaaacatataaatgacagagggcaacttaattggaggttgtagagaaatatttagaatcattaaaaatgaaatcattttgaattttctattgtgttacatactaaaattaacattaggaaacaatgtgaagtaaaggtgtagagtgaaatggctaaacttattttcataaagtgaaagcatttcccttccaaaaagaaaaaaattgtaatcaatctatatatattagtatcagtatgaattaaaaaaataaaattttgtattcaccatgagctgttctaagcatgtagcatgtattttctcatcttcaagacagttatatgttaataattttatattcatttacagaggaggaaacacagatatttagttttggagtctagattataacttcagcagtctaaatcagaacacattctattataccttttataggctttgtataattttccttttgtaacttgcctttaagttttatttgttattatatataagtaattatgttattaaattgtgtacatgtgttttgaaagacagatttgtgcagatataatgcatgtatgtctatagtatataaaaataaattttaaggggcatattgacagatggaaaaagcataaatgtcaaagaaagttgatttagaaattaatatataataaaaattaaactagcatttattaatttaacagatggtgagttaaaaagtaaaaacaaaatctcgaatcgtaacttgatttttacaattagtgtgattatttcacaaacttattcaaaagtttgctattttcttgttctatttaaaagaaaaaagctcccatctcaaagtttccaccaaataatttactactttcatttaacagattctgttcagaaatctgcatatgtacaaatgagcaccagaatataaaatttaatcatagaccaacatccaaaaaattatagtggatgtaggtgaggcatgctagctcatgcctgtaaccccagcactttaggagatagagactagaggatcacttgaggccaaaagttaaagaccagcctagccaacatagtaagacccagtctccacaaaaaataaaatacaaaacaattagctggacatggtagcatgcacctgtagtcccaggaggctgagggaacttacttgagcccaggagtttgaggttacagtgattatgccactgcactccagcctgggcaacagagtgaaaccctgtgttgtttttttttaatatatatatatttatgatgtaaaactatattttacatatttatattgttgactaatatatattataatttatactataaatacaaatattggacattgtttttaaatacccacagtatttattattaactatatactaaatccacaaaattatacatgcaaaaattattttaaaatgtgatctgtgtaagatataaaaaattgataacaagaaattaacaaaataccccaagtaccttattaatttaaaaattttctgtcaattgcttttgtcttaaggataaatccaatatcaaatttaatagtatgcaaccaaaataatattcagaggcaaatgcatagtattaaatgtttttaatattaaagaagtaaaacaattacataagaaatattttaggttaactaaacataactaaagaaatctgaggttagaaatgataaaataaagaaaaatcaatcacatgtaaaacaaaaaaatattattgcactaaaagttatttggaaagtagtctcttaggaatgaaataaaaataactctgaaaatctaattttagagaacataaagaaactagaaggacataagaaaaactagaatatttgaacatacatcttcaaaatctccctcaaaaaggtcccaggtctaaagatttactagtgaatgatgttaatcttctaactggtaattttcatgtcatttgaaagcacacaaataatcagtgagtaaaattttcaaatactcaagtaatgatcaaggaactgaaaaataaagcaacagacacatgccaacaccgctgtgtctgcagctatagtgaacggcatcaggatggtctgaaggcacttgaaatctaagtaggaccagagctttgacccttgttttccaggaaattccttcagggagacagttactgagacctgcgcaatgactctgcgcactacctgcagtgtgttcagagaccatttaaagggaaggagattcctgctgaagggccggtgatcatgggccagaggaaagaaaaatctgaaagttcttcgtgtccttgacatttgaaaatggactcttcaaatggggaacttgagaactctggctcttgtcaattaagatcattaagatagacatcattcggatgaatagtttagtgaggagaaaatttattccctcctttataatgttttcctctcctttgctaatgaaccattacattttgctttgaagttatgactcagctgttttgacattttcatagtgaccaaatatgccaaaatagagcaatttttttggaagaaaatatttgcaatacttggattgtgatcagcttgaggtaatatatgtaaaaaatggtaaacttgtcataatgcttagggtcacctgacctcttaaatgtagctgtttggtacatgatactaattttttttcttcttaatttaagcaactgactagaacttctttagtctcagtgaggtcatgctctcaaaaggcatattgccagctggtctcaatgcttggaggcatagttgtaaatttttatacagcaccttaagagtttttaaggttgctagtggcttcaattaaagaccacatttaatagattaacaagggatgccagattaagacttgaaaactttaagcaagtcacagtgaatttaagaaagttgcagtggggtataggaaatagaatgatttgagtagctaatgaaaaagagttgcaaagatttgtttttgccagcatccaatccaagttttaggatcaaggtaccactatctgattaaaatgccaaaatggtgcatctggttaaatggggggtggggggaaggatgctttatttgccttgtttcccatccttctcagtaacatttctaatcacaaagatgattagctctatcatttaaaaataaaactaaagtaagaaagtggcatattaatagttttcataaatcttatcaactactatatttcattgcatcataatcatgtagatataaaagcatgtgtgtgcccactcaggggtgtatataagtattttatctgtattgcatacctatgctttctgtatacaatatttggaaatacacactgaaagccttagaaatatgtgtactcttaattttttaaaaaaaagattgtactcctcaaacgatttcagttcttaaaatccattcaaagaaaactaaaagtctgaattgaagtgttttttgatcatagtgaaaaatttgaaataatctacctgtccaacagtgggcctttgtttaaaaaatcatggtgtatccctatgatggtatatatgtaatcaaaaacatttaagttttcaaagaaaattgtggaagcataattctaagtatgaagcatacttagaataaacgtgcataatgtgaagtatgggagagggatacaaaacttgtttgatatgaagtattaaagcagaggcctggtctgcttggccagagatgcatccctgcataaagtaagggctcattaaatatctgttaaataagtgaatgagtataggatgtaaaagaaaaatagcaacagcaactctaagtaatacagtgatcatgggtttactttgttttcttctctagtctccctccctaagtcttctaaattttccataataaatgtttgtttccaatatcagaaatagtataaaatatagcacaattgtgatggatgatgagcaagattattagtggaaatatatctcacaaagtgtgtactatgttttgcccatgaatatttggctcttctcttctgaaattcaaaactctgaggtttgctcacacgaatttttttccccacacttcaccagcccttgacatgtgactacaatatgtattttttgctactagttttattcatttcattttatcctctgcattcttgaaggcatgaatgacagacatctggaaaatatatatatatctagacactgaaaacataatttcttatcaaagagctggaatataaacatctagaagacaaagtatctgaataatgttaaattagaatctttattttatactaaccagatctcaaatatgaagcacaaattgtggtttattgcttgatatgtaattgcattagggttatcattctttttaatatcattttttccctcagttggattttatccaagaagtgatataatgtgctaggaagactttacctaaactttgatgcttttaaacaacatgtatgtgggactcctcctctctttgataagaagaaaatgggaaaatgaagagaaagctgaaacattaccattttaggggaaacttaggaaaggaacccagagtgggcagcttccaggggcagtttcaccattcttgtcagaagggaacagacacatagaatgtaaataacatacccaatattgactatgggaatagaggccccttctgccttccttttatttgaagtaaaatgtttgccccttcctcaggcttcaaattgcttagagcatctagaagacttggctgggcatggtggcgcacgcctgtaatcccaacactttgagaggccaaagcagatggatcgcctcgggtcaggagtttgagaccagcctggccaacatggtgaaaccctgtctgtactaaaaatataaaaattagccaggcacggtggcgcacacctgtaatcccagctactcgggatgctgaggcaggagaatcgcttgaatccaggagacagaagttgcagtcgcaccactgcattctagcctgggctacagaatgagactctgtctctcaaaaaaaaaaaaaaaaaaaaaaaaacagaactcaagcccacctttacattaaaatccttaaacaatttcttttgatgtggcgtattctattagactactcttatacgttgaacacaactgtggggtagtgaagttgtgatgtagaaactctgtttccttgaacttagtgctaactttagggagcacagatattaacatttcttcatttgggctaaatgttataagaacaatataaacactagaggattttagcttcaccaccattcgagaaaattggttttactcccaccattaaaaggaagcaatctaaagtaaaggaatcgatctataagtgtaagaacaacagcaaatttatcaggaaaatgtttaaacagacaaattaaccatttttcagtgtccattttcttcattatgaccaaggatatccttgactgtaaagaaaaattcaattatttgccaaaccgtaggtgctaatcctgtttctgcagttgtctgtaaatagaattcccctttgcagtgccgttttctgcatggtaccttaaacaaataggtcttagcaatagttccaataggattggaggttcaccattaaaaatagacttatcggcctgctgctgtggctcatgcctgtaatcccagcactttgggaggcagagtaaggctgatcgcttgagcagcctgggcaacatggcaaaaccccatctctacaaaaaatacaaaaattagccgggaatggtggtgcgcagctactcggagtagttccagctactcaggaggctgaggtgggaggatgacttgagcctgggaggcggaggttacagtgagtcaaggtcatgcctctgcactccagcctgggcaatagagccagaacttgtctcaataaaataaaatagacttattaccaggtgcacatgatatgtaaagttggttgtgtaaagtaaataaagtaaactataattgataggccatctccattctgctgggaattgttgtgttcacttgtttctaaaattttatttttgtggtggaagtttgcctctacaaaaatgacagcttacagttttaaactattggggaaaaaaaataaaactaaaagactacaaagaagaaatgattcctgaccattaagtcttctgcaatgccatgatagcaaaaaaaaggcacaaagttttactgaaggttagatacacctcacattcccagtagatatttacagaatctcatacatctattcattcaataagtgtgacactgtcctatgcactggagatacaataaacaaaatagatgagcgtccttctccaaaaatgtctcacatatgagggaatgctaaccttaaaatcaaagccatgtgcattgagtgttgaaaggtaaccaagactatacctaaccaacctacttttacaaaagacaaaagttagaccaaacagtcattgtagaatcactctgggttcaacagagaagcagtactactactagtaagatgtagtaagatggatggatggatggatggatggatggacagacggacagacagacagacaaaaagatttttccagttgcaggagcttgctatgcaagtctgaagttcataaagaaacagttagaaagggaagacacaaagtaggctggaactcccaaggcagaggctatttggggtctctgagcttagggaatatctaaaccaggcttgcttgtccaacctgcagcccctagtcctcctgtggcccaggatggctttgaatgcagcccaacacaaattcataaactttcttgaaacatgagatatttttgtgatttttttatttttagctcatcaactattgttagtgttagtgtattttatgtgtggcccaagacaattattcttcttccagtgtggcccagggagccaaatatactggaaaactctgataagcccactcctaggtagctcacctggcctagtctgatatatccataatatatatatattataggccgggtgcggtggctcacgcctgtaatcccagcactttgggaggccaaggcgggtggatcacttgaggtcaaaagtttgggactagcctggccaacatggggaaaccctgtctctactaaaaatagaaaaattagccaggtgtagtggcgggcacctgtaatcctatctactcaggaggctgaaacaggaaaatcactaaccctggaggcagaagttgtagtgagctgggatcatgccattgcattccaacctcgtaatcaagagcgaaactccatcttggggggtggggggggaagatgtcttatagataggggtgtctataataaatcagaacaggccagttgcaacctttttatctaaccatccatccagctatcctacatcttactggtagtggtactgcttctctgttgaacccaggatgattatacaatgcctttttggtctaaattttgccttttgtaaaataatataccttctgattaacttaaagtctgattattagagactttaatttcctctaaaaatttcttcacagcaccacctaaattggtgtgtgattgaatgactaggctatatagttcaccctagctaggttgacatattaaaaagccattacaggcacattcacttgcccagtgtcacacagctgtcaagtggctggaactaaaactgactcatttcctccccagttcattctgtgatgggcatacctatccaacattcacaccctccattctcctgttcttgaagacatctccattcaacagtaaaatgttgctttcaactacctcttaccctcttttcaaagaacaagattataaaatgacctgtaatagttggcatgtctataaatttaattatattttagtcaaaaccactcatttagctttgaattggtaaggctgatgacaaagccagtttggctagaacttctagagtctcggaaaaaataggctatttttctataagaaataaggtaacctatttattaaattgatagagaatcaaggtcaataattctttattccattttatttattttaatagtgacctagtaaagtagatataacttgatagaaataaagaatagactgaaaatataatcttatggaaaacaggtgtctagccttggagaaacagaacaaattacattagcgatttaagacatacaacaacatatcctaaaaagaattcttattaacatggcaaacattgccttaaaaagcataaataaataaataaatcctctgtatattcatgtaaatttggaaaactatgcttagtcttgccagacaagttatttatattactaaatataaatgacagaaatttctatgacaaattctagtcaagacaaacttctgttgcagtgaaaatgatgtaatcaagccgttttgcctctttacttgctgatagtcaaaacatctcaagaagtttgtgttggaggataatgacatttccagagatttctattataggctgtaccctcataatttttttgttctaattttgtctttatcataggtaatcatgatattaaaattctatcactattctttggattcctacattcccttaaagctttttattggaaaattttgctttatcttacataaaaatctttttcatcttatataaggcaattacgtcgtttttcacaatcaaatatttattataacaagttttattttttaaacttaaaaaacacccttcttttaaaatagttcctcacatgaataaaattgtttcactctttaagtgttgagactgaaagcctttctcccatcagtctctcaaaatgtttctattattcctcccttttaacccattgctattttctttccttcttccttaggtctccttaacctcctcctgttttttattttctctggttttccattaacattttaaaatacactttaatgagcctcagccaaaggctctaagatgaacaaaagcctggagaagagaatcaagagagggaggacaagaaggaaaagaggaatagtgggcactgctctcagttttaaacgaatttctgtggctggctctcacttttatagctggacctgaatgctacagcacttactaaggccactaaatcatagcaaagtaagggtctggctattaagaattggaccgtccttaaatcagggattattactgtaatctttacatttaaatattacatatatgggctattgaaaatgtagcaaatctgctcactgaaggcctttactctgttgatatctgcattttcagggtataactggcagtccttttaaatatctgttgtatttattttagcataaaggtaatgctttgtatttttttccagtttagaaatccaaatgctaatatatacatgcatatattacatgaaaaaagcataaaatacttgaaaacataattaccttttagatgctaataaagcaagaaaaataagttttttttttcttttcatcactactttttgacatgtcggccaataaaaatcaactaaagtttaccttctgttatattagcatcagtgactttctaatttgcttcactttctccatttgtgcttaggtatgacactttttgcaattccaaattcacatcacctctctagttcctctcttccaaaaagacaaaaagtcccttgcatgggttggatactctatgtctctgtttagggattcatttaacagataccccagcactgccagtaaacaaacggatgccttgaacagtgatggtttacaatggagactgacttctttctttatttccctgcattccaaaattttttttttttattttctttgtagtttgcctttgtcacattggcatgcagggtgagctcgggtcccagcaaatatccccaggatggtaaaattagtccagaagagaagttttattttgattggctattgtattttcagtctgtcatggttctctacttctatataggaggacaaattatttgggccaaacaatacaatgtggtttggaaacaattggcttttatgggcacaatcttattctttccatatccatttttttaaaaattgtgaaaatcaagccaatttttttttcagaactatgcaatttcccaagactcatggaaaagacagcttgggttgaattttttttttcaatttctgcttatggggaaaaagagttggttgtataaatcagcatatatatttgtccaagcattcatacattgtgtttggagtattagtggaaaagagtattttacataatgggctttgtcttctggtttagttcttcaagttcctgactcctagtccaatactcataaatcaagcatattcaggcaaaaagcaggtaattgagaggagctattctctgggtaattccatcctcttttttgtgcacacatttgcaaatgtaagtggttttcatctgtgcagacacccttgaggggctcgtctatcctcacatcatttttagacatccaagaagtttctttgtaaaactcttattctgtgatgccagatggttgatgccaccctacaagaccatattttgagtaaaaaggaccagtttagcaggtagatgaaacaacacccattacaattattgttgcatctcctgattcagtaatggcaaaatgtacttctcatcacatgttcattccaaacacaaaaatgagtaaaattcatatggttttccttttactctaagaattgggcacagctgctcccttacaagcattaaaaggaaaaaataaaggaaaaacgtctttaatttctcgtgtttttcagcatctcttcgaaaaatatcttagtgatacatggctcaacagcctgaaaatacctactcttgctatactcttaagcatagttttccttcacattatagtatgacagagggaagatttctaatatatagactggggaatctaaggaggagaaaatgaaaacttgaaataatgcttagtcatgctattcaattactccatggcctttttttttttttttttttttttgcagtcttttgtttgattcctgatctatgcagtctctgaaatgagtgtacaattcatttaccttgtctgaaaaaaaagttagtagttacatatgtggcaaatattgagtaaagatgaacattttaagtacttgttagactttcaattatttgggtttttccagaaaattaaaatgcattgatcacaaatgtaacagtacttggtttggggttgtataatcttcaggaaattatatgtgcaataaattaatgcatcaatataaccaataagcatttgttactgatttaaaaaatactaaaataaacccaggtacccaaaactattgtctgcttccatcataaggattgactagaaatttcccgaagaatatctttagatgacaacatagatataatacataattcaagttattaacttctccatttaggcttatagatcttatagacacaactgttttaaaagaagaacaagattttcatgcaaaaatatgaattatacagtagttttactgagtctattgctaatgcacatggagttcagaaccataatgacgatattgggcacttaagtcattagcctgtcatattacagcaaaattatttgtactatataatcattgtttccttttttatattgcacagatctaagcttagttcatctatctttgccatagcagtaccactttattgttgtaaatacctattttttaacaatgatttgagtatgttcgttgtagtttaagttcatgtttattagacctttgcttccttaaagctggaaaacatgaagtttacaatctgccatagggtgccttgtttgattgtgtattacttcatagcatcaattactgtatagtttatattttaagtacttgtatacacactaaaaatttcaaggggaatgggaacaagttttttctggttttttttttctagcaacatttccatcttattcatcatatttaagacatgctcttattcttaatattaaaatggaattctgtttgtagtcaactttttttcctttagggacttttaaagatgaacatgtataagtgatctctgatgactattttcaataagaacaaaatcatttgtggaaaaaaaagctgaaactgaaagcttcagctgcaactcatttgtgaacataaggtgaatatggctgtggttttcagaactggttccagggtttcataaaccttttagaaatggatattgattattactattcaactaataaaactgctttctcagaatctgttttgcttgtatttgatgccataaaggattgtttgccctataattaaatcctagagattatagcacaatataactcacctagcccataggttgctatgggtttctttgtgagagagagagagagagagagagagagagagtgtgtgtgtgtgtgtgtgtgtgttgtaaaagttaagaggtgtgcatacttctgagtttgaataagttgtggctgagactatttgaattgatttcatactgggaaatggcatacaagtaaaatcagtagtctattcaaatcattgtacagtcaagtcagctaaatatatggcaatgaagaagtaaaatcaaacctcaaattgaacaaaaccagtctattctgtagtcaagtagacactatgtctgtctctctaacttctctgcccagaccaaaatcatgatttggagaatgcactgtaaccagacaatgcctatccagcctttcctatattaaaaaatagatcatctggaactgaccctttatgagaatttatatttttttactttgccatgagttttcaagaataaaatattgtgtaataagagaaaggatcagataagcattgccactttagaagctttataactgtctcaagcacagactataaacttcaaatacccaggacccctgagaacctgtagtcgacccattcacacctgacagatatattttaaagtctgggtataaatataattatggagagatgactagcatgagtgaaatttcacaggtagcatgctagaataaagcagcgcttgaaaatgggcatactaaaattcagaaacctaatgattgcagataaaagaatgaaatgcaacttgtacaacctgctctaccgatgtgagatacaaatacattttaaaactttttcttcttatacacccctgcccactgccatagtgagcctatcgctgagtcaggccactgtgccaactgtagcaatgccccacacgcgagctccagtgggccagttctttgtattgacacatacgcaagttcggacatgacacccagaggcttgctccagacctacaccatccaataagaatgttactagcctcatgcaaacactgagcatttgaaacgtggctagactgaattgagatccactttaggtatgacttacacacaagatttcagagacttagtacaatgaaaaggatatgagatatctcattaacaaattttatattgcttccatggggaaatgataatactttggatagattgagtgaaatatatttttaaaattaatactatttctttttaatgtggctaccagaaaatttaaagttatatatgtgccccacattgtatttctatatggaaagtgctggtctaggggtctgagacctcagccacatgctggactaccctttccaagaacctcaatctgactctctcactctctctctttttttttctctctctctctctccataattgtcagatacagagaattctctttatcatcctcatcctatttattgtcattagtcacacaggactcttatctttacaatgttttcctttgtcttccattcaccttgccaatgataaagatgacttagaatgatttcagtatatccatggatgtataagtatccttaaaaaaaatttaactttttttattttaatgtattctatttttctttaagaaagagctcaacatgatttggcactagtatctgtgaataggtcaataaggagaaaaatactacaactctttctaggtgttcaaggttttggaaaaaaaaaaaaaaagggaactgagagcctggatctcctctaagacctgttgtgtatataaactcaaactgtcatttagtgataattaccaatcatcagttcccttcttcataaaacattaggtggtttattttcttagagcatagggcttttccataaatgtttaaatgttagaaacaagagattaagagttttcatttttctaaaaaaggaattcataatattcttttgttttatatatatatatatatttcattctgggaaatagcataaaagtagtgtgtgtgtgtacatatatatatgcatgtgtgtgtatatatgtgtatatatatacatatgtgtgtatatatgtgtgtgtatatatatacatgtatatatgtgtgtgtatatatatatgtatatatgtgtatatatatgtgttgcctgggtaagcatccaaacctgtagatggaggtgattggttacacttcttgtcagtcattcatcctactccaaacaggttggcatatatatatatatcctgctccaaacagtttcgcatatatatatatacacacacacgtatatttatgtgtgtgtgtatatatatacacgtatatttatgtgtgtatatatatacacgtatgtgtatatgtgtatatatgtgtgtatatacacacatgtgtatcatatgtgtgtacatacacacgtgtatcatatacatgtgtgtatagataaagaagatatgaatatgtgtgtatatatgcacacacacatgtgtgcatatatacacatatgatacacatgtataaatgtatatgatacacatgtgtatatatacacacatatacacatacatgtatacacacatgtgtgtgtatagatacagaaagaggatatgaatatgtgtgtgtatatatacacacatatatgtgtgtatatatacacacacatgtgtatgtgtatatgtgtatatatacacacatatatatatacacatagagagcatgcatttatttttgtttgtgtatatatgcacacacatactgagcacttttttgcttaaagattatctgggaccagagtctctagaactgagactagagtctctacaaaactaagtaattaaaaaattggcaaaaatcctgctctgggaaagcctctctaatgggagagaagaaaaaagagatattattaaaagaagtaaaatacatattagatagtgatgtttagcaaagtaaaaacaaaaacaaaaacacagaaaagaaaggggatagagggctcctaagtggggaaaacttacaattttaagtagagaaagaacctaggagaggagggaatgtttggggacaggcctgaaggaagtgaggtatgttaccatgtggatgtctaagaaaagaatgttcaggtcagaggaagaagcatgtgcaaaggacctgaggcaggatgtgctcaagaaagagcaggaagaccaatctgtttggagtaggatgaatgactgataagaagtgtaaccaatcacctccatctacaggtttgaatgcttacccaggagacactcattttgaggacccatcttttactctgctgttcagagctaatctatctgaaaagtgacggaaattaccctatggcctgcagaagcaaagcaaagggtctcctgcctactaatctactcccttacccccaaccgtactcacagctcagttccttggatctttagattctccccagagctgacattccatctgcaattaatcaagtgttgtgttaaattttttttaatatgtaaaagatgtttcagctgtgattatcaaagtatacaattgtgtgtcctaaggctacatggcatgggatatacatctgatgcaattctgatcattatcatcactacataaggtaacattgttccacatttatcaaatcagacctcctgccatttctgtttgggtagacacggcataaattttaaattaaggtgtataaaataaaagatttctatatatttttttaaaattattattaggagaagtggtagtagtaacccacaccatgcattcaccagggagatttatactaccagtacatttattgctatcaagttgcaattaacaaacattcatgcagttggagaattgggtatgcaatgcgtcaaaagtgtgagaaaatgtactgtctcaacaggcgattcctagggctcttcctattcaatatgaacatgactttttaatgagagctagtattaatataagcttaatttaattttatatacttattccaagtttcttaaattattcatatcctctttctgtttagacgcatcagtattgtgaggtttaattgttagctcccaaagcctaaggactatctctatttaactcacttttcagctaagctagtgaaagctgtaaattatgatgatgatggggggaatgatgaagaggaggaggaagggaggggaggactgtaatctacttgagtatatataaagcactgtgatattgtacatcatagtatttaatccttgcaacatggcaccaagatctttttatccttattatgcagatgaggagactgggctccagggaagttaagtcacacacttgctaagtggtagacccaggactcaaaattagatctcttaatgcgcaagcctgtgtgctttccaccatacatcttgctctgatactattcaattattaaacatttttattgatcaccgctacatactaggcttgatgacagacagtgtaggaaccaccattaaactccaaactagaacgtgaagacccacctcaccccaccttcagcctcacctccagtttgcattccaacaacattttatttcttgtggccatgaaatgagaaaagaaatatttttgccaaaccatcacatgactcagagaaattctcagctggccattgacttgcaatggagcaataaatttccattttcctttgcaaaggcccacctaagctccatgtttctgtccccctctgctttccttagccattgcattccccagcacttgttcgtgttttcacactaacgttcacaggtggccttttcttttttctgctgtgccagagtgcaaacagctaaactttctttctgatgactaagtgaaggaaatatttcctggtggatatttcctaactgaactgcttgacaaaaatggggagggagtcagatcctgccagaatatttctcttttactcttggttctgctttgacagtttggaggattaagggacaacaatgacagtagttcttgttattagccatgtcttaccgtgtctttctcaccattcacagtgtccctgttggaataaatgctgatgactacatctgttgtgttatttaaagtagatctttaagtcaaaatgaggatgtgtgcgcactgcctcattttgagtttgcttaatgtttccagccatattttagaaataaatcccaaatgcttttttgctaagtgcattttcctttcgattttaaacctatgtgtattttaaaggtcatttaatctgtgcatttccaattcctccagtcttaaatcatcactgtgttattttatgtaagaggtacttaatgtctcaagaagcttttggaggcctttaaaacccaaagacttttcttttccaagaccagaagttccattttgtgaagagtaaacaagcctgaagaagaccgaaatctcagcccgttcaatagtccaaaagttcaagtttcagaggggttggaatttggcgaaatgaattttcccatccatagctcaatcctctatattccctcctagcttaggctgaaacacatggaaattatatccagcaggcactcttctcagtgacatctgcatctgtaggggtgtcctggcattcagcaacaaaatcctcttcccccagggaaaaggaagactcaaaaccccaaataataataatctattacagatttcaggttaccaaaagttaaagaaatggataaaagcaaaacacttagcattgctacatgtcaaaaggaaggctactgtaatcaccccccacccttgaggcatgtatttttcaggttattatgcataattatgcatacaaatttaaatatatttccatattatattcaaaactgcccaattcttaaaaaatgtaggataaaacaaaattaattgatggcaattactgcatttagatttaaatctaaaattcctggttactggaagaattgggccagtagtgggcacctcgaacaacagaactgtctcttctggaacattcttctggatttaggaacagtgtttctctaaaattaaatgtgagattagagaggcataaagaggtgctgacagaaaaccagaaatggtgattaagaaatttggattgaacctttatttcttactacgtggccttaaccaaatgatttaaacaatttgggcgtctttttcttcatctgaaaagctaggcgcattcactccatgctctctcaagttccctccagatttaatatttcatgtttctgagactccaacatgaactgtgcccaagaatggggttatctgacggtcaacaacagaaaaaagcttggcaatttgattacaattaactcatttaggaaagaagtaaaatatttgggataacactggagttttggcagtaagtaaatctcccatcacaatttttaaatggaaggaagagttaatccaaaagggtggctggaagcagaaagtagttccatttgtcacacacatggtgaccaccatcaccatacagcacccagagggatttcaaaatggacaacacataaaacaacctatatccagaccacatcaagtgtcagaatgatgtggatctttgtggggcttttcctagttttctctccttctttagaaatgtatgttatgaattatgattattgcaatagagccaagtattcaccgggctccagctagatctttgtttagtgagcataagctccctgccagctgcaaactgcagctgtctgtcagcatttgtgaggacaaaccaccccactatccctgatcacttagccgtagacgacatactgtgtcctcagatctgctcagagcaccccttgcatttttcaatacacttcctgtgggggagggcatcagtgcttcgcacgcacattttggagcaaatagcttaaatcttatgtcaaaatgatgcttttaatagagggttctgtcccaacaaaactattctgtgagagactcactgactctggcctgacatttccggatattcgatgtcctgaaaaaggcaagggaggctaccactctgacaaccaactgttcctcaagacacagtgggccctacagagggtgccaagagcatgggccccaggccaggaacctgtcttacagctggggaatgtgggggtaagaaggccatggcaaaggggtgaagccagaggaagggcatagcccagggtgcccagagcagccatcctcctgggccatagcttacagccagagacaagacccaaaggaatccttatttcaggagaaatcgttgtctagaacattcaagtaaacttggaactctgcagttttagaggggctttgagggatgatacatttttcttgactctcatttgccagcctcctatgcaatttattttcctttaaattgcaaggcatgctcagaatgggagagaaactggcagcaccacaccagatttaattaaagcattgttggagttaaccaagagtctcccctgtttttatcaaaagtgactcatgtgggtgagaaaaatcatttttagaggggtgccaatttcaggaataccctgagaattaccctcggaatttaggaatactctgctttttccaggcacttgtatacagtaaacttggggtttcttaaaggataaaaactattgctgaagtttctttgggctctggggtacttctgaaacactccaagaagcctgagctatggtcccctagtacttgtggaaaagacttctttgaaacatgtttaataataatattttcaagtaaaaaaaataaatctggaattcttcctactcatgggggtattgtgagaatgctctttgttatgtaagagtactgtttcagtaagaactgtgtccccttgggaagaaaggcacaatgcaaattcaaattaataataaaactgtacaatatgtagcatatgcccaaagttggcttaagtcacataatgaagaaaacattctaaggtttgggaaaagactcagccctatgcatatgtgtgtgtggagctgtatgtgtttatgggcaggagagcactgacccaacataaacactttctttcccacaacttaaacatatacacaatacttaaaatagtttctttcaggagtagaaaccatgagagtcacagggtcattaaacaatagcaaagctctgttagtccatgatctttccttattcaagaggattataaaataaaaacaaagattctgcaaggaatcaatattttgcaaacacatagcaatttacagtacaagagtatttggattgctaagtaccttcacttctgtgttgctgtttgctgcttcattgtgaaacctttttgctggatgtgttacatgcgatgagcttgggtgttataataaacagagaggaaggctgcaataatgtatttcagttaggaagaagcacttgaaagaaattgcttttgctatacacatgatgtgagccaatcaatagtggtttagtctgacaagccctgtcaatatccattgtcacagttcagaaagtcgttaatggatagttcttcaaaacccaatgattttaacacatgttcaaagtcttgaaatacactctacctggcagaaattaatcacaggtaactcttgggaaagtatacaagcatttttttaatgagagccaaatcatttacacacacacacacatgctcgcacacacacacacacactcgcgcacacacacacacatatacagcagctaagggtctaatctaataacaacagatgcatagtgaatgctcagtaaatgttgaaaaagtgagagacactgggatggaggctgagaagggtcctttttatacacctgttctgtaaatttaatgattattacagtggtgatgatgatgcaggatgcctatcatattttaattattaatcatattttaatcattaatattaatctattaagattaataattgcttctgttaactacatatgtattatacattagacattgagctggatgtttttcctatatcagaacatttaacatacacaaaaatccttggcatggatattattatccccatctaacagatgatacaatacaggcacaaaaaactggcatagcttgaataagatacaacgttaagtgacagagttggaattcaaaatccaaagcctatattattcaaaaaagaaagaatgggtaggagagaaaggaacacacttgaaaaaaaggaagaaagaaagaaaaaagaaagaaatggcattagcaattggaaggaagcatatcaatggttcttatctgcttttccccaagtcctgatcctgaactcttacactcagttcctgtgaagcaaccaggaacaaaacaagcctctgagctctggggttgggcatagagaagaatgggatttcccagtttggctgaaagaagaactaaggagtttgcagaagtaaatgtattcacttacactgttgtgggctaagtgtgtgtctgaaaaagattgtgtgagggcaggggtaaaactgaaagacacagctaggttgctagccatttttgcctgaaaggaacccccaattcccacctacatctctccttctgtgttcattgttgtcttgctgcatagagcaatctggagcatggtgagtgatttgtcttctgcccagtatgcatccttgcagcagaactcaattcatgtccatggtggttacagttctgtcctacccagatgtattcttcaactgttcttattggcaatccagagagtattcagccaccagctccactgttgtcccatgattcactcatcttacctaagatgactctttttctctctcagccgtacaatgatacacaccacatggatagtttcagtaatcagttcatggtaaagcagatgatttaagaccttaggttgcaagtacttgagtatggtgaggcaagggggtgggggacattaccatctctctatgtccttagacacggtgacagcattgccacacagatggacaggcagggccttagggcagggaatcagacaccacctgagttgtggttctgccactgatttgctacttggcttaacttctctgaacctcagatttctaatctgtaaaatggataataatggaacctaccatattgataaggattaaatgagatcaatgtgcttagtaaattccttattatatagcaaataacttcaaaatattagtcattattataaatatgacattagaataatccgattgtctagcaaaagtggaaattaagactattttagaagaattatgtataacttataatctaagaaacattttcccacttcttaactattgattatttggctttaagacatttctcaaactatctgcacatgtcatgtatgtttttctgtcctggctgaaaattttgtttggaaaattaaggatacattatagcatattctttactaaagatacattgtaacacacagtccaggaatttagagatttaaagaagaagcctcaaaattactatatgttactcccctctatacctgctgagaatgtatctttacaggcatttttacaaatgtgcaaacaaatacgtacatatgatatacagtggtagctctcactatgtatgtatacatggaaagagtatttaaatgccactcaactgaaatactgctaatgatggttcagaatctgagtccatacatcagtactgaaatatccaatattcttatatatgcatgtgttttattctccaacttgacttacttttttgcggaaatctaagtgttaatttcgtagaaggcagaggctatcacctctctggtggaattaccacgcctacaactctttttggggttttttttttttctcttttatggactgatgttcacatttatatttaaggctcttctcatttgatttggctgtggcctgttttctatcactagaagagaacccattcctgtatttaatatacaatctttcctcatggaaaacatatttctgcttcacagtgccctttgtgtggattgatgccctatgatattttcttcttttttttagtaattcagctttcaatatcagctactgccttagctcaataaccacttactttattagcaaatttatcaaagttttgaacagctctcaagtgacaaagttttactgacactatatcaagtcataagaagcccagttaaaatatataatcaatagaagaatgtctaaatgatctgaatctttacattttacactgtatctcattttgttttaaggaaaaaaaaaatgtcattgtgtttctctacatacaagataggttttgctgtttaggtatattttccctctttttattgtttttctgaaaatgtagtattttcataacctgtgacgcaaaaaaaaaaagtcattaaactctggcttataaaaggaaaccagataaatctatagtggaagggaaattaaacattgtgatggtatacttaatatttgcagtatgggattgaagttatcaatcatcattattaccattaaaagtactcactatgaaacccaaagctatgctaagtgctataacaaaaagagtttaaacaaaacaccctgccttacactatagaaatacattatcaatgtagatacacctaagatgtattacgagcaaaataaaaatactaagtctatacatgaaaagacagtgaagaatttacatcatagacaaatgcattagaagtagaagacatggatacataaattcctgagaaaagtagccatgaaattttcctatggctgaattgacagtagacgccagctgttcactgatatcaaaaatgcaaaaatgtggttagatttaactacttaaagttgataatgcagtctaaaagtaaacattttaattgtatgaattttcacttctccttaaatgggtagatagcatgaatattaatcatggaatagatgatgagtacacacccttctgttatgaatctaattgtctattttgtatttccacaatgtctaagtgggaattaagtggttaaaactgagcactgcagttaaagtgcccagcattccctctttcaattatttccagatttaatcatgatttgtgttttgagcaagtcacttaaagtttcaataacttagtttttcaggctgcaagttggggtttgaaattatgacttctatttacactgagcaagtgaaaaaaagagatattaaatgaccaacagtacattaagcccaaacttaccctttctgcccactctgacatagggagttatgtgcaaagttctgggagctctgaaaccacaggcgggggaaggcaaagcagtatttattacagccccatgaattagcacaagcgtgaatgccctggaaaggaataaacaggaggctggaaagaaatgtaataaacttgatttctttttttcaatcaatttgggataaggtgctcttatttatgtaatttggaaagtagttaagcagggtaattccaatacaagaagtttgtgttggaaaatgtgagtggagataattcagtactttgttatgtaatccctatgatggtgtgagaagagttttggaacctctggggattaagagcctgacaaaaccttattttgtcttttttttttctttgatttcctgctctgaatactgcagagtggtaagatgatggcactaaagctactgttgccagctttgcccttgatgtccttttggaattgaattgaaatgtttagagctcctagctgctaacaaaactatctacctacactgatgttgatctcaatgtcaaacctcaccgataaagtgagaacaagtagtgtagaaagctgtgtgtaatagcttttctgaagtataatgactccactttcctttagcaacatttctgaaatgttggctgtcccagcacttccaaatttcaaaaaaaaaataataacaacatgtaattgtaacatgggaataccgcgagaacagcagtttggcaggaaaagaaggtatttcaaaataaggtccccagaaagagatgttctggcagatgcacaattttggatcatattatccaaaccgttgaattctggaagatttgggggttttcttttttggttcccataccctaaatgggagtagatattcgtcgtccatccagagggcattgtttccccttcctgttactaaagtgagaaaataagtatactaagggcacccatttacagtaagcattcgtagctctagaggtgatttttaatagcacaatagctgtgtcaggtataacacttgtgttgggctaatgcctattctcatatgtaatactattaactgaagatcatcttagaaagcccactatcctaacatcttagaaagcccagaattctaactcccctctggtgagagcagttttagcaccaattaagtctctcaactggttaagaatggtatttaaagctaatgcctttggcctgtgtgttgagatttgaattgcctattgttattgaaaattctcagtctttgaaaagcattctatttgttcaggcttgacagaaaagatctccaatgggaaaagcagaggaaaacataaaggaaatataagtaaattctagaatacctggaaagctagtacatttcaggttaaggttaatgtttatggaggtaaaaatacctaggattaagagtgattgctctagtctcttatgcaaatcagattaaatatttcagagtttaaacccatatctcttttggctctatttattttcaaataaaaactcaaagtgggaatggaaaaaaaaaactactcgttggcttaacataaatctttaaactgcaggaagcttcaccctcaaaaagtagttgaatctctgagggaaaagaaaaggctgaattctatttttcataaatgatggattattgtaccacactgtgtattttccagtaaagtgtccttttatttgcactgtgtgattacaagtttctaaaagtatgtgtggggtcacttgggtgctgtgggaaaatggaaggaacactgttctgttaaaatcagtagtgaaatcagaagcaaactatgtcccgattatcacaggcatgtgtttaaattttgctttccttaattggttatgttgtatttacttaaaatgaacaatttggcaagtttttctcccttgacaacagaaaagcgtaaactgttttataagtttggctgttaaaatcagatttgtaaaccacgatattcaaagacttttacggctgtttacagggtcccagtgatggaccttgctttatatccacgcacttcttaacatttttattttgtatttatagtgctttcaagttatttggttaataaaaagtatgctatatattatagtcatctattgacttcaacctctacataactcttcttagaacaaaatgagtggaatgaatgatggcacaggccttgtaatttgacttgtcatctgaggacaattatttacggcatcaggaaatggaagttgacgttctagtctgtctccaggaaagtaatcattagagccaactttggagagtttggctacgttaaaaactgtctaatcatgtccaagactctgctagtttctcagtatgtatgagaaggaaacaagataaagcatttaaaaacatattttcattttctttgaaaaaccaatgcaccttacacgcatttctcacatgtggagccagatggtggtattgaagacaatatgatatacatatatatctctctaattaagaatactatcaccagaatacctaggggagtttcaaaaagatataactcataccgtaattattttcataatctagcatttatacgtcatgtgtgtatattttaatttgcaaagtactttctaatggcatcgtttttactagttccaaatggaagaaaaaaaatataccgtgcttggccctgcatttcttggtattctatcatgggaaatggcaaggtttttgaggtgagaccagaaatcgaaaatattacttttgtaacctgtgaaaacttagattgattattctgtgtcattccaaagatggacttgaaaccaaaattgccctgaggcagagttattctgaaggatgttaagtgtttcttcagtctccaacactagaatacagacctatgggactttgactacagctgtcagttgaagcagatcatacatgactggtggtcactgcgatgactggacctagaaggaaagttgttaggatagcacataaacacactttgttaagatgctcagaatgactcttccaactatacaattttgaatttgttaatggctgatattcaaggtcttgtaaaagcaatttttgtttgcttgggttctcagggcacttgatatttctccaaaatgacctgaggtcaatccctcctcttagatcctttaatctcttacatttccatttgactccttactgtgctgcattataattacacaggccagacaggcggccatggtggctcagacctgtaattccagcactttgggaggatgaggcaggaggatcacttgaggccaggagttcaagaccatcctggccaacctggtgaaatcccacctctattaaaaatacaaaaattaggccaggcgtggtagctcacacctgtaatcccagcactttgggaggctgggggtggggtggatcacttgaggtcagaagttcaagaccagcctggccaacatagtaaaaccccatctctactaaaaccacaaaaattagctaggcatggtggtgttcacctgtactcccagctactcaggaggctgaggcatgagaattgcttgaacccaggtggcaatggttgcagtgagccgagatcgcaccactgcactccagcgtgggcaacagagagagactccatctcaaaaaaaaaaaaaaaaattagccaggcttagtggcacatgcctgtaatcccagctactcgggaggctgaggcacgagaatcacttcaatttgggaagtggaagttgcagtgagctgagattgtgccattgcaacccagcctaagtgacagggtaatgattatctcaaaaataaatgaataaataataaaaataaaaataaataattacacaggccatatacatgttatccacaacaattaaacccagcactgccatgtatatagtaggtggtcaatttgtgtttattttttattatcttccagcactgtccaacatgaaacatatgtataatgtaaaatcttctggtagccacattttaaaaagcaaaaagaaacaatttaaataataagatattttatttagcagaaaatatccaaaaattatcatttcaacatatggctcaaactgcatgtcaagtgttcaatagccccaagtgactagtggctagtacattggatagcacaagtctaaagcagtgcttttcaaactattgagatacacagagacaatcatacttgtataacacactggtggaaactgctcatagccaaagaatatacagtacaactgccacaaggactcaggctgtcttggtcttgcctaaattaccctaagagctgaggacatctgttaactctcagacctatagtacccattttttaaagtttactttaatttaaaaaaaaatttttaatttccgggatacatgtgcagagtgtacaggtttgttacataggtatacatgtgccatggtggtttgctgcaactatcaacccgtcatctaggtttcaagccccacatgcattaggtatttgtcctaatgctctccctccccttgcccccaccccttgaaaggccctggtgtgtggtgttgtcctccctgtgtccattcttaagagccccatagctgggaagctgtctacctttctcacatgatagtcactgtacttttattatcaattcatttaaaaaatagatagctcatgacaaatatatagatagatggtagatatgtatgagattgtgtatatatacatacacacatatgctatagatatatagacatttatttttcttttcagagttcttttacattttctcaatgtatagatagaccttccaccgataaatgagaacttcagatggccctataatttttccaatcagtttaaggcaatgatcatcaacaggaagtaattctgtaccccaacctccaccctcatggacctatggcaaagtctggaggcatttttttttattgtcataattaaggagggcgtgctgctggcatattgtgggtacacaccacggatgctgttccatatcctacacagaggacaggcctctacaacaaagaattgtctaccctaatatgtcaatagtacaaaatttgggaagcaatactttaaagtaatataaagtattacagattttcaggtagcaagaattgtctcaatttagtaatttacagtacctagtcctatgtgataatccaaactttaattgaaaaataaaattccacccttctcccagctaggagataagcaggatatttttctttttctgtcattctcagtcttgaacttcaccttaattccccattttgctaattcaagtttgagcctgctttgtagtcaaaggcagggaaagcaggatgcaaaaattccctttctttgccagttatagagaggtttctcactccctggaccaggtagattttcaaaagcatatctatatttattaaaaagaatacctaataaagtatcccaaaccctctcattatgtcaacaattgaatgaaggcagtggagcgttcagttaagatatatatcttgtctacagacacaacaaattactatcagtaattaataataagacaccttgggccaggaacagtggctcacacctgtaatcctggcactttgggaggctgaggtgagcagatcacttgagcccaggagttcgagaccagcctgagcaatgaagtgagatcccatttctaccaaaaaaaaaaaaaaaactttagtcaggtgtagccagtagtcccagctacttgggaggctggggtgggaggatcatatgagcctgaagggttgaggctgcagtgagctatgatcacaccactacactccagcctgggtgacagagcaagactctgtctaaaaataagaggaggaggaggaagaagacatcttggatgtgtttagaccatgcttaatgaaaacccagacctcatgtattatattcatccccgaattcacagcctttagcatggagcctgattagtagacattcagcaaatatttgttcaggagtgaattttacacacacctgactttgaagataaatctgagaataggaaactgaggagaggggactaatgaagacatggaaaaagtttgaggcaaattatgtttctgaatttcacatagaactggtagtaattatacatcaataaggagagtaagaaatacctgcttcagaaaaataaatcacttcaggttaatatagaaaagaagattgacaagtttattcaagcaagcaggacctccagaaatgtctgcattagctagggatggtatataatcatatttaattgaaatcagcaatgctaaagagttgtctcctgtagtttagatgaatttttctttactctgaccacaattttgtgcataaatacatggaattatccatgtaaagattacgttaaatataaggaaatgaaagtgaaaataaattgtgaatatatggaactaatcccattctcattgtacattcatgctgcaacaacaggactaatactttcatgtgggcaaattttactcacatggcttgttgtagacagaagagcctgagctattaattcaggtagttgtttcataactactgttttctattcagatttgcataaagtaataatcataaaggagaaatttaccaaaagcctctgatttttttaaatcttcagtgttcagactgcatcacagtgcttccgatacaagcgacaaaaatcgagttaaaagcagattaaagaagtttattacccgaagaccttccctgaaaactctgcaagaaaaaggacttattaaaggtacaggtcattttatacttgtactataactgtgataaatgaatgtgcctctgtgttcatagctaatcagctctaaaggaatattagaatattttattcttcttaggttgcttattaaattttctactctgtaacagagaaaagaaaaataattgtccagaaaacagatcctgagaaaataaaggaggtatcatggggccattgaacaatatacctagttttgcccacagaggatctgtgttctgcactaggaacagagaaaggatatcctagtgtcctgctagaatgataccatgtcctcctgtgtctgggtggttccagttcacagctgggttttagtaagtatgaaccagcacacttaccaacccagcccttttcactatcagaaatgtccagatttggataaaaggttatctgatcatcctagtcatagtctgaagtaagtgctaggaagaaagtctaagacaaactagtgtcatgaaaatgtatggatattgagagctggcagtctaaaaactcaatccaaactgaaataactaggtagttttacaaatatatgtagagggcagaatagatgattgtaagaatagatgatggccaccaatcatggtctctggcattagactaattagatcaccagtcactcattttgacattgatcaagttatgatcttctctgtgcctcagctttctcatttgttaaatggggatacttatatacatcattgaaaggaataaatgacatagcctatgtaaagcattcaacagagtttctggaacaaaagtaaatattctatgaatgcccactgcttattaatataattattcattgttgttatcactgttagtgtgtcaaatgaaaggatgaatggatagatagaaccagtgattagtatatttctataactggaaattatcttacagaatatacagactaaattgattctttttaaaaacaagaaaacatgaagttcattattctctgtatttttcaaattttctagcttatgtgtacattttgaaaattaaatgtaagaaagaatttgaaattgggcgaaaagaaactcctaaccctcagaagaaagctgaaaggctaaactttatagaaatcgagaggtgatttaataagcaatcatttctcatgaagagggcaaagcagatcctaatttcagcattacttaaaaagattagcatttaaataatttataacaactgttcaatctatcagtttccgtccattttgaaacaggtgaacagatctgaaaaattagctagcactttgaaccaattgtagaaggtgaaatttcatgaagcaaaagcatacacattactaatagaatagaaaattcttaggatttaagggtaaaacgaggaccttgctttaaatcagagttgcctcagacttttactctccgatgcataatacttttctgagttgtagacagtaattgaccctctacagattcaacttcactaagtagtattactagtaccttcagttctgccttagaattcatcctatagatgatcattttcttggaaaagattcagttgcaggttaactgccatcttgaaaaatataaaaccagctaagcaaccaacaatcctaactttacataatgtccgagtttttcacgactgggacaaaataaaaggggttttaattcagtggcagggtctggctccacatgaaatgctgaaggattaattactacagtgctctagaattggtctcagaaagcattaggaaagctggatgcctaatgcagttttcataccgaagcaatggaaccgctaaacacactctgattcatgcatttcttatcttagagctccattaaattttcaccataactgaccaatgagtcagtattcattagtagggctatggaaaatctatgtaaaattctgatttgataagcttccattgttgtcttcagtagaatttttttccacgtacagatcaagttatgcaaatgtagtcacttcttgggcttgtttcagttttagctatgaactttttttaaggcttttactaagtttttgggtttttttttcccaactcggtaaaaggcattaaaccaatttttaaaaatacctggctagtcacacttagtactttaatccatttttttcttacacttaaagcaaagacttagaaaaacaataaaatcagtatttttaatcagttaagaaaaattgcatacaattaatgattaatggttaaatggttagtttttgcaagcaaaatgacttaactctttcaaagggaagaattatttagaaagaggaataatggctttagaattgttctgcagctcacttggccagataatctatatcatactttataaactgtctaatcttccagatcggcacaaaaggcctctattaccaaggttcaggaaagctgtgcttggcagtttgggccttaacaattgtgcttcctgaaacctgggagggattctgcagcgacatgtcagttttctttttctttttgtttttgtttttgtttttgttttgtgatggagtctcgctctgtcgcccaggctggagtgcagtggcgcaatctcggctcactgcaagctctgcctcctgggttcacgccattctcctgcctcagcctcccgagtagctgggactacaggtgcccgccaccacgcccggctaatattttgtatttttagtagagatggggtttcaccgtgttagccaggatggtctcaatctcctgacctcgtgatccacccgcctcagcctcccaaagtgacgggattacaggcatgagccaccacgcccggccggccatgtcaattttcaaagtgtttattctttcacgtaattcaccagtaggttgaggaggctgggctttgaattcaaccagcctttattgagcaccacgatgggggcaggaagggctaatattttattgaccctataacgcccatcagagtcacgtccacaaagcacttaatgtgaaaagagatttaccccaatatcacacaatctaaactcaatcacaagccctttcttcaaaacctgttttatatgtggtttcattagctagaacctagacttggaaacagtcccttgatggtgctgtattttcttatttatttatttatttgtttgtttatttttttgagacagaggctcactctgtcgcccaggctggagtgcagtggcatgatcttagctcactgcaacctctgtgtcccaggttctagtgattctcatgcttcagctcctgagtagctgggattacaggcatgcaccaccatgccccactgtttttttgtttgtttgttttttagtagagatggggttttgccatgttggccaggctggtcttgaactcctggcctcaaatgatctgcctgccttggcctcccaaagcgctggaattacaggcatgagcaaccgcacctggcccatattttctaatttctttaatatgactaaagagaagtacatattaagatatcaaataaagtgggccagaaaaaaattctgaatgattgctcaatgaaaagaaatcttaatagctcaggtgggtgtagcaaacattgtaccattgcagtggtagctttggaaaagttctccaagggcattcaagtttgccaaggaatggtgagccctttttaaatatatgagtttattaacattgagcatctcattgggaacaaaacttgaatccgtttaacatataaattataggcaaaagcgtccatttttgggtggtaggagtgtttataaatctccttggcctgcttttggaactgaagtaacagctctttagttttagccagactgccttatgtaatctttcaaataacagtattgacatccaagtttaggtaatacagtttttagagaagataaccattgtttggctttttaggagcaattagtatgcccttatgtcaaaataatagcatcagagaggatttagaaatgtttagtgtttagaaagtagtttcattcatcctaataaggacaaaaccatactggatggcattagtagaaactgaaattagtatcatattacttatttttgaatcagtatattataaaacctgcttgaagaataaatagcacacctcagggatttatgataaggagaagtgctttctagcctcatcttagttttgctccctaaaaggtaccactttgaacagtttctatttatagttctggtgatttggtccatacctacatccttcttatttagggtaaaagctggtttgtttttttgtcaatgtccttcttatcttcagtgttgtaatatcttactttatcagtcttagacagtactttaggtttctactgcaataggcgtgaattttactcaactacaccaagcctcatcttagctttttttattattattatttttattttttggagatggattctcactctgtcacccaggctggagtgctgtggcatgatctcagctcactgcaactcctgcctcccaggttcaagcaattctcctgcctcagcttcctgagtagctgggactataggtgcacaccaccacatccggctaattttttgtattttagtagagatggggtttcaccatgttgcccagcctggtcttgaactcctgagctaaggcgatctgcccgctttggcctcccaaagtgctaggattataggtgtgagccaccgcgcctggccctgcttggttcttctcctcgccagatacttacagtcaaatacagctcatcccacagtctccattagctttctccacaacttgcaagatgcctacatctctacttaagttttgttaaccctagaaaattgagcgctaagcctccattggtaagatgaagaatttacagccaccttctcctctcatctcctctgcctcttctcttctacttctatgtcatacaaacttattttactttacttgtttttataagtatggcttatttataggtaaattttaaaagttaaaaaaaacatggctgagcatggttggctcatgcctgtagtccaaacattttgggaggccaaaggaaaaggactgcctgaggtcagggttcaagatgagcctgggcacgataaagagaccctgtctctctacaaaaagtgaaaaaaagttagccaggcgtggtgatgcatgtctacagtcccagctacacaggagactgagatggaaggattgcttgagcccaagaagtcaaggctgcagtgagctatgatcacatcactgcactccagcctgggtgacagagtgagactccctttcttaaaaatcaatcatccgggcgtggtggctcacgcctgtaatcccagcactttgggaggcagaggcgggcagatcacgaggtcaggagatcaagaccatcctggctaccatagtggaaccccgtctcttctaaaaaatacaaaaaaattagccagccgtggtggcgggcacctgtagtcccagctactcgggaggctgaagcacgagaatggcgtgaacccctgaggcggagcttgcagtgagccgagaatacgccactgcactccagcctgggcgacagagcgagactctgtctcaaaaaaaaacaaaaaaaaccatcaattaatcaatctatcaacattcatactattatgcttacataagattgtttactgtagcaccacatagacttcctttcctgtacttataatatcacaactcccgtgactctcaaagggtaaggcccctgattattgtggaaaaactctccttttacatttgagggatatattaacagttttatgctgtttcacgttacctccatggctttttcatattttggactaaatggtgaaaaaaacaataatcagctttattttagtcatgtaaatactatcaaatctttggccaagttatatgccagattggttgaacatatccatgggtggcatgctgtgaattatgggccactccagttatactgttcttgctttcaaaccttatgctctatcatttgcttataatcacgcttttagtctgattcatttttccattttgaatttcctgcacagtgttcttcccctacccagagtttcatttttttcttgcattctgggcccttatgtcattatgtgctttcattctctcaaactgtctgtgtattctagtctgccactccttgcttttttccccctgagtatcttcttctaaagtcctttcagcctctttctccaatttgcactggttgctctccagctgattgccctgtgatctccttccactgctcctctgtgttggatccactgtcttcggcatcccatgccttcccttctattactctttaacagtttccatgaacccatttggaaagcatgagtcctcaacggtctaaaaaataccttcagtatgcccacacactcgatcagtagcttagttgggtataaaattccattgcctgtccaacactgagttgcagattccgctcttaaaattgttttgcttgtaccattgttactttgaatttctctctctcagaatcattggggggttttggtctttattttgagattctggaatcaagataatgtatatagtggacaggatttttaaattttattctgcttggcccttaattttaagaattatgattctttcttcagtgctggattttttatatttttgttattacattgatacattcctcccacctgttttctctgtttcctattctgaggtcttttttatgtgatcattagatcatctgaattgatggtttcattcagtgttatcttttctcaaattttgaaagaattctcagttttgttccccaatatttatattattttaactttagcaatcatgttttcaattttctagatttgtttcccattcttctttttttgcacatctcatttctcacataccatgaaaacaaaaactgtgttgaccactctactcctatacaatagtgaggatggcacatagaactcaataaatattcggtaattgaataaataggaaaagtagatattttttaaaagctatctgaggacatagattagaatttgttgttgttttggagtcttgtttttattttttattttaaattgttctcttctggtctttaaatgatcaatttcatctatggtccttttctttcctttatttgattcattctatttctatcaaattagtgactttgcccaaatgtctgatgggcaatagttgtccactcttattaaagaatgagtctctgtagagaatgactagagctctgaaaacatgggtagacctggccaatgatatggttttgccttagggtggtctgctggtgcatcccacactaatcccatacctcaaatatcatatattttcaaaggatacagaatgctttatattctcttgataaactgaatcaatcttactgctgatagtcaatttttcagctccattttacaattaagaaaaatgaggagaaaatatctcagattatttgaaagtatagcagctttgaaatttgaccaagccaggcttgaagccagattctttgatttaccagctattaacttaatatctggttattgactttcttctttatgaaatttacattgaaagtttaaatgaaatgatatatgcgaaaatggtgctcagcttatcttggccatcccacaactgttttctccctttcttttttgtttcttcctttcttctttccttcatttcatcttgcctttcttatttttatctttctttcctttctcccttttcctcttctttatttaggtgcacagagtaaattatgaccaagatggccctaggaaaccattctgttaagtatttgcttaaagctcgagaaatcattgaaggcaagcatctaggaaaggcagcagtaattcacttacttcaagaaacatacactgataacttgggcttggcttatatttctctttttggtaattttaatcatgatgctctttatacataaatgggcatgagctcatttttctaactacactcacttatatagtgtcatgcaactgctggaacatttaagtaattacccacacagacataactgattgtttaaggtgtctgccataaaagaaaataatgtctttgaaaaattatagttcttttaaaaatatgtcaattatgttgagaaacaaaaaaaagatttgtcattcaaactgcaaatacaagctatcagccctagacttaacagtcatgtttatgaatagcaacatcattgagttaagagaaaagtgttttttaaataatttgttagaactgatatatgacagagtaacataattgtcacactgttaatttaagcaaaatatatatgatcaacactgtaaaatagctttgggtagagacatgctccaactttgccactttatcagtgttagtctgagaataattatacttgaatttatatactagggcatgggtctatcattgcttgggtctgaaatactctgacaacttccacgatatgcactaatgtgcttaaaaatatcttgtaaatcttcttttttaaaaaacttctttatggttcaaaattgaactgtgatctttacgtgtgcgctgtgtcatgatttaatattagccaaaattaatagccaaccttaagcttctttatctcggcctacaagcttcctggttcctttgcatttatagttctcaggcagtttctgttatttaaaggctcttgggagcaaatgtgttggtaatacagtaccacatagttagcttttgttcaataataagatacaggacaccatgcgagatggagaaatgttgagaaaagggtgcacctgggtagcaggttaagcccatgtattttaaaagcctgttgtgcacacaggaaacaatccaggtcttgtgagatattaaaagcagaatagctttggagcaaactagagaaaatgaggttcagaaatgggagcaaattaggtaaggggaaaaagaatgagccagaatgataaattggtttccctgtggttcaagaatttattttcttatggggacagatctttttatacagatgttagtgagaatgtaatatttgagattgtgacttacatacacttgatttttttaacctacaaaatggttttaccagtaaatttctggtatgtaactcactatactttatgtgttagcaaacaacaatgataatcattctccttttagttcctttaaattacatttctttcacattaaatcaagtcctcaagatgtttcccttttctcaagtaaaagaaatgccagataataccaggcttcagccatgaaactgacccaatgcctagtaatagctatgcttaatgctgggaatgtaaaatgaataaaacccagttgattcagccagcatattggcattttgtttttagccaatgacccctaaaacccatactaaattttgccctggcaatagatgctggttttattcattctgtggactatgtatccttaaaagattgcccagaattctggcatgccctatagggttacatgaatctggtgccagtttgaaatattgtatttgagccttccagtttgaggactgacaagcttccacaaaataggaagaaatagatcatacacaccaaaaaggaagcagtaacaagtggaggcaggctttgtttcatcttatgactctatgccatgttttaagcatactctgtgctctaactcaaatcttgtgtgtgtgtgtctaaattgtaaaacagatacaaaacctccccttccacccccaacattgcaccaaagttgatgtgctctcgaaagcatatcctcaactagttggagacaaccaaaagtcaggctagggtggtagttcctccttgtgttagaagtctgctgcgctctggagagatggcccatggctgtttcagtcctctaatcacatcctaaatctttcctctgtgaaaccacctgatgagaagaaaaagatgcagggcccttgtcagtgttcaaaagaatcccctttttaaaggttagcatttattattgataccctgctgttctccagcaggtgttcttgtaccgcatagttccctcctgactcctaaagccagcttcacgagcagtggaagattcttcagcttagttcttgttagcttttcagggcctccatagacctacgaacagtatccaaagccagtgctggatgctgctttcgcctctgtcgttggtataattctactgctcacactaagtactagatggtgatttcattgtgtggcgaggtggataactgagggagaagaaagcagaatttcattctgacctggagattgattatttgagcaaatgtgtgaatgaatgcttcttatatagtgagacaagttgaattttccatgctattcaaggaaggaggtctcactccttcctcacttatgatatgaatgggattttagagttcacatggtgtgtatgttgagtgtgtctctaaagatagtacatgtcagagctctcataactcagatatcctcattagggaccccattcagcagatgtgttagactgctacgagcaaaggaaatattaatatccacaattcattttgacatatcctaagattaagagagtgctcttttatttcctttagcatcactgacagtttggcctacaaatcttttttctccaaattcatgtctattataaatcaacaacatttcataaatttctaagattcaaaaaaaacttgcattattttatttcaggggcccaaattttgtccgatattaaaagcatctctctttggacttcttaccccacctgattagtgataacgaaaattaactgggcctctgtaaaactgagtcatcaggaaaaataactccatgttgtaaaagtgctattcctgcattttctattcttctctgtgggagggaggcaagaggccatatcagaatttggatagtcataattggtggtctgtcagtattagtgaaattgcaatagggagaggtatatctcccagcttttctttgaaattgactatattgctgtaagtgtgttttatcaaagcattttctggggcaacagatctgaaaacataaactttatgtagcattgctcctccttagatatttccctttaatatgtcttttctttttgaagataaaataaaagtacataaaagagttctgggaataggcagctatatgtcataaacaccattcactccccctcacccagagctcccaccccccaaaatttggaaacgatttgattgaagtgatgactgccttgatcttgtttgaatactccttcttcattgtcttcttctctcaatgggaggcaacaaccctgtcacagagacattcctgggagggaaagaggtatttctagcaaccatattttccaaacacaaaattgagacacatggcctgacaatgccataatatttgaagtagggactgtgctcaaagatccagaacatatggtggaaagagttttcttataaaaggcagccatttaagacactttctagattcttattcacaaaaggctcattcccccatcccttttattctcattaaaaaatattacccacagatcagaagactgaccagttttccctcaaatttgcttttttgccagcttgagaaccaccctattgactaaaaagttaaatgcacagccatccaggaagaaatgcaaaccagactgccaaacatattatgaatatattgctcttcttaaaaatgctagttggtttttcatactggagtattgactaactgtctgtgtttgatgtatggtttaccagcctgatgtcgacttatggttagagcttaacttgttagttctgcttttgcagccaattcagaataactacagatgcctcgagatattaaaattgactgctcaaatggactcagtgcgggagtttcattggttttaaattgataacagctgaaagagtgaatgattaaagtgtaaatgggcataggacacagctctttcatagaaacacttgtgaacagacttcagtagtgtgggagttttttctttctttttctattgtagttatttctaagcaaccttgagttaaattttaaaagtgctcaggaatattcaggagcctagaggagaaataattcctgagaaactgagataaattttgatgaagtgggtttctattctacagggaacatttaaagttaagtagcattccataaggtggtaattgtgtctatttcccaggcatttaagttaagtaagctgtgtaggaagtataaactgtcataatagaagggttagagtgttgtgtacatctctttcttcaactcataaaaaccaaagctccaaagtgccttatcacagataagtcaaagaaagcctctcctttgctttcttattctcctaagaacaattattattattttcattatttaaaaagatgttctgaatactttcttgtcgcatggagaaaaagaatacaaaagagaaataaaaaaacttttctccccctccttaaatcagcaatacttatataaaacaggctttatgaaaacttactttcaccatttaatagtagcttaaggaaaaggcacagtaaagagaataattaagtgaaatgtaaagaaatttatgaaaaagaaatatctgtttataatacagccctttttcaacttaatatctttctaagagttaggtgtgctcattatacaatattgtgacctagctcctttctgttttcaaatgtctcttagtattttatctttgatattccatcaggaaatatttatacattttttattttatatatttttatatatacttttttaatatttatatatgaagaactttatatagctaactgattaaaagcatcaatctacagtaacacattaaggcaggatttgttgacaaaatataagtccatatagtatgtactaatttcacatattcattttaaaaaaattgaatcattgtgcctagctagtatgtccccacatatgtagcaaatattcaccttatgttaattacaatttgtggaataagagatttagatatatttgacagtaacattagtgaatagtgatatgtatgttcagatgtaagaaaatcaaattatgaaggatgctctgactttaaaacaaaataagccacaaatatcctggtcaatgtttacaagaaaatgtgttatatatttatttactgctcaaattttccccaaaattataatgtatatacctggaccacatcttaaaattgcagactcaagttgccttcatgaagcatacagccgttgaatcatgcttttgttgtgatagacagcttatgcagatagccgtctaagaaactgctaccaaggttgacattttcacaagatataattcctttagatatgtagagcaaaagagagaaatttcattctctttcaacagttgttcagctccaattttgtaatgattttttaaaatctatccatatgagacaggagggagattttagaagagatgtcatccaaataaaacatatgtgagggtcattaacttgaatataacactcctaacatgtccctttgaacttggaactcagattcataggaggaaagaaaagatggagctgaaagaggcctggtctgggttaacctcacagtaaaggaatctttcacataacaagagactgagaaataagccgatggtataaaagtgatatcttgaggatatcttaatatggtgagattccgaatactctaaatttcagaaaaaccattgctcccttggactccctcataatttgtaccacctcatacattcattcattccctggacagtgaaatacgatgtttacatcttttgtgacttcacattttaaatgcattgaagcctttacaatgttacaatgagcatgttacaatgtttgcatcttaaaaaagtaattagcataggagaccatttgatattacataaagaatttgacaggacctcactcaatgccttttaagaaataatatcgaaagaggaagtgagagcctgttttagttataaatctgttcacataattaccagttgaagaagatatcataaacattttagaagagcgaggttagaccctcacttcattaaaaacagaattccaaatgatgtcagatacctccagttctctagcatccgtttcttatgttcatgtacacacttgcatgcatgcctttttagtcagaaagatcatgtatttgtagtacgagtaaataattttgaagaaaaataacattggttagaaatatactactaaacacatgaagagagacaaccagatctgcatgtgaggttaagttcaacttgagatgccacagtgatatggacaaagtattccaaaggtggctttgcagtataggaatataaatattccaaatgtgactacacagtgtagcagccgactggacttttccataggagaggtctctgcctaggtttctctactacagcatgaagaacaggatgggaagcagaagcttttgccagggagctgtggcctcaaaggtattgaccgggcaggatgtgaatagtgggtaaagttggcaccacagccttacttcatccaggacagaaggtagaaagtaaacagtccattggaaaatgtttggggacacaagacatgggatctgaggaattctaggaatggtagtaaaagactttgggtttggctgggtgcagtggctcacaccagtaatcccagcattttgggaggctgaggcgagtggatcatctgaggtcaggagttcaagatcagcctagccaacatgatgaaaccccatctccactaaaaatacaaaaattagctgagtgtggtggcaggtgcctataatcccagctactcgggaggctgaggcaggagaatcacttgagcctgggaggcagaggttgaagtgagccaagatcgcaccattgcactccagcctgggtgtcaagagtaaaactccctctcaaaaaaacaaaaacaaacaaacaaacaaacaagactttgggatcaagtcttagtggaaagcacttccctgtgataagccaaagccatctgttcctataatcagttattacagcatgaatactacccaaagcctagaggaagcttctgtgtgtggatcgttttgttgttgttgttgttgttttgttttgagatggagtttcactcttgtcacccaggctggagtgcaatggcacgatctttgctcactgcaacctccgtctcccaggttcaagcaattctcctgcctcagtctcctggatagctgggactataggcacccaccactatgcctggctaatttttgtatttttagtagagatggggtttcaccatgttggccaggctggtctcgaactcttgacctcaagtgatccacccacctcaacctccccaaatgctgggattacaggtgtgagccactgtgcccgcccctgtgtgtggattctttctggcctcccagatgcaactctctgagaagctgccatgaatgtgtatgttgagcttcagtttcatttactgaccaggaccatggacatcgatcagagatctgctagagagagtctgcgctaaccaacttggcataccatctgcatgctagtagtggtctaggaagactctgctggggaaagcgttagccttttggctcagccttttgcccccgttatgaccagcctagaatcctagacacaaagaacatctaagaaaatatgtagtgcgttcttgggagaaagagatactacagcacaataactgtattagttttatataatgtttgagtatgtaaagcacacttgaaataattaaaatacatgaagaaaatctttttctttttgtgcttgggtgtgtataatgggaagtcataagttgtagtgaaaggggcaaccaagactcttcctgtgctatttaaaagagctgtattttacttattcaggaaaacagagtattgcagaaccataaagattaccaaattttgaagtagacttggctctgctacttacttgttttgtgaatttgggcaagatgatgaaatgttctttcttcacactctccagctaatacttctcaggactggtaatgttttataaaaagcaagtagcgtagcaaacaatagctattgatggttatactctactcccagttctacttagtattgcgtaccagtccttcacctgactgcagagaacacattctgaaaattgcaaaacagataatatatgatgagattttttgtgacattgcattaaaatacagttagcattttgaacactctgtgtgcctagactgtgattataactttttcaggcattatccaatgatgaggatgaagagctatgcttgcatttctttatgctacaggtatgattgttattcctattgcctactgacatgtattctctgagccactgtattctgagaggatacaaagctacacaaagcaaggtccccaggaagtgagtaaggaagataaatgcacaaaaacaacggtgtaatatatcagatgtcaaatgctctaaggggtatttaggtcacaaatttggggaaattacacatggaaaagtgtgggaaagattaatgcttttatcattttatggtctttaaactgagccttgaattagagccttggacttttgtaaaaatgggtgagacatttgaggtacacaatcgtaggaaagtctggagaacagccttagatgaaatgtaaagagtttgatgagaagaagtgtctgtggcaagtgttttgcacaatcccaggcttaggagtttgtattctactttataggcaattttgttattcatttaatattttttatttgtttttatttattttgaaaacatgtattgaggacctagcatgtggcaagccataggctgggcactgggcctacaaagatgtataagttgtgattccatccttcaaaattagacattccagcctgcttggaaggaaatattctgcctcaagaaaatcacctccatacccccaaaacttggctccactagaagacacactagaaggctatattatgaaattggtacttgttatctactttgagttaattcctacgtaatcgcaatggccaaagcccctgcagctgtgggaatgaacagagtaacactgaccttacagcacaaatgtcccaagtcatggctccctcctgtgtaatcacaacacagcctttctctgcctcctcagctactcaagggagtccctgaagtgtgttgcacaatttgatgaattactgtcttttgccccattgtgttctcctctctcatttctttctcttttatacccttactacccacaagctgcctgaagaaggcaccttaccttggctgtgcagccagcactttctgagagttacctgcttccctgcctaggtactggccagggctcctgagcctgcaaaaccttccatgtgccagaatgtgctccatccctctggatcccactgaatttctagtccactttgtcttcaaaggaaacagaaaggctgttctcctccccaccctgcctgcatggtgcacctgattttttagggcctgaagcaacaactcttactcattgaatctcacaaggtgagagagtagcttctttccactgtgtctgaggctctttcctcaacagaaattacacctagtccctgggacttagccagagtacatgtgccatttgccatatctcaggagttcacaattctcctgactgtgttttaccaactaatatcagctcttgcaagtaagcatccatggtggcgaacatcattctgccaatacagtaggcagatccaactgagatactccattccttctctaagtcccctccctccataagaggtcccagtagctggaaacataactgtcaagcatgcaacaaacctggcaaatgagcaatatacaaagcagcatctcacaacatgatacctattcattcagtttggtgggcaactttgggacaggataaggtgttttggaaatgttgttgcattgtcactttctgcagtagaaactgaaaaatgagaaacacactgtgtttgactggaagcccaaaggagacaaaatgttttcagaaatgtgtgcatcatggcctactaatttgggctcataactactctccaattacattcctggaaatgtttttcaatttctttgcgtggaataactagcagaccacagtgctcagaacagcccatggggaatggcattcctgagtagaggttacatcacacctccatggaactagccagcccttctgcagaaccacatgattccctggctcttaatatggtttattaaaaaatcctttacctacctcaaagcacttttcatcaaagccacttttaagctgaagctgaggactaaagaatgcctttaacagaatcctgaaatagcttttaacctgaggctgagagagaaagtgcttttaacctaaagtgctttcctcttaggtgcttcagtgcatacctagcactcagcattagtggctttgagaacacccttaagacccaaatgaaagagactccattattgatattcaaacctgttatgttaatatattaaagtaatatttgaaatcattaagcagttttactccaactaaatttgagtcttttcttattgaactatgcattcatgcaaataaattgaagtcgtaccacctgggattctaacaaatctatgctgatattaggaaaagtacagtcttctttcctaggttttactttaatctagagtgagtcaaaatttctacactttccccacccaaaaagaatctttcaactcttctcaatcactgaatgacacttccagctttagtccatataagttgtgccttaaagataaatcatttagtatttttaattacctgaataaattctgtgtatcaaattttctcctcagacttgtcactcaaacaaatgcaattaataatttcacagtagttttaatccccctataaagttcctacttagtcaagtaagtgacaacctaattgataagttttaacttcagattaatagtaagttatataattgagcatgtgaatttcatggacagttttctattcaaagtatgtaaagaacatacaaatatgggagaaggtagcagaacttaacatttgaattgtattacccttcccttcctttgctggccctctctgtaattctaatgagatgatgacaggcaaatgaaaagcagaaaatatcatcaatccacaatgtacgtcaacagtcagctgaacaaaatttggtcatgttaattatttgaaatacatgaaagcaaacaatgaaaatatgtttccctcatactcaagtgctcatattacaatctttagatagaaatcggtttcttggactacaacccagtgagaaaatattagactaattagtctgtcctactgtggtctgttagaaaaaaatattgaaatattagggtattttccttaaaaaataaaaacattctttataagctgttttaatatcaaaggaaataattttcttttgtaaatttttctcatatttatcttttaatctattcatacattcatttatgcactcattaggcaaccagaaggcatgtaatataataaatgcaataaatataaatacaagtagaagaaactgcattcatcttttcctaccgtgtaaagttttgttgaccttgaatatcattttgtagcttcctctacttagtaaaattgtaatcatttttactcttccaactcagttaccagtgccacaaagctatccctttcttcttcattctcaattagtcctaccttctctttatccaaaagctgtaatttcattattttaatatctttcaactggattatgagctgtatctagtagaccagatactattttactgaactccgtacttccaggagttagaaagaaataaggaaatgaagctggacatgaaatcttgcagtggttttagagttattatttacagcttcttattacttcctattgaaactctcatgtcagtgagtgcccctttggtggatcctgctcttctccccatcttcagaatgttgggttacccctatgttaaggccttggacttcttttctcatttcattcttattctcagactattggacattaaacattcagagttgaaatataccattcatgcagcttcgaattccatctagaggttgatgctttccaaacttaaaacatcagtctcaaacttcagacttgcatattcaaatattgatttcatgtcttttggggtgcttggtacatatctcagatttatctagagtaatccttgattcttcagatcccatgtgtcctctatctcaggaaatatcactgccatgtgccacctgggatcacccccgctttctactctgtctcttccttcatcagtagatcccacctttaaaatatattctaaattcaaccacttttgattacttccattggattcattcttacccaagcaccatcatctcttcctatatttcactacccccctgatgagccttcctacttctcctcttaacccccttaaatctaggcttcacacggcaattagaaggatcatttataaatgtaaatcatatcatgtcacccccccctcctccataatctccatttacttagaagaaactcattcttaatatctaatgtgtgtccttcctgtgacctatagggtcctacctgctttgaccctgaggctacattttatgttttttcctcagccatacttcctcttgttcacaccactccagccactcaggccttcctgctcctcctctaaggaacctggcttacaccagcagctttatacacttgctgctccccttgtatgtacatggctcagtcggtcacttcatttggtgtctgctcagatgccattgcctgagatgccttccctggcaacaccaatagctctctgtctctctgccttgcttcattttttccatagcgcttatcaccatctgacattatatgttaatgtgttttcatgtttattttccccatttacatatagactctgtgaagacagagagtgttcttttcactactccatccccagtgggcattgaaaaatactcatagatggttagattcaatggataaatccaaaaatgcataaaggatttacttggtgaaacccttctctatgccgttgtgattctgtgtgctgacgtacatgtgtgtatgtgtgtgatgttgctttagataagcagagggtgggagagataggtacaaagtattgacaaagttcttgccttgagtagacaaatatagaagaatttcatgcgcacagtgtcccatttggttaataactctttaagatgcaaatttcttcctggctggtgtaatcaccaaaatgcctactgcactagtcagaccaaaattagattgacatctatttccaggtgagtttaggagctgaaaacgaggggccaaagggtacttcacagaagtactgtttagggttgagagtgaaactatgaaaactgaagacggccagaagcctgagaaacaaagagaaaaagtagaaagggctgggaagaacttttctcttctgtcagtcccatccctgaaactcatctttgggctgccttgatcaaagggtgctacccccgcagctaaatgtccagcttcatttgaaagctgcagcaactccgctatccttgttcggggagatcctcttcccccaggctagtctctccgtagcagatattgtcattatcaccagagactttagaatctgttaggtttgatgagatgcaaaaatataaataaacatgtgggggaaaactattcacagaagcgcatatatttggtaactcctatttatttagattccaaactacttagaagttaaagtaattaagctttttcttgtacttgcctcttatgaaaaaaaaaaaaaataagtaaacaaggcaatgagagaggtttacttccagtgcatgtcgtagattcagcagagaatcggcccaatttttgatatctatgtaacataaagcagcaaccgatatttctaatcaaagccccaaagcatcataagttaacgcagtacctcctgaagcacttacagtatattctgtcgtgttttagcattaggcgtattttttctgtgtcttaattcaaaaacataggccattccataacctatagcactaacagaagtcacccagttctccaaacattctcagtaaagttttgggaaagttacatgacatggggctcatgtcgtgagcattttaaaggaaaagaaaagatggtgggaacagaactggagaaaatataaaagatgagagtagaggctgggcatggtggtccacacctataattccagcaccttgggaggccgaggcaggcggatcacgagctcgggagctcgagaccatcctggccaaagtggtgaaaccccatctcaactaaaaatacaaaaattagctgggtgtgctggcgcatgcctgtaatcccagctactcaggaggccgaggcaggagaatcgcttgaaccagggagtcagaggtgtagtgagccgagattgtaccactgcactccagcctggcgacagagtaagactccctcttaaaaaaaaaaaaaaaaaaaaaaaaaaaaatagaaacaccatgctttgataagcaatctaaaagttttgggctgaaaaccaattctcaaaaggaaaaactaatgtaatttatagtttaaaatcaaaagatggaattattaaattgctgaaatcacccatgtttggaatacgattttgtcttccaatatccgctgcctctctattatagcaacttagtaggaaataatctgcccatatgtgtggcattgctgtgggagaaaaattctaagtgaatgctacctactatggaaactacgagggctgtattttctctccccacccattatttttataacataatcctgatcaatgaagcatcatctagagaaacttccagtctagagcgattgatgactggaagttattatgacaatgctgatgctggtggtggccatgaaatgagcaccctgacccagctaccagagttagaagacagtcgctttttctccttcttccaatttcatggctccgctaagcatcttcatttctgaatatctccaagactggtcccctagcctctcataaattcattgaattccttcctacttccacccctcaacatcattcaaataaactttccgttgcttaatacagccacagtgttgtgtttttccgttgcttgcagccagaaaccttaatcaatatacgtcattaccacgatagttggataattgtctgatttgtttttgtgactaagccatttgggctgccattattgttttctgcttcgctctgtgttccgcatgtgtgtgtccttctaggtgctttgttcttcctttttgaagtttactagaatcgctgcaatggccctctctcctgaaagcagagtcacatcattttgaaaagcctgtggagactgtctcctgcataaatgatgataaaaccgtcacattatttgaacatttaactgcctctattgagcagttgtcctcatagttttgattcatttggaatctgactgacagagatcccattactgggtgttctttccataatttgtcaaaaaacttatagcagtgatgagggagaatgaaactaatttgtaatctggaagacttaacctggttatgctgatgaactaacaaaatcggtcaaaaagtttgagagcttaaagattaaaaaccaccattctctagttaaacactaattcattatgtaaacaacatgatttataagggcagtcatgtggagggtctatttatttttctcaccaaaagatgctttcaaagaaaaattgcagaaaatgaattttttttcccaatcaatgtatatcctgccacccctgatcattaagtgctgaaacggtgggatgaagatagaatgatcacactggccaaggtcacaggagtttgcagaagattccaaaaatattggcacccctagcaagaggtgctttctaaataatatgcatatttttatggttgttaagtgaggaagaaaggattaccagtaagcacacagatgggaatataggtgggaagtcaggagctcagggttttggaagtgttcttttttgtttgtttgtttgtttgtttgtttttgaagaggagagtagaaataatccttaatgttgttccaggacaagagacatgagcatttaggggacaaagttcattaatgcttgcctggaaagcagaatgccttttctctccctccctttttttatactattttaagatagaagtttccatggctcaaatggatttctatcattgaattgtcctccttggtgtatgaaactctaggtgtattagatttacaaatggagagcaatcctaccacagcacttaaattcaacaatgacagtgtagttaaatctctgatttcctttctttggacagcactatttactttgcaaagccatgtgatgtgcattatcatctcttctcaattatttaattcattgtctgtcaagggctaatgttgtagtctacattctttccactgtaaatgacagaaacttgtccaaactgtaaaagtcagaatggaatttactagctacttaattgaagagtccaagggacagggatagcttcaggcatgactggatctaggagttcaaaatgctatcaaatatatttgtcttccatcactcagctctgttttccactcttccagaggtggcagcatagcgtctagaagatcagactcatatcttcatagtttaatatctctcataaaaagagggttcctctctcccagtaacatcagaaaaagtctcaggatttacttgacaggatccacttgggccacatgttcatgcctgaaccaattactgtggccaagaagataaaatgcatattcgtcactggagatggagagggtggagtcaacactacccaaaacaaatggcagcaaaatgagaaaggaccatccccaagggaatctcagggtgttcttgccagagaataggaggatagacacaggaccagcaaaaccaattgatatctaccatactcttcctagccagtgtcatctgtaagcagtggatcccattgagctattttgccagacctggtcctgttgtgactgtaatccctttcttgaaacgtttgtccaatgctacatccatatttttgccaggtgtatttgcttgcaataaacagaaatttactcaagagttctattaaaatgggtgggaggggatctcatggtatttatggagctcatgacatgggtatggcaagtgccatggcaaggatacagagtgcctggagtaggcactggaaagtcaggagctgagttggatctgttccatttgcctctccctgcaaactagttcctgtgtccgctcatctgcggcacataagcatcttcccaaattggctgtcccagcccccagggtttaagtgtaggcagcctagagttctcatccctagaaacaaccacctcagtctctcagtatccaaattctaaattttgtagaagaagcgttgctttgttcaagcttggggcacatggtgacctttgatgtaaccaagttcacctgagatactaggttcttgtactccagagccccaccttcttgggtgagtacagcaagtttcaagagaggctataagtgagaagaacagttttggctttgctggtaactggggaaagcaaacatctgccctctagctagtgaaattccagatgtctaggctctttactcaccaagacaccaatggcagtttttcccttgtgagggactggatgcacttgcctggaccaccagtaagtggcagtaatgtacctcccccacttccaacattataaccgctaaaaataatcagcagtgtacttcacccagctccgtggcaataaaaaataccctgtagctgaaattctctcctatccatcccaattcaaaatcctcttccaggtcttatctccacttataactaagtagtccccatatgctagccttttcacctctaaagttcttaaaataggagtctatttgctgtctctacttcttcaccttctcttcaagtcttaattacaactatctgcttttcagtttcactcctctactgaaaccatttttcttaaggtcactcatatcctgaaattgccaaaatccagcgaacatttttcatcttgatctctcataaccattctgctgcatttgaaatacttttccttaatgtctaaattccatttccattctcaagaccctcaagtaactgcatctctgtcttctccagtcaagcaaggaacttggcagtcacttttacctggtggatcagctcacctcctacacccacttgccaaacccgactgaatcactccttcttgccatgacaggtttattgtcttagttcgggtccccatcctccctcccccaagagcctaatgctctgtgacctttcacaaataactcaatatctctgggccttagttccctcttctgtaaaatgaagatgatgatagtatacacgctcaaaggattgcaggtgcatgtgagaattaaatgttagaatatataaagtactttgagccctgcttggcttagtgtagtgtacaataaaccctcactatttttttacacgtatctgcaatagcattagtcatattatgttgtagctgcttgtgacagttattctgtccacctaaactgtaggagatggtgcatcattacattttcaggctggcacacagtgtctggcttataacctgcatgaaatagttactgaatgaataaagcaatctttgcattatttacaatatggagcacatggtaggtgttcactaaatagtcactgaatggaattggatggaattgggttaatctggagagaatgcagaagaggtgccataaaatttggtaaggcataaataatttaaattttaaggtgaaagtaattttctttgagactcctcctgaggattgaaattaaactgaaggcataactccacattcttagcaaatttagaacttttttttctgttttgttcactctccagttttagtttccatgtcctgccaaccctctttgttttcattctcacagcatagcttagatcatatttcaccaaaaacctggactcatcaccacctatgtgagtaagctattgctacatgacaaacaaacataaaatctcagtggcatataacaccgagcatctatttctcatgtgtctgtggtgcaggcttgactgggccactctgctttaagctgcaggtctgactggacttgtctcttcactgagggttgccctcagttctgtgccatatgtatgtattctggagcccaggctgaaggggcagcagctccccagggaagctcttctttggcaatagcagagaaacaagaggatgagtagaaatctgcaatgcgtcttaaggcctcagtctggaactgacacatttccactcacatcattccaaagaagacatttggccgagcccaatatcaaagaaatgggggaaaataaacactgcacactctattgggtggtacgagatggttccatggcaaaggaggtgaatgtatacatctaattcagagaagacaagaaggattgtgcacagtgattacacctatcacacccttatcctgattctggtcttcgtaacatctttcctaggtaatcacatcagtcgtttaactaatctccttgtgcttcatcttccccactatattaacccccccaccctcccttttctttacaaagtgctaccaagtaaaccttctcaagtagagtatgattataatgatcactttactaaaaaaccacaatcacttcctaatgtcatgtcatatgcttttggctgcagataatagaatacctagttaaaaatgacttctttcatatgaaaataagtctagataaggtgttttagtgttggtttaaaagctcagaagtgtcatcagggtctcaagttttgttgcttatttttaatacattagctgctgttcttagcactcattgtctcatggtgacaagattgctgcaatagctccaagcatcacatcattgcaaaatgatattcaaagatggattaaaagaaaaagaaaaaagacttcttatatatccctttcctttcttcaggggaaacaaatcttttgctatatagtcctgagtcactttcctagacatttcattgaccagagctatctaatcacccaaagttgcagagcaggtaaaaatcaatagagatgattttcactttctgtcatatgagtggcttctaaaaacaagaaagaaggtgggagaggaattacttatatgtagaaaatcaatggtatctgcacactctcaaataatttaacttacctggcaagatttaagatgctttataacataacctccatctcttttataacttaatacatcaagatttctctaagagtgaatgtattcctcggcataccccagtcttcctatcattcttcccatcattcatgcatttgtttccttcctttcattcccgaaaatgctctttgttccctcttttacttgtctttccttatctttgaggattcagttattcagagaagggaagcactcaaggctgatctgttgccccaccacatgctcccacattgcctctgcgtttccccagttatagcagttttctcatgataaaatgttcttacctgtttacttatatactgcctctactgggcaaagatttagaaaatagggaatgagtcttggttgttatattaccagagcctttcctagctctaaatacagtatagccactcaagatgttcttttgcaaataactaaatgaataaaagagtaaattccctggaatgctgttgtctgtatcttctcatatccacctgtctaaaacaaaacaatttctccaaacacaaactctctctctcccaccctctgttgtacaaacatacacacactgcacaccacgtctacactaaatgacacaaaaagacctcatactaaaggacatttttcttagcattcagtaccttttatgacacctgctatattcttttttttgtatattctttgaatacttttattagccccctataatattacaaacttctcgatattgtttttacaactcaatatgcctacctcattgctgtgaagatagaagataatatttgtgaaattgatttgagtaataaaatccattaatgggttttttactttatagcaattcttcttcctgactgtaatctccagacaatgtaaatcatttgatctgatctactgggttattttttcctagataatattttatgtcattctttcttggagtggttacacagtgttttgaacaagtcattgttacttgaccaaagtattcaaagcaaatgcccattactatttcccacttctctatactatgtccatgtgttttgagcttctttctgttacttggataaaaatgcacatttccatattggagttttgtttttgtttgttgttgttgttggtgttgttttgagatggagtctcactctgttgccaggcctggagggcagtggcgcgatctcagctcactgcaacctctccctccgggttgaagcaattctcctgcctcagcctcctgagtagctgggactacaggcacgcgccaccatgcccagctaatttttgtatttttaatagaaacggggtttcaccatgttggccaagatggtctaaatctcttgacctcatgatccgcccacctcagcctcccaaagtgctgggattacaggtgtgagtcaccatgcccggcctggagtatattattaatagtgttttagctttaattgttccctccatgttgggttgtcaccaattcaaaccattatgttttcctaagaaataaatgaaaattatgattcattgaattctctctacactcgattttgagtatccccttataacaatatatatcactgaacattattttatgctgcattattattctatctaattttacatatactttaaaaaatgtattgactacctccactgatggttaagatgatgtcttgcagtccctcattctacaaatgtttattgaacttctagtatgtgccaacactgtctaggtactcaggatccaataataaatggttgagatatgacgcctactctcctgggttttgccttctaagcaagggaaacagctaagcagaaaacatttcagtctcatatgtcaagtggagatatgtgctctaagaaatgtaaggctgggaaagtggcatagagaatggcatggagtggagccatttttttaaaggctggtaggaaaggctgcaataagaagataccatttgatcagagacctaaggcaatggagttccatgaagaagaaaatgcaaagtccctgcagcagaagagtgcttggcagccatgagaaacagcaatgtggggctattacaaatttaaagacggggaggaaagacccaaatgaaatccattaattagtggaggtcagattatgtaataccttataagttacagtagggactttgatttcattctgagtgaaatgggaagcccttggacccactaaatatttgtttcattatcagtaataaacagatactatctcaatagcaaaacccagaaattgatggtggtgagggttgcacaacattgtgaatgtacttaatgccaccgagtggtacatttaaaaatggtggaaatgatcaattctatgttatatgtgttttaccacaattataaaaaacaaacatctgtctttaaatactgcaggccagagtctgtgcaagcactggtgaagacatagatgattcagacactcagaatctgctttgagagaatctattccatatattataaatgtaaatacacaatgcaaggtagcgtcaatcatgttccaaatgagagggctaggctaggatttcacagtgggtattctcggaaacattagtctggagacatgctctctgaaatcaaaggatgttgctcaaataagtttgggggaaaatgcatccttcacccctcatggggattcacagcacacattggcatatcatgggctttaaaaataaatgcatgttaaacctgtctaactttgcagaacctaatgatgtgaaaccattttgttcgcaggccctttttcctgaatcatctattaacagcctgagggtctggtattccaaagaacctgtgtcacaggagacacaaagctgagataggaaggagttagtgaagaaagtgtgatctgaactgagccctaaaggaaaggtgatagttagattagagaagaggaagggcattcaaggcaggagaaatgctaagtaattcacttcgaagcaagtctcctagaacttgcctcctcatatactattgagttgcagaatgaatgtcctaaatatactgataacattgtaattttcgtaaccattaactggtaaacttcttctaaaacactcagtataccaaagacactaagataaattattttgcaaaaattttctcaattctttgtctttcctttatagaccacaaaattaaggcccagagagactataacttacatagtcatccctgcctaatcgatgcctgagcgtcagttttctcactctggggcgagggtcctgttccatcaaggagggagttgtggtcttcatatgtctgccatagacactatggaaataaagcaaaaaaaaaatcttatgcaagatgaagatttcagcatgcaatggatatggaaacggaatcaaattaaagaacaacgcaagcttggattttaatgaagctcatctttgtttcttttgcagatcaaatttttggctctcatctgcacaaagtgtgtgaacgtgaaaattccacagttccgtggtttgtaaagcaatgcattgaagctgttgagaaaagaggtgggtgactgaatgtgcagcagttccccccattactgcaccctctacacaaccaatactcaagttagcagtgccacctgatttgtctgagaagccatgcaattaaaacttgacttgtgttaatcggttaagaggatcatctttcttattaacttcagtttgtttttacaatagggacattagtaattctcactaatgttcttttttgtttttaatattttgtctgtctgacttactgttgattcaagtgcaaacttcttgttttcaagccagtgataaaacattcataaaatatcagcactcacagtgttagaaccttcctaacattcatgctggtagacgttgtgccagaacaatttttggtaagcccccaacattacccaagttaagcaaatagcattctgaatcacagacagtgatatcccaccttccacatgtctctgttcagtacagaatacgctaacgggttttttcaggaacaattaaaagacacacctcaaaagatgacctttgattcctctatttcagcattctgtttttcttctgaaattatttcatcttactgaagggaacaaaacaaaacccaactgaatcatcatttctactccactctatctgtggggtgtttttccttcaaactatgacttcattcattcaaggtcatttttcctggaagatacatatagtagatgcagaatcttaaaaaatgtattgtataaaaatgcaaggcttcatcaccatctgttacaagtttacaacatattcccaggatctagggggatatatatcatgtaaaagatagaggtgttttcagaaaaaaggattggtgaacctattcccatttccagctcctagtctcttaagacaatagaaccaaggggaaaaaatctttacccaataatctactaggaaaaagccattttaattctctcagtgttacctggctttattataaaagcataataaaaatggtctgcaatttctaactcctggaaattcatactttaattatactgtaaggacagccttgggatcctattattcccctatcagtagggaatgagagaataacaagaaggggaagagtgggtagggaatgtggataaagagaatgactttggggaaagcatatcaacacatcagagagaagagcagagagtacagtgagagtagaaagcagcaactgcaggatgaacatgaggagaggtatctgtgagaaatgaagtcaattggagtttagagaaaaatgtttttattgcaagttgcaatttcatttaattttataagtacatttttaggaataaatattctttggtaagtacttaaagacaaaatggatcactgagaatattataaagttattatttccaataactaaattgtcatcattttcaggaaatcttcatccacttataaatactcagccctgacagtgtgagcactattagaccaaaaacccaaatagggcgttggggaagcacataataagatgtgtgcatgtgtaaagaagcgctccattcctcccgatttatgtctccaccctaggcaaaacgaaaaactgctagatgcagctttgcggtgtgcagatattataatattgcagagtagaaaacgtctataaatagaaaccatgtcttttgttcatggcattttgttggtgatttttaataaaataagacaatgtttttgctgactggagcaatcacatctagcattatatttcattgtccctgtgtttactcttaaaatgaatttgtagatccagcactaaacaggcgctaatcacacatatgattattaaaataattcctaagcattttaatgaaactcaaagactttccaattccacaaagcaactgataattcaaagcactttggcagcatcagcttaaaggaaccctatggaaatattcagtaaaaactaagaagcacaagataaacctctcacatcattgcaagatttacaagtgtgtacttttgattataattttctatgatcattttgttggattaatattcttatatttatacaccaattctatttactcaaagtgttgtttttacgaaattctggcataaagcatttcaggacagaaataatttatgtgaatctaagtccaatgtttatgcaggcttctgatgacattttatgctggggttggtattaggaagtagcatataaaggcgccaagtctctcagcatggctgggactcagcatatctggatccctccttctaatggccagatactctcccagccaagaaactcaactgcagagtcatgggaaatgctgatggaccagttatgggaaaggaacatttaatgaaaactatgtgtttactctcacagtcttagggaaatggtcttgatactcactacatcggcacattggctgttataaaaaagatttgtttccttctctttttttttcttgtgattattttttactcctttaaaaaaacctacaaattgtggctatatctctaaaatgcttattagatggatgatttaaaatgaaacattatcaggaaggcagatctcactattcattcattaattcattcatttatccatccagtcagtcagtcagttatttgtcttacctgtttgtaatgaacagagccaaattgctcacacttctgtagtctctccaaggaaattctacccagtacttggcaaaagatgcattctttattcatccctggtaaagtgatattagttacattttaaattttgcaacttttggacatgcctagaagaaaatctaccaataaactgaatgtgaaccaatttagctaataacttgtttagtatgtttccttatcttgatttggttctctttattactctaaactaccagagcattctccttctcaccaactattataactagattaacttcatttctgtggtttctgacattgtctgctgagccttgaaaatacaagcaaaatttggaagacaaactgttaaggagcatgttagtctttaaagctcttccaagtggttccttcccgcttgccttgcctttatagtcgtagagcatgtatatgagaaatcataattagccaatgaaaaactcaacttatgtttcttttttgaagcaatttctgtgaaaatattaaaacacggttctgctaattcttaattcatatcctgggtacaatgaccaaaagcatgagatcatctgacactattttggaggtttgaggaaacaagcatgtagagcaggggtatctaatcttttggcttccttgggtcacattggaagaagaagaattgtcttgggctacacatagcgttacatacactaacgctaacaatagctaatgagctttaaaaaatgcagaaaatctcataatgctttcagaaagcttacaaatttgtgttgtgctgcattaaaacccctgggccatgggttgggaaagcttgatgtagaggaaggcattgtgacatatagtagatacaagcagtgagaagttcatttttcactatgttatagaacactttgtgtagtttatgatgacgtcatatgtgtagaaattgcttacttaaaaatgcgatcacctgtgtctcttagatagaagggcctaggagacctgaagtaaacaaagtatatattttaaactggtataacaagtaagaccttaattcatagttctttttatgcaaagcatgtaattgactatcctttgttgaggtccattatttggaaagaagctttatacagcacgtgacaccttgtaagtactcaataaatattggttaaatgaagcaatcgaagccaaatagctattgagtacctactttgtgtcatcttccatgttaccagctgataatacagaggagatagacattaagcaaacagacacacacggttatgtatgttagcataaactgtgataagtactatgagagaaaagaacagaccctacaagacagaagaaccataacaataataaaaagcagggaaatacgtgtgtttaaaaatgatgtaataaaccttgaacgataaacacatatttatctggttttatcttcattataagaccaggagacatttaattttgccttattttgcaagttattttcttaacattgtgactatgtgatatagggagtcctttggtgtgagatctaaaaggacatgccttaagtggcgaaccagtcatgtttctacccaataataccaaacatgcattttgccaaatagatattttatataagagtagtgttaactagataaatgagcatatttctaccctaaagatatttttatggatccaaaatttttttggttttaagggaataacattaatttttttaagtttgtaatataatttagattagcattcatttggaatatgtcttaactcatacttccttcatgattcccggttctggttaatatgtacccaaactattttaaaacattaaaatgatacctagagatttattgtacaacagtgtgaatatacttagaattactgaactatacacttaaaaaggattaggaagagaaattgtatgtcatatgcttttgaccacaatttttttaaaatgaaatcatgtttttcaaatgtgataattccaggtataagcaactttgcagaatgcctcagcagatgctaatcaacaagaagtttgccctttctgtcttttttctggaacacgaaatactatgacaggaatggtacacaaagttacatatttgacttggtgcctaaaagccaccctgggatccataaccttgcttaaagatttaagaaagacctttagtctacttctgagaaggtccttagcctcaaaaactttatctctcaacttgacttcttagcagctgttatattttttttgctgtcgtttgtttgacaggatccagttataggttccgatgtctgtttaaagaaacaaggaggctgttggctttaaaattccctcattgcttgtgtgatcagcattttcccaggcttttctacatagtttgccaagcaaagggactgaccttttgtagcaaacactttttcatttcaaaatgctcactttgatttttgtcccattttatgctcattccaaactgtttacaacccactaaaaatgactgtgaattatatgtttgtgtaatggattccttttgtggtctgagtggaatgtttactttgaacaattagttatctttgggtagattatagcaacttggaaaaaggatggctaaaattattattataccttaactgtttcttttttggtaattcctctactgttaggagaagtttgagagaatatgaaattaacaagcctgtgacattataaatgaaacctgtttaattatgtgactatttggatatgtgtgttaatatcacgagaaagcgtggctggacacctactcaactcagtaatatacttatctaacaaaaatgtaaaacttggcatgtaaataaatacatgaatatttgccatatacatgttgcatttgcatatgcacatgaatgtgttatataaataacagacatgttaatacagctattgtacagtacccattgtacagtatagtagcaagcattgtagttgttaatataattttcctgatatttgatccagtgcaccagtctgcctcttgagatcctaccgagtgcttacttgcaaaaatcagactttacatagttgtttcccgttgcctttgaatccaggccccgaaactgcagatcatattgccttccctagacaagctctgctcccagttctgctaattttatactgttcattctttcccactttgggataatctattatagttggatccaggcacgcactaaaggctgatacttccatgaagaatgtgcaatttgtactgttaagtttgtgatgagattcttgaaaacttttatgattctatcttgttccagagagacttctgcttgctagttttataagcagtgagtaaaaaaaagtaacaaaaacaaaacaaactgataaaaattacatgctccaaaaaaaaaaaaaatcaagagtacaagataagcactttttctttttccctggagaatatttgtggactgaacaaaaatgtttctgaggtcagtgacctatgtttttgtttttttttttaagtgtttgcttttcatgccttatgttaggcatctgcatgcatttacaatggaggtgatcttaaagaagctccatgaaagtttgcagtgaatctccttggcttttctgagttaaaattaagaccagtttagtgctttggtgttttgtgttttgttctgttttgttttaatgcagccacaaagactgccaccttcctgacagcacagtgttgtgctgggtccaagctggaattggctctttggggtagtcacgctggggcctctgtgtctgtaagaaagccacatttagggctcgaggggaagacaaaatcaaaaaagaataaacaggaaacagccagcaagagtataaaagagaaactaggaaaagacaaccaaaagaaatcagagatgacaaggtggagaggcgggggaaaagctgcattttgcaattaagaaaacaaatgtggataagaggacatgcttgtgaggtctgtaagaaagagaagacaaactagtgaaaacattgccatctctgccataggtacctgatacctgctttgctgttccagagaaacttacttatgctcaagaaaatgcttgaaacttaaaccttgcaatttatggcatgcattgaatgttcacaaactctgtatacggagctggttattaattaattcacatatttattagtgacatttaacagagtttatctatgtctagcaatgcatgacagtcttattatcaaaaagaaagcttaaacataacagaagttaatgtaggaataaacgtgcagttcaacaaccagagaggctatctaagaaatacagcaatgtggctctggtcaaatcagtcagcggatattcccacactttaaaatccacaatgcatcagaataaataatgtcgcttcccagatacagcctgagtctaatttccaacctccacccccaatgtaaagtttaggttcttaacatacttttcccttggagtcagttggaaggaacagagccaaaattaagaccctaggaaattagcttcttattgtgtatggggaatttaaataatgcaacacctcaacttaccaagatgcaatactctcaaatagcctatactggtgtcatttacacagtgggagttctaggactgggagttttcccattacaaggccctatatgcagaacttaagagttccaccataaaaataatcttggctgaaagttagcaggatgttttagcctggaagcaaatgtttacaaaatttgagaaaaaattgcatgcatttggaaagctttcaggttttcaaaaagcagaagcaaataataataaggcagtcagagattttcagatttttttgccctagcattcaaaaactgacttgtagcttttcagtagaaatgttttgattcttgtcccataatatgaactgattgattaaaaataatcaactttcacaacagtgtcactctgttttatgaaataatttgttgtttactggtagaaaaagaatctatacattgtatttgtgtaggtatttccctagggtttaaaaattaatgataattaagaaaccaaattaattcaggaagctataaatgaaacccaaatattatactcctttgtggatttcctaaagcatgatgttcttttttaaagtttataccaaaaaaaatgacattttccaagggatttttatactttcaaattgtatactcaatttaagcattaatcaattagtctacacatatatggtaaaagagacatacagattccaggtgaaataattacagtggtctatatgaatgaacatgacatatttttttgtacaggatatttagaactttttacccatttccttaaaagactcatgtcttagagattcctctaaattctttgggaggttatcttatagacgagtaggctatacagttaaagatgtttttcttgggttcaaaataatcatttattttcttgttttatctctctttgcctgattttatacgtttcaagtcgcttcctatttttggttcagaaaaaaaaaatggaaaaaatcaagggctggacactttgagaaaaaaacctaactctgcaaaaccaaaatagctctgaaatgataatgctggaagaattcttgaggttatagtagaccagagacccaatatgtaaatacacactcttttttaagaagataataatgtcctatatctagggtgtaagtatatcttatagaagaaaaatatttaaaatattaagtacatgatgtgctccctcgtgtataagccaacttctcatatggtacctaacacataatgaattctcagtaaatggtgtataatcagataaattatattcaacattgctgaaatcctcattggagagttgcacaccattgctaccgatgcatatagttgatagtataaaaagatcaatcaccaacagttgttggttgaaggcagctcagagaataacatggtctgtaaatccactttttaaacatttaaacaagttcatttctgataagagtatatcatattgttcaataaggtaccattcttgctatcaatacacagctatgctaaacaattgaagttaggtttccttaatgattttattttcatcgatttttggatactccatttaagttaaccatcagcaactactaaaatatccattctctactcattttcatcagaggaagtcatatcccattaggcattgtttcaattccaatagcctgctgtttttaatcaagtaactgaatggtaactatgacttgtaattgacatgcctgagaatggtcaggcttaggctcagttcccataaccacacagcaagttaagccccacatcttttcctttaattcagacttggaatgccatgttagtgctgttttgtattagtttacttccctgtgaatatatcaccctcttgattcattgtttgttttccatgtacctctcaggaaatttttatttggatgataatttttttgagttgatagagactgtccaataattaaaataagaaatatatggtcaatacacaggatctatcaatttgaagttaatgaagacagaatacatgattttgctattggatattgatttcatttcctccaaatttacttcctagcagaaaaaaaaagttaaactctgctgttgctatcaaaagctctgtaaagacgttgaatataccaatgttattaaaattggactgttgtctttcttcttttaaaatgatgttgttcttgttatattttgcattttctgacagtttgggatgactaactctttagtctccctatagaacagttgcacacctaacagatggtattgtcacgacaacagtgagatttttttcttccttttgtcttgaaggtaggcatttgacgatgtatttgatattacatagtctaatattggagtccatgtgtttggcctagagtttgacagcataagaaacattcatttcctctggatttaattattgactctgacatttcatgctactggttttctcagggtgatctcaattatacctaaagcttcagtgagcccttcaatgacttcagagctcctatatgcaaataattactcaagctgtttttttcccactcagatccatggtctagaaacaacccttcttgaatttccctctgtctcctcaaactgaacttttttgaactaaactcatcacttttcccaacaaagatgttcctcctattttatttcttaactcagcccgcagcattacaatctatattccccattgccctagaaagaaatatgttagacatcttagattcttctctctcattacagacagaatcattcaccaagcctcatgagctctactttcttactatctcttgaatctggttcttcctttcactttctgtgaccttgattgggcctccatacttccttttgagataaatctcctaaggaggtctttgcctttgttcttatttctgcccaggccactcttttcaatgctgccaaaatgatccctcttaaatacaaataagattgtgttatcccctcttagaatcctccaatgattcattgatctcataaggataaacaaaattccacactaattacccccataaaaaaggataagcatatgacctctgtctactgttcagcttcatatccttataagctgctttctatgctccaggaataccaagtacatgaatttttctaatggcctattcctttcccatgcttttctttctccctttttatccatctgccaaattcacattcatcttcttgtgaatatcacaagaatcaccttctccaaggaatattctctaacttaaatccataaccatcccgccatgatctcttgaacatcattagccccttcctccacaatattccagtgacagctttgcttttcctaatagagcccttattgcctggaactacaatggcttgtttcattatctgtttccctatctagagtgtgagtccttgagtctaggaattatggttggatcaccccgtccccacagtgcttagcacactatacctggcatatgatagggcctcaattcataatggatgattaaatggatgaagagacaaatattatccaagctttctgtttatccactcatccatgcctctatccttagagaaacaaagcttacagattgacgattcagtgacctgctagaagagacaatgattaaatgtctctttaaacataacgtaaagtcatattatccagaatgtaaagaaattaccttaaaagtgaaagtaagggttttgttttttgtttgttttgttgttgttgttgttgtttttccagggggcatgatatatatgtagaccagtatgacataccatatttgtaataatcttgaataggataggacggaaatagggcaatgacctttgtgtccaatacaggtttcagacaaaacatactttctcatttttaatagggagaaaccagtctctcaacaaataatgttaaattgtttcataaaactgagggattcgactaactaaagccaaatttgatgcttttgagaccgaccagtgtcataagaatagcactatccactttctggttcaaaatattatgctcttttttatataaaccttcaggcattgtgcctacttccttgtaagtttgtgtataatttttcccattatcaccccctaggtaatctttcaccatcaccactttccaggcatctaccatccactgaatagccatgtttctgattatcttctcccaaatgtatcagcttgcattatttaaagctgaatctcattttattatttcctgctcgtatttctaaactccttaagtccatttgtatgattcttttgtcctcacagatgtccacagttcctcccaatttagtatcatcagcaaatttaattaatgctctgtttacctctccttctaatgaaaccagtcccttgtttcatttcatgatacaaagtaaaaaatgtattggcaataaaacagtccaaagaaatgtttcctcactgtaggaggggaagttaaggatacagcaaagaacaatgtggtgaggagtggacagtgcagcagggtggtgagttagtttgctattgccctgaagcaaaacctttttcacagagactacactttggcatattgcctgggttgatgctgtgtgtgtatgtgtgtgcgcgcatgtgtgtgttctgttctggaaggtagctttaatatcctaactgaggacattttaccaaagatgtatttatgaatatatgaaaagcatattgaaaactataaatataaatgtaattatagctttatatacattagtatttatagttttaaatacaataaaaggtaagctagtaatgtctgattcatggtgtagttacaaatctagatatggatgcatacatctggatatatacagacattcaatcattttcagtgggctttttctagcattcactgtgatgtaaatttatctctgtccttaacttgattagtgttttaaatccaaattaacccttggatttgaatcaaattctttgtaaatagcaggtttatagggtaagaaaaaagaactttttttcagttgtatccaacatgcaaacttcaatcaaagaatattttaacctctacaattaataggctagaaaattgagcttgatcagagtaaaaggcctaacctgctaacttgaaggtaagccagcatatgttctaaaagttacactataactctttgaaggtgtggatatacagatattgtgtcatttacatgaggaaaacaaagatgacatttattaagcactcataatgttagtgctttccagcatacataccaatactgtggaataaaattgtacattaattactacctgatacttcatagtctgtattcttaactccagcaaaatctcataaacgtttgtcaagtttcatattaagagtcagtcttcagaatgtggatggattagtataaatccagtgactttactgggaaaaaaagtactttcaagtttatgctttgaatggacagacagatgttaagatcaagatctctattgttgtatacaggagacaatgcatgttcacaatgctgaaatgaaggctgatatgtactttccatacaggacaaggtcaccaaagatggcatcaccaagggatggtgttaacaaaacagtgactgggaatattgttaggtggttacagcctcacattgcttttctagtgagaaaaatatctgatgcataatgcatccttatgagagaattttctcagatgccaagattttacaggcataacttccataagctttaatgggaatttcctgccagcacctgttacagtatagagttcttacttttcacacataatccaagactgacttggaacactgacttggaaaaactaatatagtgaaagcttcttgtaatgtttcctcacatataatgttcatcttttaatctttggtctgatgatatatgtatgtccatgttttccattcaaattcttttcccaccagtaaggtttcttttcacaagtttttttatggatgagagcagaaaaagcaattcttcttactaggtaaactagtggaaatgatacataaaggggaaagttattaggatagcaagtgacttaatgctagaaatcaactattcttgacttaaagtagttttatagatatactgtagactcctgagcagccaacaattagagtaccgcatgcaaaaacaactgtcagggactccacagcaaaatcacaggtcaaaataatatagtttgaccatattttctcatatatttatagactagaatatggtaacttttaatatttaaaaagatattgtgtagatataccaaaggatctattttaatatttcaaaagatattgcatagatataccaaatgggcaatgcattgggtagaggagaaagttaaaagttttaaatttcatacatttctaattaattccccaaacttccgttaccaaaaaactcaaacaaaaacaggtcacagtgctcctgcttaactagaattattggagattgtacagaacgactattttatgaacaacaacttcacttttaactttttcactttcttgaagtttcttcttgtctagagtttctaacacacaatgacacattagaatgaaaacagacatttatactcaaattcctgaatcatttctgatcactaccctgagtgacaggatgatgagcagggggaatgcttttcacttgttgaatgttgaaagacagtaaatttttagttcatttttatgacaagatttttttaacaaatgttggcaggtaacatgattaacgttggaagaactctgaaaccccgaaaacaagagaagacgtgtgaacctgttcatttaatttctcacggggcaaaatacgggaactgaaggagaacagtgcattcgcatccttccttctctttctttggtgtgtgattacattactccatgatgtcaccttgagcccctgtctgacctctgatactctccttctggcacacctgcctcagaaatatcatttatactccagcttgatgttcagacacccttattcacacttttgagtattaccttgagcttaactgttttaaaaggtatcaataatttgtctcctattagagtatgttcaagcaccaggaaagaggattttgttttgtttcatttgataaggcaaagaaagggaaaagggagtctcactgacacttctaaaagcatgctgtgtttccaagcttggtaccctcctcctctcaaggggttttgactgtagcacactttgctcttagtggaaataaggttattactttcttttgatactctggccagtgaattaatagaaatgcatttgtttctgatgtaattgcctttattaaggtttattttaaaacttaagagcagattggaaatctaagacctcgttaagtctgccatagttcaaagccatgcattaccagctgaggccaataagccttaggttgttactggggaagacttaagacttgtggcattgtttgtgtatacatcactggctccatctgacacctctcatctctccagtgagcctgatggagttaggctttgtatccccacccacatctcttcttgaattgtaatctccataatccccacatgtcaatcgagagacgaggtggaagtaattgaatcctggggctggttcctccatgctgttctcataatagtgagtgagttctcacgagatctgatggctttataaggggctcttcctccctcactggcacttctttcttccaccttgagaagaaggtgccttgcttccccttcgccttccacccttactgtaagtcttccgaggcctctccagccatgctgaactgtgagtcaattaaacctctttcctttataaattaccgagtcataggcagttcgttatagcagtatgagcatgggctaatacagacccagtgatgtatacacagacaacgccacatacagtaaaactgcaggagagtgatacggtgagagaagtacctgtattctctgcagtccttacccagagaagagacaggcctggctcagagatctgatgatttcatgggagaatgccatgaaatattcacgacatttcaatctatagaaaaaaagacctatatggggccaggaaaagtggctcatgcctacaatcccagcactttgggaggctgaggtgggcagatctcttgagctgaggagttcgagatcaacctgggcaacatggcaaaacactgtctgtacaaaaaataccaaaaaaaatagccaggcgtggtggtgtgtgcctgcagtcgccagctacttgagagcctgaggtgggaggacctgagcctggagaggttgaggctgctgtgagctgtgatcataccactgcactctagcctgagtgatagactgagaacctgtctcaaaaaaaaaataaaaaacaaaacaaaaaaacctatatgaatttaggaacctcagtttagagcattgtactcacctgaaagaaaaattattttataagttttccctgaagatgttattttttacaatttccatatttctaatttccttatgatagaaaattactataagaataaattatgttaaaataaattgtgattaatcaagcttaaaaatgtgccccttctcccccaaatttctaagtacagtaatatacttctttttttctgtgtcttggtgtgtccaaaatagcaggtaacccaggaagggagaaactttggataatagcaaccactcttttgaattcatttgaagccaacatgttgtacccattttccctttctgttcctctcccattatgtacttgcccccttattctccatctttttctctcccacatcctacacaagtaaactcattgtacttgttttcttttcagttaaagtctgctcccagtaaaggatttaataaattaatccacatactaaagcgtatatgaccagtgaggtttgatgtgaaatcctccaataggatttcaagaaaaaaggacgaattctaattgcagaattttaggcataagcaaggctgtgtgaaagaaatattttaagaaagaattatcttcccagattttctgaaaataaactgcaaaagtagcctctataattaatattaacttacgttgggaaccaatggcataaaatccaagtcttcaaattgataatctttcatttctatctctcatggcacttcaagatttagctatactgcctgattatggatttcctaacattcaaactcaatggagtttctaacatcaaaactcaaactctgccatcccctggaggaaacagggaaattaagacatcctttatttacatttcatacaagagaaaacatgagatacatttataattgatatcttgccactttagaaagtcacatatatggagttagatatttcataaatgttgtatcaatgaacatcagcatatataaaacgtcttagttttttttaaatttgtggataatgtatgtttttttcacatacaacatgaagttttaaagtatatagatattgtgtaatagttaaatctatgtaattaacaaattacctcacatagttatcatagatgagagcacttaacattcactctcattacatttttcaggaatatatgtcatcattaactgtagtcgtcttgctatccaatagatcccttgaaatttattccttctagctaattataattatgtatcctttgaccaacattttctcattcctaccgtccgcctaatcataccagcctctagtagccaccattccattctcttcttctatgaggtcaacctttttgaattccacatgtgagtgagatcatgcaatacgtatttttctgttcctggtttatttcacttagcataacgtcctccatgttcattcatgttgtcacaaaagcaggatttttttttttattatttaagttttagggtacatgtgcacaacgtgcaggtttgttacatatgtgtacatgtgccatgttggggtgctgcacccattaactcatcatttagcattaggtatatctcctaatgctatccctcccccctccccccaccccacaaccgtccccggtgtgtgatgttccccttcctgtgtccatgtgttctcactgttcaattcccacctatgaacgagaacatgcggtgtttggttttttgtccttgcaatagtttgctgagaatgatggtttccaccttcatccatgtccctacaaagaacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgagatggctgggtcaaatggtatttctagttccagatccctgaggaatcaccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggctggccagtgatgatgagcattttttcatgtgttttttggctgcataaatgtcttcttttgagaagtgtctgttcatatcctttgcccactttttgacgaggttgtttgtttttttcttgtaaatttctttgagttcattgtagattctggatattagccctttgtcagatgagtaagttgcaaaaattttctcccattctgtaggttgcctgttcactctgatggtggtttcttttgctgtgcggaagctctttagtttaattagatcccatttgtcaattttggcttttgttgccattgcttttggtgttttagacatgaagtccttgcccatgcttatgtcttgaatggtattgcctaggttttcttctagagtttttatggttttagatctaacatgtaagtctttaatacatcttgaattaatttttgtataaagtgtaaggaggggatccagtttcagcttcctacatatggctagccagttttcccagcaccatttattaaatagggaatcctttccccattgcttgtttttgtcaggtttgtcaaagatcagatggctgtagatatgcagcattatttctgagggctctgttctgttccattgatctatatctctgttttggtgccagtaccatgctgttttggttactgtagccttgtagtgtagtttgaagtcaggtagcatgatgtctccagctttgttcttttggcttaggattgacttggcaatgcgggctcttttttggttccatatgaactttaaagcagttttttccaattctgtgaagaaagtcattggtagcttgatggggatggcattgaatctataaattaccttgggcagtatggccattttcacgatattgattcttcctacccatgagcatagaatattcttccatttgtttgtatcctcttttatttccttgagcagtagtttgtagttctccttgaagaggtccttcacatcccttgtaagttggattcctaggtattttattctctttgaagcaattgtgaatgggagttcactcatgatttggctctctgtttgtctgttattgctgtataggaatgcttgtgatttttgcacattgattttgtatcctgagactttgctgaagttgcttatcagcttaaggagattttgggctgagacaatggggttttctagatatacaatcatgtcatctgcaaacagagacaatttgacttcctcttttcttaattaaatgccctttatttccttctcctgcctgattaccctggccagaacttccaacactatgttgaataggagtggtgagagagggcatccctgtcttgtgccagttttcaaagggaatgcttccagtttttgtccactcagtatgatattggctgtgggtctgtgatagatagctcttattattttgagatatgtcccatcaatacctaatttattgagagtttttagcatgaagggttgttgaattttgtcaaaggccttttctgcatctattgagataatcatgtggtttttgtctttgattctctgtttatgctggattacgtttattgattttcatatgttgaaccagccttgcatcccagggatgaagcccacttgatcatggtgaataagctttttgatgtgctgctggattcggtttgccagtattttattgaggatttttgcaccaatgttcatcaaggatattggtctaaaattctctttttttgttgtgtctctgccaggctttggtatcaggacgatgctggtctcataaaatgagttagggaggattccctctttttctcttgattggtatagtttcagaaggaatggtaccagttcctccttgtacctctggtagaattcggctgtgaatccatctggtcctggatttttttggttggtaagctattaattattgcctcaatttcagagcctgttattggtctattcagagattcaacttcttcctggtttagtcttgggagggtgtatgtgttgaggaacttatccacttcttctagattttctagtttatttgtgtagaggtatttatagcattctctgatggtagtttgtgtttctgttggattggtagtgatatcccctttgtcattttttattgcgtctatttgattcttctctcttttcttctttattagtcttgctagcggtctatcagttttgttgatcttttcaaaaaaccagctcctggattcattgattttttgaagggttttttgtgtctctatttccttcagttctgctctgatcttagttatttcttgccttctgctagcttttggatgtgtttgctcttgcttctctagttcttttaattgtgatgttagggtgtcaattttagatctttcctgctttctcttgtgggcatttagtgctgtaaatttccccctacgcactgctttgaatgtgtcccagagattctggtatgttgtgtctttgttctcgttggtttcaaagaacatctttatttctgccttcatttcattaggtacccagtagtcattcaggagcaggttgttcagtttccatgtagttgagcagttttgagtgagtttcttaatcctgagttctagtttgattgcactgtggtctgagagacagtttgttataatttctgttctttcacatttgctgaggagtgctttacttccaactatgtggtcaattttggaataggagtggtgtggtgctgaaaagaatgtatattctgttgacttgtggtggagggttctgtagatgtctattaggtctgcttggtgcagagctgagttcaattcctggatatccttgtttactttctgtctcgttgatctgtctaatgttgacagtggggtgttaaaatctcccattattattgtgtgggagtctgagtctctttgtaggtcactaaggacttgctttatgaatctggatgctcctgtattgggtgcatatatatttaggatagttagttcttcttgttgaattgatccctttaccattatgtaatggccttctttgtctcttttgatctttgttggtttaaagtctgttttgtcagagactaggattgcaacccctgcctttttttgttttccatttgcttggtagatcttcctccgtccctttattttgagcctatatgtgtgtctgcacgtgatgggtttcctgaatacagcactatgatgggtcttgactctttatccaatttgccagtctgtgccttttaactggagcgtttagcccatttacatttaaggttagtattgttatgtgtgaatttgatcctgtcattatgttagctggttattttgcttgttagttgatgcagtttcttcctagccttgatggtctttacaatttggcctgttttttgcagtgggtggtaccggttgtttctttccatgtttagtgcttccttcaggagctcctttaaggcaggcctggtggtgacaaaatctctcagcatttgcttgtctgtaaagtattttatttctccttcccttatgaagcttagtttggctggatatgaaattctgggttgaaaattcttttctttaagaatgttgagtattggcccccactctcttctggcttgtagagtttctgctgggagatcagctgttagtctgatgggcttccctttgtggttaacctgacctttctctctggctgcccttaacattttttccttcatttcaactttggtgaatctgacaattatgtgtcttggcgttgctcttcccaaggagaatctttgtggcattctctgtatttcttgaatttgaatgttggcctgccttgctagattggggaagttctcctggataatatcctgcagagtgttttccaacttggttccattttcccgctcactttcaggtacacctatcaaatgtaggtttggtcttttcacatagacccatatttcttggaggctttgttcgtttctttttattcttttttctctaaacttgtcttcatgcttcatttcatttatttcatcttccatcgctgataccctttctgccagttgatcgcatcggttactgaggcttgtgtattcatcatgtagttcttgtgccatggttttcagctccatcaggtcctttaaggacttctctgcattggttattctagttatccattcgtctaattttttttcaaagtttttaacctctttgccattggttcgaacttcctcctttagctcagagtaatttgatcttctgaagccttcttctctcaactcgtcaaagtcattctccatccagctttgttctgttgctggtgaggagctgcgttcctttggaggaggagaggagctctgatttttagagtttccggtttttcagctctgttttttccccatctttgtggttttatctacctttggtctttgatggtggtgacatacagatgggtttttggtgtggatgtcctttctctttgttagttttccttctaacagtcaggaccctcagttgcaggtctgttggagtttactggaggtccactccagaccctgtttgcctgggtatcagcagtggtggctgcagaacagcggatattggtgaaccgcaaatgctgctgcctgatcgttcctctggaagttttgtctcagaggagtacccggccgtgtgaggtgttagtctgcccctactgggggatgcctcccagctaggctactcagcagtcagggacccacttgaggaggcagtctgcccgttctcagatctcaagctgtttgctgggcgaaccactactctcttcacagctgtcagacagggacctttaagtctgcagaggttattgctgtcttttgtttgtctgtgccctgcccccagaggtggagcctacagaggcaggcaggcctccttgagctgtggtgggctccacccagttcgaggttcctggctgctttgcttacctactcaagcctgagcaattgcgggcacccctcccccagcctcgctgccgccttgcagtttgatctcagaatgccatgctagcaatgagcgaggcttcgtgggcgtaggaccctccgagctaggtgtgggatataatctgctggtgtgtcgtttgttaagcccattggaagagcacagtatcggggtgggagtgacccgatttcccaggtgccatctgtcacccctttctttgactaggaaagggaattccctgaccccttgcacttcccgggtgaggcgatgcctcgccctgcttcggctcatgcacggtgcactgcacccactctcctgcaaccactgtccggcactccccagtgagatgaacctggtaactcagttggaaatgcagaaatcacccatcttctgcgtcactcacactggtagctgtagactggagctgttcctattcggccatcttggctctaccccaaaagcaggattttttaatggctgaatagtattccatttgtgtgtgtgtgtgcacatatatatcatatatgtgtatatgtgtgtgtgcatatatatcatatatatatgatttaaaatatatatatgatatatattatatatatgatatatatgatatgatatatagtatcacatatataatatatatgatatatataatatcacatatataatatatatatgatatatataatatcacatatataatatatatatgatatatataatatcacatatatagtatatatatgatatatataatatcacatatatagtatatatgatatatataatatcacatatatagtatatatatgatataatgtatatcatatataataacatatgatatatataatatcacattttatcattcaaccattgatggacacttaggttaattccatatcttggttattgtaaatattgctgtaataaaataagaatgcagatatctttttgatatactgattttatttcctttggatatatacccagtggtgggattgctggatcatatggtatttctatttttaattgtttgaggaatctctatattttttcccataattgttgtactaatttgcattcccaccaataatataaaagggtttccttttcttcacatccttgccaacacttgttatcttttgtctttttaataatagccattctatcagaggtaaggtgatatctcattattgttttaatttgcatgtatctgatgattagtgatgttgagcattttcccatttacctattggccatttgtatgtctttttttgagaagtatctttttagttttttgctcatttttaacttgggctcaggttgttttttggttgtttggtattgagttgtttgagtaccttatacattctgatgttaacatcctgtcaaatgtatattttgaaaataatttctcccattctataggttgccactccactctgttgattgtttcctttgctgtgcagaagcttcctagtttgatgtaatctcatttgtctattttttggcacatgttagtttaatatattttctttccatgacaatagatcagaaagaaatgagagatattaaatatatatatataaatatgtatgtgtatatatatgcaaatacccagatatttccacaagtctttcaatgtagatctatgtgacaaaatcccccagaagctgaaaatctggtttgtattacactagtgctagatgagtttaaataagggaacaactgttattggaatgcctttttttaagtcaacaaagtgttttgagtaaccagagggtgcatacttctttgttagatggttaacagcccttatgtagtacagaatgaagctgagaagttaggtctctcctagaccactagaggaaggctaatctttctactttatattgtgatcataggaagtcagaaagccaactttattgctacctcttgtcttttgcttatacatttctttttgtacgagtcccaaaatcacaaaagccaatggtataaattgtccagggaaaggtagagcttctaagtagggaagatgtttttgtcttttcagctctattccagataccttatatttctgtctccaaatctggatgtgatttccccaataagaaatagtttatgaaatacttaattttgagatttctactgtgtgtcccatgaagattttgaacctcattttaagagtcttaaaccatctttcagctaaattagagatacaaaatacagcattcaaggatacagaatagatttatgatagtctccaaacatttttcaagtggatctgtggggacataaactcataagtatatattatcaaataatttcaatctgtgtcataatgttttcataataaatgtcattaatatttgttcacaagagtaatatatatgtatatactacacacatgtgtatatatgtatatgtatataaacacataaaatagttgggaaatatgtaaaacgatttaaaaacagaatcatttttataatccacctcacagagaatatatgttctcacattttagtgcgtgttatggctctataacatctggaaatgtgtgtaccacatttgttactgtatccccaatgcctagcacacttttgctacatagtaagtacctacacaatatctgtcaaattgcctggagagttggaattcaccaattcaagggccacagaatatcttagaattgatctgttcttccatttaatcacagtttaacacaggtccatctgccaagcaggaaggaacatgacctagtcccacctctctgtggagcagaagtattagtaatatccactacgcagtttctcctgtactctcaaaaagaaaacagtcatcctatttgtgtttcctgagaataggaagctcaaatgtctcagcttcatccactgtcatggttaggagcaccttcttctttgcctgggaaagaggctagtgacactataatttctcagaagtttcgaaaggcagcaataagctgaaaagaaccattttgtctgtgatctaaataggactttgctgatggttagtatactcaaatgggtttgtagaatattttgtcttggtgcctggaatttgcttttacgaactcacttgagaggcagcggccagggaagagctctctctcacctgaatgcttagcagaggcaagccatcaaaaccttccaggaagtggcaagccaaagggtctgaattggaggcacctccccaaagatcaaaagttatgctccaccaacacagagacactgagaaatggttgaatgtgttctaaattaaactgccctggtggtgagcagagatctgccaaaatctttcaattaatcacttttaccttcagggcagagttaggcctgagagtatttcaatagatttttattggaacagagttatttcagatattaaactatgttgcacaaagtaaaaataatgttattttttaagttgctactcttgttaaataaaagttggcaagcgttctcggggtctgtattgtgtctgtgtatttgtgaatgtgtgtggctttttcttgtgccataatccccattgatttttaaaaagtgaacagcaatgaactaggtgataaatatatttatataatattttcattaataatgtgttataaataatagaagaaaggttttaagtatataattcgctacatcacaattgggatttttttttcctacgtcttcagcagtaagttaattagaatcacctgcatttccttgggtggacaccaaatggattgcaaacaaaaacagattaaaatagctgctggagctcatggcatacagatgacaagattcacaaaaaggacaatgaggcactgaaaatgttcgcttttcaaacaattctagaggaaatttagctctcgcgacttctctgtaaaagctgcctgtaagtgttttgctgaaaggctagaacagctttgtttctgatcccttgatgagtgagagaaatgtttaagaaagatcactttacagagagattcaggctgaaatgtgatgactgtgattcaagccaagccaaaaattacagttcagaatgaaaggggagggacgtggtttgggaatccattttcccacattcctgaatctcaatcatcccagccaatgtttagaaaaaaatccaatggaaaacaatgaggtcactttgtttagatgttaaaaaaaatacgggtggagggattgaaaagaatgatggcaaatatatgaattttaaatcagtatctatttcaagtatgatgggatcaaaggctacactttatataactcttatgacttcatcccaaaaggatccatttttcagttttcttctttgtgttggtgagccttttattgtgtttctttaatttatgaaatagtctcttgctaaaattaaaaaaaaaagtgtatgtaggcacagagtacagattactcctcctgagactccaagctttccttaggaatagcatctccaggaatctggttttctttctttaaacctgctgtggccaccccactgctgtgtagatctcaggttatgctggtgtattggcttgcaaactaccagatgataatggcagaccaaattagattcattgttcttgttacctctatttgttttaatgaaacacactaagcaagtcatactaccaaatgaatgatttatttacatcagcatgatcacagcgtaacagtagaactacaacataaaagaaactcagagaataatatgagataaaccaaatataacctccaacttcaatatcttccagatacactaagtttttcttcaaggcaacagctctcacttaatgataaccagaatcattgaccaaaatttgtcttcaagactaagatttttttaaaaaaaagaagatgtaagatttgtcaatgactgtttataggtaccttgtttcccaatctccagaaatcatttcaattcatcatctttggtctgatcagaccactgatgctaggttcttttctagagaaatttctcaagcaaactcagaatcttgctgagatctttcttatcttcagagatttccaaatgatcctaaggctggcatatatctgtaagtcacatttatgtctactatcctacaggcttcatgcagttaggcctcaaattcttagctgagcttagagagatatgtaagaatgaatgtgcagaaaataagacacaaataggacactattgttccactattgtttcatgttaaccaggtattaaggtacataaatggcttatcaatctatatcacattagccacactggaactttttccccttgtcttttccctggttgattaccatttggtaatccttaagttaaaaggaatcattttaaaggtgggaattaaattagatgtatagaggctatatacacaaacaagcctgatccataaagaatcacagcaaatggaaaccaggaaataatatttttgaaagtatactactgcctatacttccggattccaaaggtatagataagcatctccaattataaaaaaaaaaaattggttagatattgtggcaagaactaagtataaatataagggaaaattctaataatgaggcaagacagtggttttactcctgtatccaaattgaggagggatgactttttttttttttttgtaacatttgaagaagtcagtgagattttcttctacttattgaaatgtctgatatcctacttaacatgaatgaaggagatgaagaaactaggaaagtaatgcaataaattgttttccaagactgaatccaatcctgtgtctctatacaagaatacctgataatagtaaaaagcaagatagccaatcactctcctcccacacgtctccctaccatccccccacccacaatccccaaactctattgtcactgaacttttcaaggcataaatgatacaatgtagaaccactaagaaaaccaaaccagtaacacacttaacattcagggtatttagttcttttcctcacccaattttgatgctgaagcaatgtaacaacacctgtcttccctggtgtccaaataagacgaggtttgttaagagctcaggactgggcagaagagcaaataggaccaatattaatgataaatatttttgcaagaaaacaatcttatttcctcatattaacaaattgaagtaacaggggcaaaagaaggaagtgggagtgaagcatttgaaaatgatcccaattgcccaagtgttcaaagaaaagtccttgaaaagcattctcctttctgattcaagagtctatttgatatcaccttcttcttagtatatatgtatatacatatacatatatattcctttattatgtgctctttcgaggtatttaatttaaatctggaatttgcccctagctcagacactggctatataaacaattttaaataattgctcattttttagtatcataggttctaagccattttcttagaaacgaaaaaaaaaaatccttctcttagtgacctctttttagtctaacattaaagaaaaattacaacaaatatttatctcttccatgtcttaagagaataaaaattcttattttccatatgaatcccctacaaatacctgggaaattaaatacatttttttcagaaatgaataatcaaaaatgagccaataaaatctagataatgatgataaccaaaagcaaacaaaataataaaggaaaaattgaaggtattttgttatgacattaaaaagaaaaacttgttgcaataattgtgtctatgaagcaagcatttcatagcagaaatatgaggaaggtagaacaaaaaaccaaaatgagataaaaattgaaaagaaaaggctcacgaaagaaatggaagagaaaactaaaacaacttcaggtaataaaaggagaattgaaaaatgcataaatgatagtaggaatttctataaacacagaaaaggacaagagtaagaaacatgaaatgagagatgtactgaaaccctgtatcaacctatacttccaacattagaattggaatcacgtaacaactgttttaaatattcatagtttaatccctcaccatttatttcccatgtaccaataatgaaaataatataatagtatcttcccaaactaatgaaacttctgttttcagtttttaaagttcttttttatgaaaaacaatgtaggcctcacattcaagttggcagtctcaaaaaagcatgtctgattctctttcctcaaaaaaatcccaatgaaataatagaaaatatgtgttttaaaaacaaaaaaatggataatggtgctgaaaacagaaaaggtgccatcagcagatgagaaatagaaattccaggaagagaggaagcagatgggatcaaacaaatagagaaatgaaagcaggagaaacaccattcccagacaccacaattaggcacagttctttccaggggtgtcccagagaataaccaaacttggagtcaacaaacaaaaagaacagaaattgtcaagagggcagtaaagaaagtaattcattaaataacaggatctaacagctgtgagaactgggctcctctttctttatcctgcaccaaggaagcacctacagcaggtgcttgagcctgagagcaatttctgtaaggacggaaaagttgctggcatctgagaaagaagacagtggagaagaaagtgtctcaggtcttctccaacagaattagatatacctttgcccaggtgaaaaattggtaaatttctctatatcccaagttaagtcttccttactttgataactggggagaacccctggcctattgtctactcaccacccatttatcctgcgagacactccaacacaccattctcatttaagattggacaagttgtggggagggagagagttggacacatacagaggtacccatgaccactgtttaatcagtctcaatcataagggtaatccaatatttgataatccatcttaaataaattctagagaagagagataatagagggaaaacaatattgagcaaataatataagaaaatgttttccaaatgaaaaggcccagatggggagcacatatgagtgacattttactgctataagtttaaagagaaatttttttttaatccaagagcaaaagcaatttacctgcaaagtgtcaagaatcaatctgacatcagacttaacagcagggatgctagaagataatggaacatatatttttcaaagttagaaaagtaaaagattatgaaactgaaataaatactcaagtcaacaatcaattaggaagcaaaagaaaacagtcagatgggtaaagtaagaaaaattaccgatcacatacttttatgaatcaagaaacttcttaaacttcaatccaagaaagaataacaacggaatacaagagaaggagggtagttgatgctgacctagagccgcattgtctaaaatggtcatcaccagccacgtgtggttaagctactcaaagctgaataaaataaaattaagtccctcagttgtattaaccacgtttcaagtggttaataatctctgtagccagtcatatgtggccagtgaatgctggtttggacagcaaagacatagaacatttctatcattgcagaaacttctgttgggcagcacttaatctgaggaaatgaagaaacctagaaaggaggaagaggacaagttaagtcttaacttttgggagctctcctttgtgaaactaaattttaatgttaaaccccaacatgttccctttttaaaaaatagtggctattattaacccatagataagtctcaaaatagttataaaaaacaaaatgtcccaaattttaagaatataaacaaacgcataaagaataaaactgggaagggaagtggtagagagaagtaagagtaaatatactgctttgttttccatagctcagagataatttgatatgctaagatatagaaataggcaaattaactcaatgaagagaaagagggtgtacagataagtggtaggaactacgaatgcactaagctctttatcttttctgagaaatcaataaataccattcaaagttaataaattaataaacagaaatatgacatattaacattaacaaaaagaatgaaaatagaacttttcttttcgagacagggcctcactctgtccacccaggctggagtgcaatgctgtgatcaaggctcactacagcctcaacttcctgggctcaagtgattctcctacctcagcctcctgagtagctgggaccacaggcatgcgccaccatgccaggctaatttttaaattttggcggggggaagataggtttcactatgttgcccaggctgttcttggattcctgggctcaagtgattctcctgccttggcctcccaaagtgctgggattgttggtgtgagccactgaacctggcctaaaatagaactgttaacaataactgtctttggaaagcatgttggggcagctactgtacttagttctgattgtatattgttctgtatggttcaattttgtattttttattgtttttttaaccatggaaatatagcaaaaaaaactatatatttttagaatggtttttatgaagtcatatagttatcctatagaataaaatgattcttgtttgaaaatcaaaattgtgccagctatttcctaagggaatcattcttaggaaatagcaaggctattgaaggatgggtgtctcataagaaattaacaataattaaattaaaatggcagataggtacaaaatcaacaccactgagttggaagagagattagaattttaaattatatcctgtactctcagtcatcgaatttaaagtgtgtgaacaaataagctagcaagaaaatgttggaaacactcatttcaacttagaggaggaggcataggtctgaatggcaccagagcttctcatgtttagctcagaacccaagtagaaatttggaaggaccgagacagaaacgtgcagcgttgaggacaacctgagtgttcccgtgctcaaagattttcgccggagggagaagccagaagttcaaagtattgcgagaatggcacttcttgtggtagctctggcctcctaggaattaggaagtgccataaatctcaggagagggactgtttgtgcaaaattcccagcccacatttgcagactgtagaggttcagatgcattttgttatgggttagaaaaacaagcaggctttcaggacacaccactcaaccaggctcaaactccacatctgcatggtttgtccatcattcgggctaccaaaaatgctacctaaaccagttttcaactatttttaacagactcatctgcattgtcaaaaactgtccatattttggcagataagccagtcaaatctggtcttagatttctttttgcaaagtgtctaagatttatggtgggaattactcataacagctgcattctttccactgggcttagaccaccatttggtctaataactcctaattgtgtgtctatcccagtctaagcttcttcaggagaaaaaaaagtcggggtggggaggcaggggaagacttttaaaaatcccctacagcaatacccagtgatttctgccaacagtaaacactattttgaaatataagaaggtcagctgatgatgaacgaataaacaatatttcagtgaatgtggatttcttcagataatttttcatactaccattaatgccactcttatttaaaaataaaaaataaaatgacttagttttatcgtgttcccaaagtatttttagcataacaggcaaaaatcctgtcagcatttacggtcatgttactttcttgaaagaggtacctctcaaagcgatttttcaccaaccttctccaaagcacaaaagaggtaccttgaagacgttggtcatttaaaaatcatacgacgtctaattatatttccaaaataagtagtttgcaatccagcaaggataatgtggtcatgaaaaggatgtccaaatccaccaatttacattggtttggtttggcataactttcaaagttcttggagtaaaaggaggatggcacgtgaataattgtaatttgggtaatagtcctagaactttgggtttgctgttctgtgagccattcaggggaaagcaaatcaactccaagactgtacctatataatttataactgttaaaattcactgatatgttccagattattttgcaaaatgtaataccctcctttttaatatgtactttgtcattttcactctatttatgtaatttaaaaagtatgatagccggagagcatgagccattcaaagcaggagccgctaatgtcagagatcattatcactcacaagatatatagtgttggtatctttgaatctaaagggcttggaagttgtgtcaagatagattcatattgcatctaatatgttttgctttactcccttttactttctggtttctgtctccagccacagagcagtttctctgctgtgactcaggtctacaaccacagcggtagcacaggtctgatttaccctccctgtctccaccagctgtgctccctccttttatgccaaaagaaagttgtgttattactttaggatgaggctgctttctttaaacagtatactgctttccaattgtttatatgtgatatgtccaatccatactactttttcaaatggttttgattactggacttaaaaaattgtttacagaaatttatgaaagaccaaggaaagcacttcttatattgtaacactctaagagaaaaaagaagttttggatacagggaatttcatcagttaaaaaccagtttacaattctatgcatttcaatagcatatagaataatatttgaaaaggaagagtgctaacttcaaaatcaagacatgcacttgattttacaccttgtataaatgaatatgcatattaaaatgatgattaagtaaggcccttatttgcaattaaattttgaaatccaaataatttcatttataatagacctctgataagggtctagctaattagcaaaacaaaatttttaaaaacacacaatgttctcatttttattgtaatagatattcacattttatctttaatcactgtaaataggactaatttgattgattttttaaaaaattagaatttctcttttagagaacatagacccacatattccattgatgtttctattttctaaaataattattattctctaaattccttaaaatcaattgataatccatgggaaaataatcagggccacattcatttgatcaaactttgtttgtttgtggtggcaagcatcaaggtgactttattcaccactcatggttctgatgccatttgtctgcttccaaatccaaaactctctccaaaacccccaagcatgccattatgaacatttttctgtaaacatttcagggcctctgagggtgattttagagaagaattttaaaataatttcctcagtagctatatgctcaaaaaaattaagagggaaaactttgagaaggacacacttgaatgtacaatttttaatatttttaaatctatcacgttatttaaaatttcataggttaaaactaagtaccaaacagcatctaatgacaaaggaaaaaaagaaaatgataagttttttgtaaattaattttttaacattctgggtgtaagtgcatgaacttaagaccaaaatagaccaatactaaaagtaggaattaaatattagaaaaattttaattaggactattatcacatttaagctgtcaagcagaaattgtactttaaaacaaacaaaccagagtagacttagattaatggaggtaatttgtgcatcacgaagaaaaaatatattgatttttacaaatatatgtgtcttagaaactttcaccactggctaactggtgtccagcttcacccaattcctcacaatttatagttctcaggaagagacagagtctcagtaatttcttagattattctagaactataaagtcacatcaattaatacatttgttaatagctattccattttattgcaattatctcaagtaaccctaaagtttattacatggaagagtaaaaactatagtgaatgattgtcttaaattatgccattattaccaatgttataagtgatgttattctaccctaaccttccaatgcaatattttgcacaatggcagaagtgttcctaatacaaagtgtgtaaaatggtaaagcaataaatgagctcattttatgccagtaaagtgctttgggaagtctttattctgttacactatggcaataatttctaccaatctatttaatactgttgtgaattacaatgattatccatgatgctataccacctccctagagaaactgctaagacctctgcatctgctggcaatctcagctagtcctgagtgcccagacacatcaaagaatatacattcttgacattaaaattatgttttcagcatttttagatactattatagtgtttgactaagtgtttcccttttcgttttcctgtttcttcattgtcctcgtaacgtggccaagaaattaactagattctataaatagatgtgtggaaaacaagtgaatgattattgaaattcactgccaggataagttattttgaattacagatgaccagttctaaaataatctgaaactcattttaccatttcgctaaagattttttaaatttttctctccataatggagcacctcattacctataatacactagaaattatcaaactagcattatatctagaatagaatttttactctttagtttcaaataatcagatcaaaatatgttattctgtaacaatcacaggaaaacaagaatagaatagaatagaatagaatagaatagaatagaatagaatagaatagaatagaatagaatagaacagagtagaaatggagagaagaaaaagagctgagaagaggagaggaaggaaagaagagagacagaaaggcaggaagacagtaagtcaggccagtagcaaatgtcttacaaatgtctcgagttattttaccttgcagaaaaaaggcaataatacacaaacgtctggaggtttcccccctacccagttggattcctatattttccttgtaaatgaaccttaaatatatgatgtaatcctattctacccactgctctttttgcctcaattagacccaaatttattgatgataattttaattaagactgaacaccatgattactttgagattaaaattttgaagattgcataatttagaacacacaaattggttttatctgagaagaatagatatttgatttactccttcttttcatagattttttttaaaccatctcaattcctatatgtgctaatataaaatatgcccttttgtcttcaggtctagatgttgatggaatatatcgagttagtggcaatctggcaacaatacagaagttaagatttattgtcaaccaaggtaagtgatttccacttcagagattttttcaaacagtttcatatggaacaatatttcatacactgtgctgtatgtactgtgaataataataaaactttaacaggagaatgtgaaagtggaagaaatttaaaaattatcagaaaagtaaaagataaccaactagtttatctagaaaagaatagcatatacagataaacaaattaatagtctatgtgaaataaataatgaatggaacatgtcaaaataaaaatgggggaaagaatagaaaaagagtaaaagaaaaatgacccagattcaaaaaatgttattggcttataatggacacttactatatgttgatgaatgaaagaatgaatgatggaaaatgtaaaagtcaaaataacagataatagaaaaatatatagtaggtaagaaaaaaattaggaaacgcatatgccatcaaagagttgtaaattaaaacaatgagataccactacacacctgttagaatggctaaaatactgacaacaccaaatgctggccaagatgtggagcaacaggaactctcattcattgctggcggaagtgcgaaatgattgagtcactttggaagaaaatttggcagtttcttatgaaaataaatgtatttttattgtatgatccagtacttcttggtactaacccaaatgagttaaaaactcatgtacacacaaaaacctatacacaaatatttacggcagcttttttcataattggcaaagctagaatgcaactaagatgtccttcaataggtgcaaggacaaatacaccagaatacatccatataatggaatattattcagggatgaaaagaaatgagctttcaagccatgaaaagacttagagtaatctaaatgcatatgctgagtaaaacaagccagtgtgaaaaggtatgattccaacaatatactgggaaaaggaaaactagagagagtaaaagatgagtggaagcagtaggacgagcttgggggaaagagggagagatgaataggtgagcacaggggattttgagggcaaacaattctgtatgatgctgtaattacccatacatgtcattacacatttgtcaaaacccataaaatgcaacacaaagagtgaatcctcatgtaaattataatatttagttaataataatgtattgatattggcttatcaattataacaatctaccccattaatgcaagatgctattaatagggaaaattttgggaagagtgaggagatacatgttaactctctgtactttctgctcaattattctgtaaacttaacactgctctaaaagaagtctattaattcgaaaagtaaaaataagaaattagaaaatgaaaaacaagaagaccaacacatcttaagttggtgttatagacagctcataggttttaaaatcatacagatggggtagaacttagactctctccttgtatccttggcatcttaacctccctgtgcctctgtttcctatcaggaaaaacagtagggggatgccttggaaacatttgggaaaattaaactgggtagcatctatgacacttaggaatgtgacagactcatgttagttttccttttacttaaaaacagtcaaaagtgtcttcagaagaactccaaatccttgtactctagcttcccacttagcttctataatagctggcttcaggtcctctgaatgtttttcataatacatttaacatataaactgtactcccacatttacatactgttgtgttttttaatgtctttgcacatgctcttccctttactttcaatatcctcctatcttttccttcccatcccacatacacaagcttccagcctggtagatttcttctttttcttcaaggcccagattatagcaatttcattcaataagcctccagtcagatttcttctctgttccccttactctgagtagctgaatttacagtagtacattcacatctaacttttaaaattccatctattataagacccatagatttaatgccaacttttggaaaggatataatcaaatgtactcggtgattgtatttcagaaacattaaaatttgtaagtcttggaatcaaaaaataggatactggctgaaatgtctgtctctttcacaaatctctaaaaaggtaggacttgaatcatccttgtatcttttcccattaaccagttctagccttggtgtttccatacaaggagttcctcatacagggagtttttaattaatatttgttgaacaatgtgtgtgggtgttgcaggtaagagaagtattaaaactggaaagcattcaactctccagcaattcaacttgggttgaaccagttttttaaatgttgattgcaatacttttggccacttgccacatgactcttgtttctaagaatctctataactgagaatctctacagctctgcttgttcactaatgcaattctttgtctttcacaattactctctttcctgggcaaaacacagaactaaactttacctcattcatttatattatttccatttaactgaatcagcgtaccccctctgtgggtaaaatatggataaaatagccctagcctcatattcattctagcttataaccagctaaaatcattcttacaatatagtttatgctgaaacgatatcctgattgggattctagacagctgggcaacacatttcttctacaaagaagaaatctcaaaacagaagccatgctagaaacaaacactagttgcatttcctgcctttaaaaaaactatgctcagcagtttgaaaaggcaaagaaaaaaatctgcaatgaaaatatgaaatctgtccatctcgtcttttgcaatccaaacttcagcgtcctctgaggctatgtaactgctcatgtttccatgagaattgacaatgtaaggctggacagaggcctgagttggtatctggtagcacagaattgtcagtaaactgtctccctggtttatagcactgtcagaatgcaacatactcaacacaaattatgctacattaggacctttgatactggtaactttgtccaagttgtgttatggagttttctgaattagatgataagtgaaatgcatataccaacccctttcaaaatttgctaatcagattatcctttgaatgcgttttctggactggccccacaaccttgttgctaatgccataccttcccctccatctggaccaggactctaatagtagagctgacttgaaaataatcagtgctgggtgcaaagagattgtaagtgtacatgtggccctctgtggccctctctctgtgtgtctaatacaataaactggcaatgcagggaaaattccatgaaaagcataaagtgctatgtaaaggcagtgcatcatttttgcagtctaagctgaaacataaatgatttttgcatacctgccttgtattaacatattttattccttctttattcaccttgcacatgtttattttctagaaggctctaaatatacatttttaaacaagtaagccctgcccactgttagactagacaaataaaaactgatttttgagattttcaagacagatgaattgcaatttatgtatttcactaactttcttgaatgctataatcatcagcaattctaaatacaccagttgaatgactcaatttgttttggttttctatttgacttactaaatcagtgggaattagatacccttattatacttccagttcagatgacatgcaagttatattcaaagtgttcacttttgaaaagcatttcctaattataactagtaatgatgataatagtaattattatcataaaagtaagcagcattttcataatttattatgtgccaggcactgtactaagcactttatttacataatttaatctaatcctttcttacatcccatagagtaggcactattattattcccattttacagatgtaaaaactgaggttcagatagtaaataatgtcctaatgtcatacagcatataagtgaaggagctaagactagatcccagatctgtctgactcagagcctatgctgcaaaccactgccattattctgcatttccaattcatcagctgttgattatctctttataaaagcagagattagtcttttcatgctacacacgctcattcatgactttcctttacaccccgcctcttggtgttggtaactgatgagtactaccgttggagttttgctaaaattgttcaagagctatttggagaaacgccaaacatcacagttaggaagaagcctggcattgccattctctgtatggctttatgtatctatgtttggcccaagaaactactttaacacgctattctgttgcagcctttgggaaagggatcgaggattctcgatttactaggctgttggtgcgtttgtgagcagcgctctgccctgtttgttgaatttggtgacagctttcagtgacattttgctgatacagctcttctgctttgtgaaggcatccccaaagaaaactggtccatgaccttagatgtcaacctgtcatcagcctgcgacattgcgttgattcttcagaatgatctgtgacctccttacacttttcttgcatggggggtactttgcaaatgacagacttcagcatggaggatgctgcatgtcttgagaacttttgacagaaagtcttggaaattcccctaggctaaactccccctccttcccacattgatacttgggtttgagctgcccatctatgccttaggcttattgcccaaactacaaattcagttcagactcacttggtattatttagacatcctctttcaccctttgaaaaagggacaagagagattggcattctttttggaaaaatctagctatgaaccttcccaagcccatgagccaatgggagagctatgaagcattgccggaagaactgactgggaattttccagatgggtgtctgttagtacacagttacaaatattctctctgttttcctgaactgaagaaaattacttcttaccaggattttagacatgtttttcttttttctttttcttttttttttttttgagacggagtctcggtcggtctgtcacccagcctggagtgcagtggtgtgatctcggctcactgcaacctccacctcccgggttcaagcgattttcctgcctcagccacctgagtagctgggattacaggtgcccgccaccaagctcggctaatatttgtatttttagtagagacaaggtttcaccatgtctcaaactcctgacctcaagtgatctgcccacttcggccttccaaagtgctgggattacagagtaagccactgcgcccggccgacatgtttttcatttatagaaacaaaatttgaagaaaaactgttaaggacaaccttctctacttgtgcaaacaaggaggaacaaaatatacaaatgctataaatctacatgatcaagaatcttgtttgtgtgtttgtgagcacacacacgcatgtgcatttgttttaaatgagaggatttttttcattaatttatggtctcgtagatatctttatctacccagattttattggcataataatccaaattagatattggcttaaagagatggatgtgcttagtttaaacatgctaagaataagctccattaaaaacaaactattagaaaaacaattttgtttttatcaactgtacctaaactactttaatatagatttgtaccttaaagcaaagccaagcattaactttagtagctatccctgtgcttttcatattatttgcagcatcaaaaattgaataaaagaaagagaaagtgagaaagaatgtgaacaattggcagtttcatcatgaaataagcaattggatgaaacagaaaaagatctgaaaaaggatttcaaatttctgttcttataaaatagcccttgtatcaagtccattcatttttctattaaataagtttatattgccctcttattatttttaaaacgaggtatttccttaagcctgctctactctcaccgccaatcacagcaacaacgaaacaaactctgttattcgctttattccattccacagggtggttttttggtaagttgaatcattgatattgcacctttttggctttcatgtgacaagattatcttttaacaatgatttatttttcccattaaagttgaaaagatcacttgatcataaaagagccagactctaacatcattcagggctttggaaactttcttagacctcatttttcagctacattgagtcagggagctcaaagactattgatgaagcatgtattgttttctagctgcttaagaaaatgtattggcattagtaaataatgctgaacacagaggtcaaaagagtaagttattcatgttcatgcacatttagtttctgatttttacattatagtccaaaaataagtttatgaatcctgacagtctccaagacacacaaatcctggctacttattttaaagcaaaactataccacacatttaccgtggattgtattttctaattcattatgtaccaaccaataatgaactgacctaatgctgttgtgaaataaaggcagaaggcatctaatggggaaaagcaccagataaatgttgaaggatcgacctctttatcttgattctgaactatttggaagcctaatagaaattattttaacccctttaaatcaccaactcttcatttccaaaatgggaaaaataatggaaatgtgaggactttaaaaagtgaatcagccaggggatagttattattaactttaattaagatgacaagtagatagatgaaatcaaatcactattgcattttcttggtaatagcatgataccaaatatttataatcaaatatggtttttgccttctacatgattgaattttccttgatgataattggaagaaaaaacaaataaaactttggaaactctttactatccagtgtttgaaatcattactagccaaattcataggccttctgaattcttggacacaaaaaagaaaatttcatgttgtcagtatggtttgggaatattctaaattgcaaagaatagcttcatgttcattggagaaggggagcgaagtctactgaaatttaaagtattaattcggttgtagcttttccatatagacttgactactgagtctggaaattaaattagtcagagttatgtaactactaatccccaagaaaaacccctaagatatttacaaaattccatcatgatcatcaccatcatcatcatcacaaatcattgccataaccatcaaaattaataagtagttattaaaagcttcataggaaaacacaccatgcttgcttctgctctaacaacactgtagcactggttcccggccttgactgcatatcagaattgtactgcatatctcctgctgcctaaccatattactgccaacttagctacctaaagcaatacaaatttattatctcacagtttctgtgggtcagaagtctgggcacagcttagctgaatcctctgcaaggctgcaaaatcaaggtgtcagccataggcgggttctcatctagaggctcaactgaggataggtctgcttccaggttcacatagtcattggcaggattgagttccttgtgggttgttggactgaaggcctcaatccatcattggttgttggccaaaagccttgtggaccatcttacagcatggcagctgccctcatcaaagcagcaagggagagacagattattagtacagcagaagttttaatcccatgtaacataatcatgaaggttacatccaatcacctttgctacctactgttggttagaagcaagtcacagttcccaccttacatcctaggggaggggactacacaaggtataaacacaagaaaggggggataattaggggtcatcttagaacctgactgccataagaatctagtggtagagcttttcaaaaataaatatttttgaagctcattcattaaaaaatccaatgtaagaagtctgcagtttgagctataagtaagtgttttaaaagaaaaactccccagataagtaaagtgcatagccaggtttggaaactccctgcacaatggaagctagttttattctggctctctggtggagacatgacttaccaagacataacatatacaagatttgcatttgaaaaaaggggaaatagaccatgaatgcctgtttcgataactagttttctagtgaggggaagtcttctctttggctattgattaatgtaataatgttcaaaaacttttatgaactgcttcattatataactaaaaactaccatggatatattatgtatgttagtatgattaaaattacgcattttaccataacaatccttttccaatgttgtgagttctgaaataaatgaaaataaaaggtgctttacctaatcatttgctaacgaaactaaggggtaaataatatgaaaaatgtaatacatttatatcattgctgataataggagcatttaattgagaatctactacatgacaggtacacaaagttagaggaatctctgaccctcataaaagttttcgaggtagataaactttattatccacattcttcacataggaaatcatacttaagaaaaattaaataactcttaggccacaaaattaatacagtattgaaggcaggaggtgaatctattttaaacttactcccaaaaatatattgcctggtagctggattcaatttaccatggggaagggggcagagagatgttatcttctttttaacattaaggaatcccaaatcacttattctcattatagtactatattttccaggtgttcagcctatgggaccctctataagaaaaaaacatcaattttaaattacccttttaataaataacccccaaatgctttggggattataagagtaggaaacttgattcatttttgaatctccagcatggcaaagtgcctgccactttgaatgtatgaaattaaggtttgattctacaaaataagagaatgatgaacatcttatacaaaccaactctatataaaataacttcattggtacattatgttaggttccattttctcagcaaagaaaactcaagctatattttacattatattttctcccagatgcctataagttagcacttaattttagactggataaaagaaatgaatagtgaaggatcccatatccccattttctgtctcaacaaaacaaagcttgaggcgagataacttactgtccctcaacatggtatcttgttagtaattgaacatgtcagtcatgatattggaaatagtggtataacttggcatgccatcttagtcctccaaaatgttggaaatacttagggttggataaatagcaatgaagtcatactgctcttgctaacccccaggccctgaattttgaaagcatgtcttttgtttttgttttcacacaaggatccctgttgctggtaattacagctttagtgactcacatatatttatatagcacctcttttccaaggtgccccatgtactttggaaacatttcctaacaaaagtgtgctgtagaaaaaaagtattctcatctccttaaagctgttcctgaaaaggaaagtaacagttgcagagatgggaagaaattttttttcaggtccccaagcacaacgtgaaaataaatattcaaagttaacaaatgcagggctaaagcaagattcaaactaaggtctgaatgacttagaaccacacagattctattatgcccttatgtgtatggacccactggagaggtggtggaagatagccttatctgcttcttgcttcactgagggtcccagcacagcaggattaatatggaagggagagatgagctccataaaataagattttggcttttacagcattcatttgacagatgcttaaagagctcccactagatgccaggcagtatgtgggacaccggaagtacagcagtgactaggacaagtgacctttccattcacatggagcctccatgtgcatggacattgcaatctatcagctaagaaccctggtgatgggttcaatgtgaattagtgggaaaatactaggatctgcaggcatcccaggtctgctccctcctctctctctgacctcactgtgtagctctcttccgtcctcattattttccaaccaccacggcttcctttctttctcagattcatcaagctcatcctcttcctggggcttttgcatttgctcctgtctactggaaatgagtttccagcagatccccacaagatgcccccctttccacagtcaggtcaccttctcaggaagccctttcctgaataattcgtctgagacatgccttcactgtacccacccagccactacctttcccagtatcgtgttttcctttcttcagagcacatgctatctaaaactgccttgctgctgcttttttttttttgagacagagtctcgctctgtcgcccagtgccacgatctcggttcactgcaagctctgcctcccgggttcatgccattctcctgcctcagcctcccaagtagctgggactacaggtgcccgccaccacgcctggctaattttttgtatttttagtagagaaggggttttgccgtgttagccaggatggtctcgatctcctgacctcgtgatctgcccccctcggcctcccaaagtgctggcattacaggggtgagccacagcgtgcttctttatctatcacctcagtgcttgccttcctcctccacactgtggcatctatgtaagcaagaccttccctgtcttggtctcctcagtatccctagctcttactgtgccttcaaataaaagctttttggatttgaatgaatctaacaaacaagtgcattaatgagtcatgttgggtcaccagcaaaggataggctctgattgaaaagcaggcgttagccctcaggaccacaacccagacccaggaaaacatacagccccgaaaagaatatcttaagaatttgagagttgctttctagtcagtccagtgaaagatgttcctcttcccaaccctcaccttccacctccacctgaagtaactgtcttccaacccaacatggaatacattggaaagatttgggaagaagaggaggaagctgccaggcttggaagatcagagccagccctgccagccttgtcctttaggccaaaaaagactgcctaagaaacagaggacccccaaactcaggtgatactaaagccacatttagggtcttatgtgaattatatgaatttccatagtgtaatccctttcagtgaggtgatttgttgccaagtccctgtcggccccatatctcgctgtacctcaccttccgtttgccagagaacacctctggctcaaattacaagtggatgtcctggtcttgctatggcttcagtgaagtaacataaactgcaaaatagaataatcaggaaaggagggaaattagctaagggtataaaataaggcctaaatgctgggaaaactggctagtcatatgtagaaagctgaaactggatcccttccttacaccttatacaaaaattaattcaagatagattaaagacttacatgttagacttaaaaccataaaaaccctagaagaaaaactaggcaataccattcaggacataggcatgggcaaggacttcatgactaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctacccatctgacaaagggctaatatccagaatctacaaagaacttaaacaaatttacaagaaaaaaaccccatcaaaaagtgggcaaaggatatgaacagacacttctcaaaagaagacattcatgtagccaacagacatatgaaaaaatgctcatcatcactggtcatcagagaaatgcaaataaaaaccacaatgagataccatctcacaccagttagaatggcgatcattaaaaagtcaggaaacaacagatgtggagaggatgtggagaaataggaacgtttttacactgttggtggtagtgtaaactagttcagccattgtggaagacagtgtggcgattcctcaaggatctagaactagaaataccatttgacccagtgatcccattactggatatatacccaaagaattataaatcatgttactataaagacacatgcacacatatgtttattgcagcactattcacaatagcaaagacttggaaccaagccagatgtccatcattagtagactggattaagaaaatgtggcacatatacaccatggaatactatgcagccataaaaaaggatgaattcatgtcctttgcagggacatggatgaaactggaaactatcattctgagcaaactatcacaaggacagaaaatgaaacaccacatgttctcactcataggtgggaattgaacaatgagaacacttggtcacagggtagggaacatcacacaccagggcctgtcataggatggggggcagggggagggatagcactgggagaaatacctaatgtaaatgacaggttgatgggtgcagtgagccagcatggcacatgtatacttatgtaacaagcctgcacgttgtgcacatgtaccctagaacttaaagtataataatttaaacaaaaaaaaagcctaaaatattggcctaaatgaagacttcaaatggggatttattcattcaaaaatatttcttgaaaaccttttatgaaccaggatctcttctggaaaatcaggctctggtggatcatccattttggtgtcaagagatacataataaatacacaagataatttcagatgatatcagaaattataatcaagatcgtgatgtaatagagaagaacagatggagacgggtgaggtggcccttgattagatgacctgagaaggtctctttgaggaggagacatttgaatagacacttgacctgataggaagcagggaggcatggagagatgtggggggagtgcaaagcagggaaactggttctggggaatgagggcttctgtgagatcaggacacacagaaggccagagggatgggcaaagccaggccaggtaggccttgccaatcaagattagaagcttggcttttattctaagctcagtggaatgtcagtggggtgtagggcagcagtaagcagaaaattagctgaacctatttatttatttgtttttaaattattccactggctaagagaagaatgaattgtagggggaaagagtacatacaggggacaaattagaaggttgttacagtagcacagtcaagctataatagtggtggctgatttgtatgagggaatacttcatattctatttgtcttattttccatatgccttttaaaccatttcctttaagcaataaagtgtagagagaagagtggcccaggagttagaaagcctaggtcaattttcatgtcacctcttaataattgtgttgtcttgcccaagtcatttaacctccccaggtcaattttattatctttaaagcaagaatatattttcttttaagatgagtcaatcccatgagataatgaacctgttacaatggaaattgctacaccatatggaagttatatctaaatgtgtcccttacaaccatcctaatgaagtaatctattgtaatataatgaagtataacattttttaaaggaaagaatattttataaagaaagggcttatctcaagttcttcttggattatttaaatgtcactcaaattttccctggaacctccccccaaaccacaagaatcactcctcattttaaatcctatgtttacaacttcaactactcaatttacaataacctcatattgtgtataatgttatatatcactagtgaaaatcacatgcttatatcttatctactcaacacactaaacatttcttaagggcagagttcatatcttttaaacctgtctctcctactttacccagaagaatattttgcagctgatagaagcactacacattttaatttattgattgattccatccagagttggaccatttttttattaaagaaggtgaggaatttggcacatgctggagatcagtctcaaagtgaacaatttttcactgtgtactattgaactcagttccaaaaacaatagcaagaaatacataaaatgttagcattaggtattggtgatttttattgtcttcgtttttcaaaataccttcccaatttcctgcaatttacacattatttcttttgaaaacaaatattgaagaaaagagaagatatgtcttgtttcaaacaggtcaatccttttttttaacagaatagaatttacagaacataccaacagaaccaagagaatgtcagtacttgagttctctaaagcaggggtttccagccccccagccaggggccagtaccagtccatggcttgttaggaacctggcagcacagtaggaggtgagtggcaggtgagagagcattaccccctgagctccacctcttgtcagattagcagtggcattaatttctcataggagtacaaaccctattgcaaactgcacatgggagggatctaggttgcatgctccttatgagaatctaatgcctaatgatctgtcactgtctcccataacccccaaatgggactgtttatttgcaggaaaaaaagcttgaggttcccattgattctacattatggtgagcatgtaacaataatagaaataaggtgtacaataaatgtaatgtgcttgaatcatcctgaaaccatactcttccccttacaatctgtgaaaaaattgtcttccacgaaactggtccctggtgccaaaatggctggggaccactgctctaaagcacttgaaatgctattacactaaatctttgtaagaaagctacccactttatagatgaactaaagtctctatgaatttgaatgagttgctaagagttgcatttcttcattcagctgagatttggagaaggcattatgtgtttcctggtaatttagagagaaggtgacatgaaatcccagccacagtctcctaacatccatgggattctaaaaagcccatggaataattccctttaaatagcagcaggtattggtggcatctgcatttcttgctgtttcaccatctcctcatcctttctacttctccagattgtttgtctttttgtggtctcctcactctctggctacatttttcctgagcaagtaccccactccctcttcttgttagtctattactttcatgtctggcagccataaggggttcactcaccattatctgcttaggatgttggaattcaatatcccatcagtcctgggggctggagtatgtatgcgtattattatttgataggtcccagcagaacagtctttcagagcaagatgcacatcatcagtggttttgctgatggatgagctcacctccttgacacagatctcatgattcttggcataaatctcaacaggaattagctgcttcttccactgtgttcccatagcatgttgtccctgtgtttcagtactggttttagtctatttcatatgccacttctctccctttcatgactgttagatgctggagactgagctatttttcagtttcctctggattcctccctatgcccatcatgtgccatctgcattgtaggctttcagcaaagctgtgcctgccagatcctcttatttctgggtgccaaaatactcagcattacacttctacctcacaaagatctacctggcttaaaatcatcacccacctgtgtgtgcctttggagccttcatttcacccctgtcctcacccctgacacctgtaagacactgagtcttactgagcccactttctccatagtcatactctatgcacacagccatcttccccattcctctctccctctccctttcccttgccctgttctcagcgttatcatccccatctctcaagagtccactcagactttctaaggtgatcatttgttcatctgagcacagtaggtcatgcttcctgctactcctgggaatataaggtaagagacgtcatataatcaggtaaatagtgaggatttccagtctctacataaggtattttcaacagtagtgttgactcacctcaaatcacaccacttagacagctataaagccaggcttacctggaattttctttttctgactcatgaaactcttgtctctgtcatatgtgtatttttacttctgaattaatatagccatcctgaatcctaaatccacgcgtgatttctgagaccactactctcactgctaatctagttatgtaggaatccctcctaaataaaaattttaaaagataaaacatacaaccaaaacacaaagagccatattgagaaccatgcaaagcactttaaaagtggtaaaagatactagctagataaattcaaatctctagattacaaaaatggaaattcataaattaaaaaaatacctctagatacctttatatttgtttctttattccatcttgtgtgtttatagaagaaacaatattcaggtacttttcattttactgggatgagaaatggaaatgctaactacagtgcagcttcatgactcaaaagtctgtaactggtattaatgaacttttaaaatgctaattttaatgcttactccaacagaaagatgccttaaagcaaaacttcacatttcttatctgctaaaagcaatgtgttttgcatcccttacaaaataaaatggttgaaataaggtttttaaagggcttaaagtttcaaggacttctcttgttcttctagagaaaagaaatttataaaatcacatccattaatggtccctctgctagaaaacgaaaatactcccaaatatgttccactctaggaaaatcaaaaataacatgtaaactacaaatatgttagccaattcagaatatttattaactaaataatttaataataaagaaaatgccgacttgattaattgttacagagtaaaaattacaataaaactgtcttgatcagtgctttgcagaagcgccattactgtctgtgcagttgtttaacaaggatttaattggaaagataagtgaatgcacatttaaaagtattgttaatttgctttataatcaccccatccttcacagtattgacagcacaaggcacaaacccctttctgttttacaagtattattttccatatgtgcacaataaattctgaagcagtaattggaaattttatgggatccagtatacctagtatagtgggtttggaggtgcactcttcctttacaagaggtaacccagttctagttgttggaaacgagtgacaaatctttgatgtatatatttcccctatccatgtttgttcaggttcatatttggtccatttctagaaaaggttgcctctcttatattttatgtctaataaaatcaagattgagaggagaaaaaaatatgaattatttttagtctgtgactatttgtattactttcttgaaaatgtgcattatcagtggaggttctaaccaaggatggtttctagactgtagccaaacgaaatcacctgtatctgaaaatagtggtacctgaacctattaaaggagacaagagaaggggcaaagaacatctatgattgatctctacctctgcagccacactgacactcactcacacacatcccttagagtttggaatcatctcgtcaaaaatctaatcagtgtggtttgcaaaacaacatgagtgtaatgcctcagatttctaagaggtggcaaccttgactacccaagtttccaatatacaaagcccaaagaccttccttattgtagaaagagcctaaagctactttggaagcaggtcatttgctcatttcaaatgggtagagaatgttagagtgccttgtttattggctgattctcaaggagccacagtctttaggatttatttcaaaagataaaagagcctaaaacttaaagtataataataataaaattaaaaaataataataaaaaagatgaaaatatgagcgtcttcttgaaaatggggaactgttcattaaacctattttgaaggcaacagttgttcgaatcctctctattgataaaggctgcccacttggttatgacgagcagggagtgtccccaaagtgtctcatgccagtggcagtaaaagcatgaaaaaatatagggaacatgctaaatagcctcttggccatgcccccattagctagaattggtagaaatatctttaggtttggttaactatagatttatttttttcctgtagacagcaaacacttcaactataaaagcttagaaatgtcttctgaggaaaattttcgttagaatcctttgcagtgtaaacctctttgccctctggataaaatgtgttaccttacgtattgtcatgggaacaattatttttatctttagtttggctatgcctctaaatctctaaacttctcacatttacattagttttttatgcttacagagtaaaatagatacacatattgagtttcacatgtctagagattttccaatacatgctaatatccgatcactaataccaactcgcaaatcacataaatctatttcttcattctgacatgtatatatatttctctagtgaaaattcttaccttgctgagtttcactctccctatatgtgtaagtacttgtgtgttgtaaaaactgtgcgcagacacacatatgtgtacactttaaagattacttttactactttttcaaatttctccattggaggcatggattttaaaactgtttatctctggtgaaaatgtctttgggaccaagacctttatatgccccatttcaactagacagagctgagactggtgcaataatgaaacgtccagctgtcctttaattaactaaaatgaggaaaatgtaatgttttgatgagagaaccaggattctgtgagggataaggggaagactatatgtttctgcgccttcctgcatatgacacagccatggggtgcaggaaagagaggaggcatttttatgccccagtagggggagctttcttttccctactgtaaggacagcatggtgcatgtgtttaaatacaccatcctaaaatgcagacttttcattttcattttgcaagtgggaaatttcactatgtgatgggcacattactcttcttagcgacacattttgtgcaaactcatttgggaaagaataggaaatttaaaatactgccttcatatttcttctggaaatgttagcctgaatccattatttccaaacctgatgaggattacagttcatttgtatttcacagcaacccatattgtattctgttttgtgaagtaaataagagatgataccgttctaatagtgcctgtattttgctttccatgttaatagtcttattctgggggcaaaagggaaggaaaaaggcagagagtggaatactcaatttagccttctctagatggaaggaatgtgttattctgacaaagaagtgccctgaattattttataaataatctaaaccggaggaggtggaacacaaactcacttaggtcactgagtatatccatattcaaatgatattataaaaagcactgttcattaacacccaaatctctatctcttatttaactacgtttaaaatactcatggactaacctgatttgacagcagtgtaggtggatgcttatgtgccactgaagggaattctttacaaaataatttcccaccagcatttcactgtgcctgagatgccacaatttgaaaatcaattcattggctgaggcaggaaagacaaataatttcacctcttatactaaatacagttgtttcttggtgactgaccagatggttgtgttaagaaggatactgaaacattgtcctaaataagtgggaaagagttctgtgatccatccataatggatcacattaataatgtatggcacagatattatttaaaaagaaaaaaccaagtgcctgaatatgcacaccatgcactttatgtttccggtttaagatattggattaagaaaaaattgactgttatacaaataacatctgagtcttacactctatcgacgtaatcatgaacacaaatcttttaatctggtaggacatcatataacctagcatacctttaatggaatacagcaaagaacaggaaatatcagaagaatcagaagaagggaggattatatgataaagaaaaaagaactctgggagttgagttagattaaaaagtcacattttacttaacaattttaccacctctttttcacccactgactaaatttctttctgatataaagtatgactaaactattttggttgactctagttcatagattgaggttatttctattggaatgaaaggaagtccaaagtaatcctccattgaagaaatgtcccagcccaattaatgattttagctgatgaccatatagactatctttctgtctacaaagctgtcatcaaactatagctaaaactaatcctcctaattgcaaatcacttgaaaataaaagcaaatcacttgaaagagagaacatctacaatggaatgtataagtaaagtcttcccactttaccttcacttactttgggctcaggttggtgagatttattttcattaagacaaattcttaggccctgaaaaaatagatgaaacctaccatctgcaccacatttcaatatttgacttaagtcatctgttgactttgaacacactcgtgtaccattcctcatacgagctaaaatgtaatccccttcactggggactgtaaagaaatgttgactttcgatttctttacatatttgatctttcaagatatgagaatgctgcagctggaaaactcagcaccattagggaaacaaagcagaaaataaaacatacaagtgaatcagttaggactcttctgattttaagggacaaaaaccaaaggatttttttcctttatgtaactggaaaaatcaggaaatgatgcagcttcaagcataactaaattctgaagcttaaacagaatcgtaaggcctaacctctctcggtctctcagctctgctctcctccccattagcttcatactcaggctttgcatggttgtaaaatgaccaccagcagttctggatcaacatgatccctgcttctagtccctcaggaagctcctttcccaaagcacctgactattattaaccaaaattgtgtcattaactcatccctgaatcactcactgtggctaaggaaatagaatgggctgattggcttagaacaaggtaacaagccccctacatggaggtagagggagattcccatccagaattcaggaactgcagtataaggagggggatactccccagaggaaacctggtgcactatgttcagaaataagatgctctctacaacgagtaagtgaatttttacagttaagacaaaaaatgccagactgtacagatagaagagatgtcaaatgtcactcaggcaattctcttacttgcaagcagtctttgaacgtgcttaaaactctttagataaattaattttgcagagttttgggaactttttaaaaatattcagtaattgctttgggagctgatgtacataaacctcacagcaattgattggttcaggaaaggggtaatcatgtccaagttacgttggtttgctagctcaggtataagtgtggaccctcatatgtcctgagtatttcatttatacataatctttgaaatgttttaggagcaaaaaccacatgctttcaaggtcttttaggcaaccaacattgaaaagaaaaaaaactatcattaaagctaagcacatgttgtcattcaagtaccaagatatttaatagaaaattacaacatggagtatgaaagatgagagatttaactttcaacaggcaaaggtaaatattgagagggccagaataatgatgtggaattatgtagatgaaaatcttgccaagacctgatagcaaatacaatccagcaaagggccagggagagtaatgttgaaatctttgatgactctaggccatctagaaagcgccaatggcgctctatacatttttaaaaaaggtgggggggtagttttttggttgataattttggtcatttttagtggtatccctgtgcagaagaagatgcttttattcaataagagaaaactgtttactgtttttgttgtatcagggacacatgacaaagcattcaaatatgcaaataattgcaaactgatgtatccagcagtttaaaaattgaataaataatttagtttttacgcatgggcaactcttgctaaaaaaactacaaatcagaactcttctgtttgaatctattttattttgttaatagatgagctaatatgataggcatttaattgtataatatattattagccattttctttggcataccattaactttaaatagtattaatatttaacatttcataatatacactacaaagttcttattttttccagctgaacagaaaatgtacattgatagtaaatctctttaaagtgggttttaagatgctaagtatgcaaaacctgttccatttatactgtttgatcagaaatactcaaaatgccacagcataataaggcaaatgctgtaagatgacaatgatgccaaaactgtattatgattgtgtattcaaatacaatgtatcgcataattaagcataattatataatttgaatatttaagagagcatttaaaatgtgataggaagcatctaagtacatcgacttctcaggatggttaaatcagagagtgtaaagttgcgattagtatttgttactgaatggaaaactaattcaaacacaagtttgcaaggagaacacttgtagctggctcaaaatcataggccctaactttgtctcattacatttgaatctgtttaaatttgagtaccatgtttttctgtccttgcaaaacgtcatttagttagttgaggtggggctcagagtttctaggatagttgtaggatgcctaggataaatgatgctctttgttccatggatatcaattgtgcccttcattcagaccagcattctcagataggtgtgcccacgaccgtgaggggagctcgtccaaaaagaataaagggagcaactcaaatgcatccctgtttccaggaagactgcccagaggctatgccccacttagtataaatcagccagatctttttgtcgagggaagaatagtgctgatcatgcaacttcctaagtagaagatgaagcttgatttcttattaataaatatttggggggtataattttaagtgggcaagaattaagattctgaacttttccagcactccctgcacagagctttttttctccattaccagcactgaaacatttgttttatttttttatttttatttttatttatttatttaagttttagggtacatgtgcacattgtgcaggttaaaagaacttttcttcagctctcagtgttctttcttaataaaacaaatgtttcttcaaaacatttgttttattaagaaagaacactgagagctgaagaaaagttctttttatttctaattctccctaaattttcaatgatgtgaacataagcccaacagaccaggcttatggcatactctaaaattgcagtagaaactcgaacaattttttctacttcattttatgtaatggtgacttaattaggggctaaagacaggtgaaagaagttgtcccaacaacgagtatttaatatgtcaattttttcagagatttgtgccattgcaagtaaataggaaatgaaaagacaaaatttaactaaagatttcctgtatctgttagtaccaaagccagataaatttctccagaggtcaacatattctccagaagctgaccacatccaattatttccagcccacgcccaacacgaatcttatgctcctgcagacaaatataattattacaggcagagaatggtatgtttatttccacctcgatgacttgccggtgacaacagattctgtattctggatctcttcttttcccgaaattctcttgcttagcccatttttcaaaactccactgaggttccaagttcctgtgatgaattcagctcattttcttactcatccttcttttagatgtatttttaaattttaatatgcgttttatcacaattattttaataccttaaaatatttaatattttaatactttaaaatatcctagttttttgttttctgtatcattacaaatatattggtacataattctaattaatatatgtaattttccctttatactaattcatgcacttgtgccttgtcttcccaaccaaaaccatctagatcctcatggataggatcatatttgacttttatatttttaccctcaagctgtgcaagaaagtgcctataaataatggatgtttaataatgatggtcttaatgataactaatatatactgagcacttcctatgggctaggtactgtatgtgctaagttttgaacagtagtatcttgtgatcatcacaataatcccacttagcaggttctattttcattctcattttaagctaaaggaactgaggtagaatgtgatcagtaacttgactgcaggcacagaattggtaaccagcttcacacaggtatgcttgaacaccgtccatgttttcaggcatactcgatggactaattagctccacaaaaagccagaagatgcaagtgccaagtgacatttgtctcaatatgccataaaggttagagaagctgcattttttttatagtttcactttacagagaactgggctcattgtggcaaacaagcaacttgctgtgccagctggtacatggctatgtgtcattgcccacactgcagtcacatcttggagtgcccttccaccccacagccccatagccccacagccccacacccacctacaaatctcttattcatccttcaaaatcaagctaatatgttatcacctctctgaaactgtccttaaatttcccagggagaggcaacctctccttctctcctctggttttccttcattttatccatgcatttgccatagcatttagtactgtataatcatttaccttctcacttcgagagcttgaattccctaatagcaagtagggagggcttgttacctttacctctactgcctggcaaagggattagtacaacaatgtaaataaataggtcttaaatgagttacaggaaaaaaatgtaggttatacttggaattagctgtctcaactccggaaatggcacattctgtcgctattctccggcatctcccccaacttcacattcccagaatctttggaagagcaaaaactctcatcttcaaagacaattgcttaaaattttccaaggattggagcttctctttcacaatcatttcattggtggggagggtaaagggaggaaggaagaggtcagtttcttttcctgaatgacattatctctaaagactctggaaagtgataagtgccatttagcactcttttatttcaagtgtctatgatgtgaagagtgtttgcttctgcaggctgagcagccccattggagtctaatattagacgtgatataagatgtgcacatctttcacattatgaggctttatgtttcaaacccccataccttgcctctgtgtatttgacagctgctgtcctgcaaggcaatggccagtaagaggcatgattgcactaaattggaagcatgaggcaaaagggtgtgtttttattaggggggcagggaagaaatttgagggtagtaggttagaagaaatcatccacagatgctgatctctgtcggttagtggatgtgatttctgaattgtggtaattcctgtttctgtgacagttcatcaaaaatcgagggcactacttttgaaaattacccatggtttcatttccaaactagatgcagactctgtgcttttgattattagaattattcaactcactctgtggggcaatgaggaggggcattgataaatcctaccccaactgatactctgtaagagattcgttacagaagcatgaggtggcagagcaaactccatcactttttaacaagtgttatctaaacacacagtggcaaccgatgagtgagccaaagtgacaatttggaaattcatttctctccttcagaaagtctgtgtgggttgggaacagtagaactaaaagatgtggagacaaacttttttctacttttattaagcatttctagatgaattgtgaaaggcaactcagcagatgtctactggcatctctctttccccaaagacttcttttaaagtcatataaaacacttctcataccagcttgccaatgggtgaggaggagacaatacttcaaaaacttttcatggttaacaccagattgatagttcctttagcaaagctaaatcttgaaagctgtttttctttcattctaccaagaactggctcaggttgagtcccagcttttcttcagggatatgggaacactcagatgggaactgtgtagatggaagaagtgtggaaagggagagatgagtgtacattggctacgtctagtgcagggaaatcatttctccactggtctcacgtacagctggccaccctcctgatcttgctaaaggggcatataagtgccattgttaagagatggggcttaaaatgtaagaggagtttcaagagaagtgagctgcagatccacataggaacatgtcaggaattatttaagtggccggtaatatgagtatcatgctaccaacactgaacagtttatcacataaatataattgtcttctttgagaagaataataaaagctgactccatatgttacatattatttaaaattgttcctgcaagatgtattagtcccagagaagaagcaattcttctaccagaggacaacagcagttttattgtataacattgtcatttgtttaatttgtttgttcccagtagtagttttacagatttttacgaactgttacttttatagaaagttgagttactcatgatggatattgctggcattcgtaaagacaaaaatggggggggtggaagaggtcagaaaggtagatggtgtggatttccctaatgaaatttgcttaagccaatgcttctgaattcttagagaaaccaaaaattactgtagggagttaggttctgtttgggacatttctaagatttttgtgtgagtttatttaaacatgatcaagttaaactcagtctggaagacctcttgtgaactgacaaacaactacttttattcagaaataattgtgagtaaatgggagttctccgaggttttatgtttttgtatttgaaccaattaccaaagaatactaattttatagttcaatgtctactaccaatttttaggcattttattggttaagaaaaccagtttcctctgtcatttctcacaatttcaactaaactttactttttagctaaattaagtgaaacttttctaggtaaatttggaaattttggaattttaaaatggaaacattttagtttgcattctcctttgactgatagatttaatatataccgaatgagaaaatgccacccaagagtaaccattcatgttttttgaactgttaaaatgcattctattgcagtttcacaacactgaaagcaagtgtctaaaattaccgaaataaagctgtcccaacagggtagatgaaaaactggccagataatcagcagtaaagaccaatcttctttgatatcaaggtatctagacattcacaatttgttcatttgtagcattctggcagacttaaaactctagacgagaatagccatgctattgcaatataatctggataattagagcatttagaaatccgacaataggccatgtgcggtggctcatgcctgtaatatcagcactttgggaggccaaggtgggtggatcacttgaggttaggagttcgagaccagcctggccaacatggtgaaaccctatctctactaaaaatacaaaaattagctgggcgtggtggcaggcacctgtaatcccagctactagggaggctgagacaagaattgcttgaacccccaggaggcggaggttgcagtgatccaagatcatgccactgcactcaagtctgggcaacagaacaagactctgtcaaaaaacaacaacaacaacaacaacaatatagaaatataatacatatctacaaaagccaattgaagtcaaactggaattctgcaaagcaatctttatgaatgtgagtaagttaggtcatattaggttggtgcaaaaataattgcagtttggccattatgtttgcaccaacataatacatcttttattctcagtgcaagatttttgatctacatttctgaatagcttggaaaataaagtatggtcacatcagaaccagtggcaggtaaaatttctaattataaattggctcaaatgatttatatttgactttggaatgtcttgctaatatcttcgtacatgtattttactttttgctgttaaaacattttctaaacatactgataaagactagagagatggatcagaaacatactgggtgttaaaaaatcatcccgaggtttaaaatgttctttctaaatttagataaacgcaagataaatcccacaggaagttcacaattccatagatgtctaaaactaaaagaatgcagagattttctcagctccatgccgtttcttgtaattgtatgttgactgagtagagagttataaaaacaccccagcctgattttatgcaactatattgctgtttgtcaaaagaatacttaaaaacttgtcaaaagaatatttacaaactatatttaagaatatttaaataactgctataaaatttaaataatacaaaaatatacaaagaaaaattacatcatctagtcatttcataaataaacacatacataaatatacacataaataaatatcttaatatttagtgaacaacaccattctagatggccctatgtgttggtgtagagagattgatagagatgaatagtcagataaaaatatgattctgccacagtggttattccttagcaaaaatgttttatgtttagttctacttgaattttaagaagaaaaagaaattaaatgaacttgaaaaatgactgaacttcaaataaatgtttatttgacccaagaaatattagcttctgaaagaagtgtttttaataaaaagtgtttttattttagaccaaatctttctcattgatgaggaaattagtacaattattcttccttccagatagtcttccaagttatttaggattttattattgaaaatgttatattatttacatttataagtatatccccaatattgtttggtcttattctatgctgcacaggaaatatgttcacccctttgttattttaccaagttttctctgtaagggaaagtgccttgctgtaattttgtgtttattagatttaagcattcagttacttttccagaaagaatcatggttaggctactctctagtttctgaatgtttcacagtgtctgcaaatggtcttatactggaagagcatgtcacggtataaaataatatatctatatttaaatttctctaaattttgcacactttttcatgtagcactcagtgttgctgtgaagttctctgaggtcattcctcccaccaccacccccttggttagtatgatttacctgtgctgcctggaacaccatatggctatatttttaattcctaaattttaatagctacactaggatttgttagattaattgttctatgtcaaattttcctgggactaagtgtgtcactttagtaaggaaatttaagtccttctgtattttcaaaacttttcttctattacatctttaatttttttttctgtggcatttgctctattctcttcttcaagagaactagtcctatttttcttgtgtactgtaatcacttttatcaatatactaaaactattcatagacatattttatgtctttaatctttttcttttcattttatataatttcttctagtttgtataccattctgtgttttcagtcatgcatattttattttgcttctactttgacatttatagggatttgttaattccactaatttcctgagctctacccactgcttttcatctttttgaatacttatagttctttttaaatactctttccattgcataatatgtaaatattttttttttaactataggttaactatttgtctgaattccactggtttcttgaataattcatcttctgatgtatagcccttcttcctttttacttgggtctaattgatgatttcatgctgtttctgtaattagctactttttcttgaaaaaggccatttactcaattactctaattcttgattagggcaattttactcaatctcaatctctcaatctctcaatctctctctctctctttctctcctcctccatccctctccctttcctccctccaacacagctctgtgtgtcagaatctagaaatttctgtttcctcttcctccttcatgcaacttcctctttggcactgttcctatgtgatgatcctgaggaatggacaataaaatgattttgccttcagtaccacctcccttgactttctgcagcatgaaatttctaggtcatttccttactcataggatacagccattcccatgtcctgatactctaatcagattgtcagatattactcttgaaactgtaaccctttaaaggaaacctctttcatctgccatttttgaagtttgtgttgactctcagattcttccctcatcttggtgcagacttcgatttctatttttacagtatttcacagtacatatgactgtgtatggtttgatgctatggctatttttgttttactaaagattgaagggttgtattgttagtgtggtggctctctacttttcagggtttgttgttttgggaatgttttgaaagaaattagttctgatgcttttcactagaaataatctatgacctgagctcttgtggactcctaaagtttgtgccactgtgtttcggtcttacttcaaacattacttttaaaaaaaagcctctttctattgaattatttcaaacaaatcaaatatattatgtttcctgaataccccttgctttagttggcttttcccttcccataatgaaggatgaggaccttcctttcctttgtcttctgtctttcacagtcgtttctggaataccagcccttctatcagaactggatggagacctgtggacacccctagtaagctgcagatttttcacagtggtcatttgacctccagagcaagccaataatttgtcacttcattaaactggtatttatatttattaagttttttgagatacaatccctagtattgagtgatagaagagcagaaaagaagtctactgttgttagcacctcaactaactgaacccattaaatcaaaagcctttctcttaactggactcaccttccttagaagacgatttaacaatgttttctttctgctcaaggataatcatttagaattttagccctcttccttctttccaaacagcttatcaaagaaggctatgtaattgtccccctaacagaagttctaataatataaattcctcccactcattagatttcagttatgttttacaatcccttttggacaggagctctgggaagccaatggcacctgctgtctacccctccatctaactttcttccctttactacattctggagaagccatctcagttgctctaagtacttatgtatttgccttttcctaatattggagaaaatttaagctttctatttttttaatggcatactccactgcatcccaatttgcttttgtgagtagaagagacaggtgtaaatttttcttttaatttttactttaagttccaggagacatgtgcagaacgtgaggtttgctgcataggtatacatgtgccatggtggtttgctgcatttaatgacctgtcctctaagttccctccccttgctccccacccctaacaagccctggtgggtgtcgttcccttccctgtgtccatgtgttctcatttcaactcccacttacgagtaagaacatgcagtgtttggttttctcttcctgtgttagtttgctgaggatgatggcttccggcttcatccatgtccctgcaaagaacgtgatctcattcctttttgcggctgcatagtatcccatggaaatttttagctagttaaattgacttgtatacactctgggcatgcccaccaggaattctcccacaaataaacatcccctgtactgtgttaagcaataaatgattctggaacctgttcttttctgcccagtttaaaccctctgctttttggattgggcaagttttctatactctttaataaatttgttttcatatttgttgtcaaccagctgacagtttctctgccctttttataacctacttcctgattcaagacattgggtcaagacttttaaaaggccttgacttcccttttgctgattcctcttcattatttcacctattaaactaggcatgaaaaaaactcaccattgggccctcttgcctacccactactccctcagaaaacttgcagagttcaagcatcacttgcaatcaaattattctcatacctgcatttctaacccttagtttcctcctttcaacatatcattagaagtgtgattttcattgcctaaatatatacttccacttaagtagtcactggtcactggaatgatagagaaattttatctttgctccaagagatctacttcttctccatgtactctactgcttatagaaattgactgcatttcctttccaaaggtgacaagtttaagtcatttctaatacctgctttttgtctgtctcaaccacaactttaatagcatttcttgaacacaggcatcacactgtggactttatttatgttatctcatttagtaatcacagaatacaaagaagtagacattattatctcagttgttctggtaaggaaactgaggcttagtgaggttaacttactcaaaggccccatctagtttgtgacagagccaacattcaagtctagggttgatggactctaaagtcaatgtgctcttagccactttgcatatcattgccttaaacccatccctctttaggtctagggtaggcttcttgagtctgcagctactctcttttcaacaaacatcaatcaaatggctatgatatcccagacccaaggtaacaatataaagatgggtaggatgaggttcctgttcaaaagacttttggagctagggaaaaacagaagcactaaagcttggaagtaattttatccattaaacataaagtgaaactgttaaaaaattaaaattaaactcatataaataggtgaaatgtattttttcaggtatttattactttatgtgtgtaacttaacaactcagcaagaccgattttggcagaaaggtgtggcttatatgattctagaatatagaatacagtatgaaacaggatacttgacttgcacagaaaaatatcagtgaagatagtaaggattaaaactcattttgtatttgctccatgaagcagtcactgctttctagtgcccttgattcacctgaatgtccataccccagctgtttagctcatttccatgtgcatgccccatttctccttcttgagagaaaacaccatcttttaaatattttcttaatttttcacaatctgttttccagagtggatggcaatgctaacaggcaaaatttctgtttctctttaatttccaattaaaaagtagctcagaaacacttagcatacacttttgctctgttttcttcatagtattacagcacaaagctaccttgtttagttgtcctgtctgtctctctccatgagcagaaggatcttgcagtctcactcaccactatatcctcaaagactgacgccatgataggagtttaataactgctgtgtgagtatagggataaatgaaaagatttgggacaacagccactttagccctcactcctgtcctccaggtcactcctctcttgaccactgcataaaggacatcaggcctcagctgcctggccccttcttttcctcacccccaaccatccattcctcctgggtatctttatggaatctaagtgctgattagaaatccttccagaatcgccttctataatgtttctgttttattatctttatttttctagtagactacaagatacttgaaggcagggtgtgtcttttattttgtcactaacagcatctagtatattacttgggccttcactagatgttgttccagtggatatttgttattgaatgttttttattaattggcaaaaaattaagtttggatgtgtgccatgtatagctgcacattttttatcaagtggtgagtattcttgttgccgctgcttcaaagacttagtaattaatacatgtatctttgctctctctctctctcttgattcagtacctattgcagatgatagcctcatttgagaaacacagattttctttttatcatttatttcctacccaggagttatttcttcataaaaaattagtcatccaatccaggtcctagtgagaactacatgagtttgggatatcatgtgcatataggagctaaaaatatatatattgtaaatttccaaaagtatacatttggtgcttaactcactattcacagttactttattatttttcctactaatcctttccaactaacttctatccagaggatccacttccccaatcgatgtgattttgctttctatttttcagtaaaattttcaaaacatatgcattaaatataatattagattgtgacagtcagaccattcatttcatttctaggcacaaaacaacatttgcttaaaaatgtggatcctggaatcacagtggtttggggtaaattcatgccatgctgtgcaaaagtggcacagccttgaattggttaaaatacttcagggctctgcttcctcaactataaaataagactaataatacttcctaatttataaagttttaatatgaaacccaagtgaaatagatgactattattattgttattattatgcaagtgtttctgggataagttggttttttttgtttgttcttttttttttttctttttttttttagagaaagtcttgctcttgtcccccaggctggagtgcaatggcacgatctcggctcacgcaacctccgcctctcaggttcaagcgattctcctgcctcagcctcctgagtagctgggattacaggtgcctgccgccatgcctggctaatttttgtatttttagtagagacggggtttcaccatgttggccaggctggtctcgaactcctgacctcaggtgatccgcctgcctcagcctcccaaagtgctgggattagaggtgtgagccactgcacctggctgggataagatttttataactctattttgagaaggatttttgtctgaagaaactcacttttatcactttattttgcccaaataaagcactatagtccatatctctgtttcaaatattatttattaaattcaatgtttcctggataatatgccctttctgaatgacagtcaaatgccattcagtaattccctcatttttttctgccaatcctaatatatcctcatttgtttataaacaattcatttttaaaattatactctcatataataagtgaagtgtctttattttgttcagatatttattactttatatgtgtttaacttcataactcagcaagaaattatagcatcattttggaaaatctccagtcaaactctgatctttgcctataatgtatctggttttatttaactgaaatgggagaattgaatacttttaggtttttctgctattcttagttgactatttgactttagttgtgtcgttctgtaagaaaccttgacaagttaaatttatccatacagaaacctatagttaggagacctgtgagatgactataatttccttcccattagtttcaatgaattccatgcatgtgaaagagaattggagagtggagtctgcagccctgtgtttctcgttgtgcaggtatattgaggagggagatatagtccaggtctccttaagttgttcctctgctgcacattacccttaatcctcctttgagcaaatgcagactagagcagctatgccaagaagagaagacttaactctttaaacacaaggggcccttggacacttagcttatgcttcatacaaaacctgtgaaatggttaatatagaaatgtgagtgtcatttgtattgtagccaatatgaaccagaagaattgagctgtagccagcatttatttaagcatcatttttgccatctggattcttttgtggggaaagaaccattcgaagggaattgcctttggttacaaaggtgatttgacttttctctctatttatatgtgcaccatcccactggcaccgttgttcaaggttccataaagagacacttttgttctactgctgcttgagagtttaggtagcataggagagcctgaagaagatgtgggaaagcgtatcaaacatttttgtggacaaattggattcataaaggacattggcctgtatgtggaaaaaccaactaaataatttaatccaggtaaaaattatgcagccattcactcacacaggactcattggcgtcttccctaaaatacaagtcacttgatgtggcaaatcatttgtaggtcagtgttcaaacccaaatgcttgttggacacctacctgtcagctggtttaggtactgattcaatccattccttagcaatgaacctgtaaacaaaaaatggctatcacccaggaatcataatttctaattacctttgacctgtggcaaagtacaataatttaaagatgatagtgagcctctattacacaaatgttttgaagattaaaacttgagaagattggcattcacatctgggaattataaattttattttgatgttagaagaaaggcttttacatgagtatgatctgatatattttattgttaggtttataggattcagaatccgtggttattttatgattatgtgatcaggtaatttttatcttatctgagagctctttcataatactgcattaattaaatcgctcatctgaataaggagtttaaatggtacagtgggcaatgaagtaaaatctgtagaattcccagccatagcacatattattttaaactatattagagataaaactatttattgagtgctaacttctgcagagccttatcttaaatacccctagaatatataaaagaaacactcacaagtaaaggtcttttaaaccaacaataaagtaatagatcaacaaatgcaaaataatataatctgtgcaaaatatttatgtgccattcacatacacgttacaaaaatgattgaaatggaaatgaaaattattggtattctaagtattcatccccttatactattaattggaaactgatatattatttaactcttaagcagaaatgtgtgatgtttaaaaataaacagcaaattatgaagtcacaaggtaagtgttaaaatacatatatatgtgtgtgcatgtgtgtgcgtgtgtagatgtattaatctcatcattaaaaggaggaaaaaagagcctttaaagtttccattatccattatgtcaggtagcaaatatcttctcaatgtaactccagacattaaatctgtcgagaggaatgctgtaaaataaatgtctgggataccttcataaacaaaaatcttatttccataattcatacagctggctggcatttattggcacgtcaggtgcaatggggacatttcaggaacattaacatgtacagcatcatttgtcaacaaagcaacaatgtaagcaaatcgttcagaactcatacagatttacagctttctccgccagctgctaattacggtgtgctcggcctatttggtatggtctttttattggaaaatgacaaaggggttatagtatcccagtttggaatatagatgtggcttttagtaataatatgaatgtaatatgacgatgtagcttggagttgtgatccagttttcctggtcttataattgatcagctttgattgatgaaggacaagagaaattcacagcctattttgtttctgatgtaactaacctctaaaacaaaggaaaaataggggaaaaattatcaaagaccatgtcacagcagttcttaatgtttttccctatggaacatgacacataatatttacctctcaaagaaaatctgatatgttgattgctggtggagcaaatgttacaggagcctgtacatttcagaattctacgttgtactttgaacaatcagaaaggccttacacaaatatgcttaaataatgttaaggttatgacagaaggtgacaaatgtcagcagcatcaaagttaacatctataatcaccccctgcttacattgttcagttttaggaaaagacacaaccgtacaagcaaatgatggagtgtcaactctaccttcaaattccctggattgtgtcaaggcatattataatccataaaatgaagagtggtgctgtctttgtgcccatgatgtaaatctgtatttagagatggtccttctgtttaaccaaaatgcaaaaagctaaattggtaaatacttattcgaacattgtttagatttatcccatcccaaaccttattaaaatccattaaattccagagtgaaccgatttgacattcagcaaatcagttgctgtcagagcagctgacttgaccagatattaaaatattttcaactttgctggcatcagatcctcggcccttcctagagctgataatgtcaggacagcaatggttgactggatccaaaatgcattatactaaataagtatcattctcatgttccaaaaataaagattctaactccagaaatagtttgcagatagtgtccttctattttacgtaatgccccgtggaatcctgtaccatcttcgcttacacatttgtcattatgtattgtaattgttggtttcttcctcctccactagaataggattcctaaaatcagcaagtaaattatgtttaattttgtaccctcagagcctagtactacctggaatatagtagatgccaaattaagactagtcaaaagaatgaataaatgtgtacatattggggcagccctgcatgagattgtgatggaggaggaatttgctttaatatcttgcccactcatcctttcttgaggataccgtctcctaagtcctctgagatgcatatttcccatatacttttttctttgtcccttattctaaaacctacttgcagaagagtatctgaaactcataaacattaagatgtaaaatataaacaatcttccaaagtattgtcttttccaggggcatttatattcaaaccaagatccatcccttaaactgaaattgaaaattaatttgagggtattagacattattttttatgtaaagaaacatttttacagtgaaggtaccatcttggttttctttagtagaaaggcactcactcaacttttccccaaaccacccttgcttggtgctaaatggagatggtgttggttctattctccaggattatgtggcatgtagattctactaggaattgaaatgaagaccttagaatggaaatgtggcctagctaaggaagaatactatgattttaatttgcattaacatgaagtccttctagactgagtcaatatgaagagaaccatctagtgcatcagaacagagccttttcaacccatattattgtctttgtgaagcaaaacgtgctgctggaattaaaaacaagcaaaaggttgtattttttactgttcaaagaatgctaaaactttcaatgcataacaaccccagagaaacagggttgatggaatcagagaagttggaggacagacaccttaaatttaaaattgaatacttgtgaagagttgcaactcatagtctgcctttaaaatatagctgggcaaggaggtcttgtgtcaccctatatgatgatcacttcaaattggttttaaatttacaacaattatttgaataaaagccactatttccaaagccacccatttgcctaaaataatctctgaaagtaagttatttatatatatttatttataaactagcatttgtattaacccttacccaaatggttatccttacttgtatttaaaaccactaagtcagtgctttagaatagtctatgttaatctttacaaataattcatgttgcgctaattaatgattcatacatacttgagagagaatggattgatgtttacctgttcattatgcaaaaagtcttcacagaaaatatttccaaaattccaggaacattttaagtgtttttaattattttagaggtatctatgtatcttcacaaaagtaatattctaactataaatccctcataactaatcatttattcagaccctctaaggaccttcactaagaaccatttattatcctcaataatacataagaatcctattttaaatgatctcaaagttgactacaatttgtatttctcactaatttaaacaggcctctcctattcttgtcctcttcctacccctccctcaagcttcccatggtaatacatggctactaactggattgaaagcataaatgatatgaagcagagttttgagaatttgtaattcagaaaatatggcaaaatctaggaattctcatattttaatatcactattagttgatttgcttaaatgcaaaatattataataaagaaataaaaatataaaatttgtattttataagagcaatactaaaattacaatttaggatgcataatatgtatatatttaagcctatagatctcaatacaaatgcaactgaatgtagaaagtctacctttaatccagtttatgaggaaatgtcttaacgtcacctttctaggagaaagcaagagaccaatcatgagaaccatttagtccagcaatctctcaagatgccagtcgccagcttgatggagtgagcatttaattagcctagtaattccctcctattgttcccttctcaactctaattgaagagagaccttaatctcaaaggagaaatatttaacttttaaaaatgtcacagaaaggtggaaagtaactgttttgttaagtaaatagcatttactcacatgagaaaataacttttaaacaaatattttatgtttgtttcttaaggtctgtagtaaaacaaaaacaatttcaagcaaacaaacctgagagctcaatatcaacagattcttttgaaaaggaattatcaattgctgctgccataacaaaacacttaagactgggtaatttataaagagcagaagtttattccctcacagttctgggatctgggaagtccaagatcaagatactagcatctagtgagggtcctcttgccatgtactcacctgtcagaaggcagaagaacaagagagagtgggcctactcctgcaaaccctttttgtagtggcattaatccattcatgagggcaaagcctttatgacctaaactcctccccaaagtctccaccttccaacactgttgcattgagggttgtttccaacaatgaattttacaggacacatacagaccatagcagttattataaggacatatttcaagaataagctacattatcccagcaggagtgtctgaaatgcatgaagttaaggctaacaaagaacatctaaactaataggtaaatccaaagaaactccatgaaacaaggaagtctcatttgtgtggtgtaaaataaaagtctagatacggatcaaatcttggtcaaaaatagcatcaaatgtggctaaaggagtgatcaaagttaaaaacttcaaatgcctttagtatttctggaagtaaagacttcagttgtattaagtgaaatacacgtgttaaaattccgaggccatcatgctatgttacacagatggtcaccatccgctgtaaggtggctaaagggaaagaggtgagtagctggcttggggtagccacccaatagggctagccacccaataggtatatagccacattataccttacccctttactatgcctggcctgatctactgcagcaatgagctgttcactctttttgggctgggctcagtagttcacacctgtaatagcagcattttgggaagctgaggcgggagggtcacttgaagccaggagttcaagatcagcctggacagcaaagcaaaacccccatctccgtaaaaacatgaaaaataaagaattttaattatccaggcatggtgtacgccttcagtcccagctactcaggaggctgaagtgagaggatcacttaagttcaggagtttgaggctgccatgagctatgatcgcaccactgcactccatcctcggagacagcaagaccttatcttaaaaaataagttggttttttttttttaaaaaaaactaagttttattttattttttgaagttagaaagtatgcaacttgtctgtgggagacaaaaactctgagaaatatattaaacattggaaaggaagggagagtaggggtacattgttcagggttgcaaagtgaagttgagagtcttaaatagagggaggcctatgtactttcttaaaatcaaaccaacagcaaataggaacacaagcaatagattctggaagaattgtttgctatggagtaaatcatgtatttgtctattcaccaaatgctatatacctagatgcttctacaaggaagaacaaaaaaccatgttaatgaactcagacatttgaatagtgttgttgctgtccatagatgagagctttaatagtgttgttgctgtccatagatgagagcctaagcagttttcctaccagcaaagaataatgtaccttgagaaagatgtgtgaacatgtaagttcctattaatgcacatttatcacaaaaattaatctgagcataagcaatgggcaatgtgagtgttgaggatcgcttgaaatcaggagttcgagaccagcctgagtagcaaagcaagacccctacccccgccatctacacagaaaaaaaaattaatggtaactaaaacacaacgaaaatattgtcaatcagaaacaaataatacatgagaaagaaacgaagccataactaccaaaaccagaaatgtatgtctcagagaccagaaaacacttttgatccaaaattaaatatccaatattttcacacagttagaattcatcttatatttctagtctaatctatgcttgacgctttccattgctactgggtgacacggatcacttttctctaattttgttttcagttttgctatttcttatattgtgtatctgcctccatgagttttaaatggctaaattatttgcttagaattcaggtgtttttcttaacagattatttctagctgaagctgtttctgtcacatattgttgaattccaaatgcccccctaaaacataaccataaaagtaatttctttcctatcctcatcaacacttcagatagttaatagctgcgggcacatgttataaaagaagttgctgaagaagggaacttgaagtgaatttggcatagagtcatggatggtactaaacacatggatgaagttatttacttaaaatttttcttgtcggcctgatttggctatattttcaaaattgacacatactatgctgtagacttctattttcactagctgagaaacagaatgattacagacttttgcatgttatgcatttttaaatatcaccaagttaaacttagattttgattccgtgcccaggaccaagtggaaaaaaatctccatcttcaatagttcctattatcttttagtcacagggccacatactgtatttcttccatgagtaaaactcccacttggaattccaagcattgcataactagtggagtattcatatcatatataactcagtaggccttcatatcctaatcagctatttcatctgcacaatattcttcttagcagttaaaaatcttaaaatcatagttcagaatggagccaacatttaattcagccaacaaatatttattaaacacctacttctactactggtgttacaaccatgactactactttacatagttttgtattgctttaaattgtttttacaaacctcatctcatttactacagtgaaattacctactgctttgaaggagcttagagactcataaagtagattaaatcaattgtcagaaaaactgggctttaaagaacttgtctacgatggtaccggctactgtagtattttagatgattttggtgaactctcagttgattttaggtaaaagattcatctgcacaaatgtatatttatctttcattgtattttttattacaatctaatattttttaaaagctaagaaaatgcaatgaaaataacattttaaaaagtgtcagctatatgaatgatattctttaatgcatgtcacatttaaaatatgacctatttttaaagtacattgtatatgtcacaagccagatttggtcacaggccatggtttgctaatctctgtcctaaagcaatatggtagttctgaacgtttggctgaagaacatggatggcggtagaagtccctaaactggtcttcatagcttagaataacagaactgctgagtttgaaggaaaccgaacaacttatctcacttactctccaaacactgttcaatttctcttcatacttttttttacaatgtggtagtctctatatttatatttgattcaaaatataatgttttaaaacggcctgtactgatgtctcttcaaaatctttatcttgcttaatcttagaaactttcttgccaaggagtgtaggagtagacatgatagcaagggaaaggtaatagaataaattttgaaagctaaatgctttattttgatatagctaatattcatagaccttaacatttacattagtcagcaatcaaccaaaagtcatagtttcaaatacacgagggcagaatctgcctagctacacaggatttgaccacttaaaagttgagctctatgattattctgatgaagtggattggagaccatcacctttctcttagtaaatatttgtccttcacataccaatcgtaagtataattaagcattttttacttcatctggtgcttcaaattttgtatgatgcaggatttagttttctattctaattcctaaaagccatatttcaggctgcattctattaggggtgtctcacttaaaataagaatactattatgtagcttaacttgcatctatttcctttttattatggccactcaattgttcctgactttctttgggaatgatttgttaattttattccagtctcagctatgtgccttcacttaacaatgaacattgactactggatacttagcttaccttttttacaagatatatatttcaaggttttgttttcatataacataaaacagtaaggcattcattaatcactattaaattcattcttttcctctttattgaattctaaaggaaaatcagctagtcttttttttggcatgtgtcagcaaaagtatgttattatgaggtgttcttaaataatatatcttcataaaacaatataggtggaggtttaaggagaaataaggaaagaaattggaaccatctggatatccaaagtagagaaaagtttttactaatggttgtcatgtacacgttacaaaaataacattatacagctttctaactggacaggaaaaggcagaactatcaaaaagttgaaaaagaagatagccctggagtgaagcaattgacaaataaaatcatttataagacatgcatttagaagaaaagtggagattcatggttcttgggtcagtaaggattaaacatatctcagagatgacctgcttgttcctgggaatcgaaatacagttgcattccaaaaaggatggctccctgggaaatgcaaggaggggaggacaggagggaacagatttttgttgttgttgtttttgtttgtttgcttgttttcagggatgagtgggaaagcaccttctatgtacttgctcctaaatcagcctggtgaactgggaagagtagagattccatgaaagaaaagaatgtgaatacatgctttggagataagacagaaaatgggagaaaaagcaaagaaggaaagaaggaagggagggaggaagaaaagagagattctccagagacacactgcactccctcacatgtaaatgttatattaaagaagcaatatcactggaaattcacttcatcagatatttaagtattaatacataaattagaaatcaattttaggagtgttattcctccaatacaaacatttttttctggcttttcatctccttgtcatattcccagcaaataaccacacagacggggtgtgtgtctctccttaaatgagattagtgaaggtggcccgatcaattatttttaagcctgaccaaataggcgtactctaatcttgcctatttcagcataatgttgcccagcatgataaaatacttatttaaacaggtgtatcagtctcagagatctgtatgtatagtttaccttgaagtcaattgaaaacagaatattccttattgattttgcctgcctggctgctatatgtagtcaatgggactcacgtggatgtaaatagagtgaatcaactccttgctggccctggacctccttgagtcatgtgaagtaggtttctgattcctttatgttcaggcacagccagggagacaagagtactactgtcttctgctggtgcagagagttacctcaggctatgcaggaaaaatccttttttcttatttttagacctgaatcagtctatgccactaaatgtattcttgtgaatacagatgcactttgttgtcatgctcgtgggaaggcaatggagtaacctgtttggacgcagctgcaggccacctgtagagaaagtcaaattagggagagaccccactgttctttgcattaatgctttttgtattgttgtttgacttttccccctctgtcgatgtatctttttcaactagggagatcgggagcacattttaaggccttctgtccctttaaggcatctaatgattgaaaggactctaagatttgaaaggctgtaaaaactccccagttggcaatgaatgatggcaatacaaagaatcttaaagctgttgaagttgaagtagtcttcttacagatttagtttgtttggtgaacttccagcggcagctcttacaaggtactgttcaaatattcccacctatctgtgctgctgctccttctaaagatttatcatgttctcagtggaaaagtagttatccatattagcagttaactttactacagataagaaacaaaagaaattctaaaagaagaagaataaactcctcttcttcctttcctcatctaccaatgtgaagctctaaaaaagaagcccataaatgaaatatctactttagccataaatattaagggagggaaatgcacaaataaaacttgtttctggaaagcttgattttggctgaatatcaaaaaccatttcctgacaatgaaatccattagactacgaaataatctctcaaagtagtggttgcattgcttataagatttaacatttaaggttaggctgaagacagccacagatcctcaggctcaaatgcagaatgttatttcagaagttggagggacctactcttttgatcctagctgtttctcttgttttgggttcctttacttggaaattcaggttataatatagggttttatattaattttttggtgtcctccaccatggatccttgagagctgtttcagctgactgggatcgaatcacatgaaccagcctgactgtgtttgtgtgtgtgcactgttcttcacgcatctgaagcagaggagtcgtcacaattattctaaatgcagttagaggattctgtctgcctcagctttacaatgtttatcaagctcctgtattaactcagtaacacaacctgccattacaaaattcaaacttttgataaccagcatttcaccaatatgaatttatttatacaagatgccctttcagagaacatattatatctaggtagtgactgagaggttccctaatcaattcttcaagatgcagcttcagtaccttagtcctgaggaccatgactaaattcatttgatacatgtatgttatatattccactaaaatcaaagaagatatgatagaatttgttgcaactaaatagtggcactcagacaactttaattctcaaattcttggcacgcatcctgaaaactcgactctgcgctttctcctaaatgctctgctctcttttgctttattgtagtgaagaaaagagaaaagtaatgataataccgtgcatagcataatattttacagggtttttttgttttgttttgttttgtttttgtttttgttttttgagacagtctcactctgtcgctcaggctggagggcaatagagcaatctcagctcactgcaacctccacctcccaggttcaagtgattctcatgcctcagcctcctgagtagctaggattacagatatgcaccaccatgcctggctaagttttgtatttttagtagagacgggattttaccatgttggccaggtgggtcttgaactcctgctttggcctcccaaagtgctgggattacagatatgagccactgcacccagccatactttgcatttttacagcttgttttcacctatattttttgactaaatgctcacaacagcccagcaactgaggctgagattaagtgataagattcaggacttgaaggatggagctctgactctaagctctttgctctgtccacctcagcgccatagctgaattctcatatgaagaacatttttcatgtggtattctattctgctgggactgacacataattagcaccttaaactatatatccaggtaaagaattagtcctgtgtcagaaacaaggcatttccagaagcataaagtatagcacctcacaacaaggtagttggaacccagggtcaaaaacaagacagataccccaggggaaaaaaccatgtccctagctaatatccctagcaaatgatccctagctaatcatgatgccaaggtatgctgcctcaggaatcagattcgcggcatttaaagtaagaaatttttgacttccaatgtagggagacagaactgatgggccacagggagccaattgaaacctaccttaaaagcattcacctccaggcatggtggctcatgcctgtaatcccagcactttgggaggcagaggcaggcgaattgcctgagctcaggagttcgcgaacagcctggccaacacggtgaaaccctgtctctactaaaatacaaaaaaaaaaaaaaaaaaaaaaaaaaaattagccaggcatagcggcgtttgcctgtagttccagctacttgggaagctgaggcaggagaattgcttgaaactggcaggcaggggttgcagtgagcggagatggtgccactgcactccaacctgggcgccagagcaagactctgtctcaaaaaaaaaaaaaaaaaaaaaaaaaaaaaaaaaaagccatacatctgtctctttcgctacctgtgttttgaagttgaaatgattttatactacttttatccttggatgctttcttcatagcttaacacaggtattgtttaccaattaaaatgggaagctggtttaaatatcagcaatcatgctacaacagcacaattgaaggagtatttgactcaaagccttggctctcctattcacaaattttgagtggttatttcattgaacttccatttactatcttctaaaatgtggagaatatgaactaataacttttccccagattgttgtgattcttaagtgggatagcgaatgtgagtgctttgttatctgtaatgcactatatcaatattattgttatattttgcttcaatatatttattagcttgctaaaataacttcctaagttatctagctaatcgcctttttaacaccccagtctgatctctgcgtgcactcagctcatatcagagtagttaaaagtaaaatgggaaaacgtgagcaatgtataacaatccttatttcaaccactgtatatagacaactcctattttttgtcagctggtatatgagacatccacatgcaaccataaagcctgtgttgtaaagaagtttttaatgccagaaatcccatatggttttgatgtaactaaaaggtgtacactttcctcaaggtcaagtctaaaaattggaccactacaggctctgaccacatgtatgagaagccaaaggacctgtgatctcacctgcctcaatcatgtgccattatttactccacttgcctcttctgaatgggtatgatcccaaccaaacatagtgaaggggaaagttaaacaatatttggaaagccatgtatttggaaagccaatgtaaaaggtacattatattacatttgatataatgcaacagtaattataactatatatgcaattcgtatctacataagccatgatagtggaggatttcttgaaattactttcttttcccccagtgaaatgtcagttgtttttagttttaagttttgcaaaatttggaacctggttttcttacacactgtaaataattactgcagatacatttcagtcacgctgctctaacttgggagaagaatcagcaccaaaattctatgatgtttcaggtggggcagagtgtgagaagacaactcaaaaagaggctggagagtcttacttagcagaaacctcagctctcacttcttttatggctgtatttcataacacttatcttttgacttagaacatttgccaggaaaactttgattcttagggcaaataaccctgataatttagaacttagagatgtcttatgagtttgcaaacatcaatgcattatcaaaagccctgtgaattattagccatttaaataccagctacctatttttttctgattactgtttcattttaattgctcccatttcctgtcctgaccttaatgtttcagtgaaaagaaggccacccacgagagagagagagagagagagagagacagagagagagatctttcatttgtgaattgcaaagcttcagaggtccgaatttggccagtatgtttgctgcaaagccttggaatgctgttttgcagtttcaaaagtgatcatactcagcttcccagaattttttatgcctggaggatgccacaagaacaagggcagccttgttaacaagttccaatctctcaaaaacaagataggattcggatataaatcatcatttcagctcacaaagccatgttctccaccccactgaagggcttcatttacatctaaaatggttaatactgatctgcaccagaactcctaagtggaggaatgcagctgccatgtgcttagtgactctggggttagggaagaatgacatcaccaaatgtaagcatattatcatgctgacatagaggcaccttgttttctcctctgtggatagagcaaggattgtgttctgtctcttgtttttttccgctcgaagaatacctttccccctcccttcttagcagctgcaatatgaagggctgaaaatgtcacttcaactaatgatgaatgatgcttgacctctggatgggttactcagaattttatgcaattctaaattaatatgaaagatcccaactcaaaggacttcggccgttaagatttgcttcaaggatagatttgtgtaaagcagttagtagctttggggattttgttgctgttgttattgtacttggtgggggactgggagactcgtgctctgtaagcaaggtaaaaggcagaatgtgctaacatttttatgtgttatttttttcctgtgagattaatatctttttctactagaaatattgtcagtaagcagaaccagtttgtgaaaaaaacattctcaaaagggcacaggcccacacgtctttgttgtttttatttgaatataattaattatgtaaagcaatagttagtgtaagattaacaattagtagattctgtcaagtagtcacacggaaattactaactaattgaactactggtcgtctattgtgtcagaaagcagtactgagtgtcattctttttatctttttactttgttgttttcacagatcctcttgtttctaagatgtatgtttcacagccgactaataaataaataaccctggttgtaatttcataacatgcaaaaaggtttgaaataaaaacacctgttttaattagcattatggtttgttcactttaaaaaaagtgataatcctgatgcagttagctgacatttttaaagctttgaatttccatctgtatcttatattatgatgtttcaggattgtcatgagttaattatgttaacttgggaagcattgcttgcatttagaatgaaaaacttcagcttgaatagacagaaaagcagatgctatctttcttgtcaattgctttgttgtgggctgccttgcaagttttcatgtatttctggatctaaaaggaagtgtaaatctctatttattttaagtttaacataaactacacaatttcagtattcttctgttttggctgtatgtgtcttgtgtatctttacatgtgtagctttcctgcccccaaattcagaaatccacagtcaaattatctcttctttaattcttaatttgttttgttgtgcctaggcattatggagattagtacataataaaatttaagaataggacaactctactggctcaattctctctctagttatttttttctaccacctttttgcttttgtacatcaaccttttaaatggtacaaaatacatgcagcatctgggcacaacaaggcatgttaagaatggagtaggcactctaagtaggaatttccatgcttttgtgagtttaatgttcctttaacatagagagcagctgtgtttatgtcaataattacacattgggataaatgcgtgtacatgtttttctttatgggattaaggatgttaggtatggccttacacaaaagattcttgtccctcccatacccacccaaaaagtttctataaaattcaaaaccaagttacactgttctgagattctgaaatatttctctaggcatttgcacttctagatttcaactgacagaatatgggattgatgtgtttgtaatcttctctttgcccccccacctcatacccattctccactcttcactaccctgttcggtacccaggatctgtatgcactcgccttccaacaggcttccaactagattgggccaacgagaggcatctgcagcagaacagagggcaggagacaatgcaagaatgccaggactgtgaatgcttaatccctgaattggtgccatgagcaataaatgctcgtgctcaaaagaaagtgagatcaaggaaaagtggatcactctaggcagaacttctgggataaacaatcttcctttgggctttaaagaagtggtgggattgggccataggaggtgggtgggtatgatagcttaggtcaagaatgagcaagaaccacagtatggttcttgcttgggaatatcgagtatactagtataatgggcccagatgctcaggtctgaatgaggtcaaattttaagactgaatggcaggttgtggcctggaaaaagaggcctcgaatgatggaattagaaaacttagtgtttaaaatgtatggtgaaggtgtgttcagtatataaatccaatctgtaagtgatatggaaagtggaagtttattcaatgccttatcacatattcaaatgaacgtatggctgctctaccacttaaaaatagctctgttcattaaaggaaatgtaacctagattttcagaaaattaaaatacaatgttcttaagtcagtttaaactttaactgagattcatagtttggttctgccttcctaagcatttggactaaggcagagagtataaatctgatgggtcatcttcctgaccaatcgactttccattttgattgcaaacaatccacttgtttatttagatacaaccactgaaccaagtcatttagacacaaacattgaacaacaacccatgtgtttcattcctctcaactttaggtgtattttgcctcataaaatgtacggcattgtaattgttattaattagctacacatcaaagagcttgggttagcagtgggccatgatggcctgaatcacaaagtgtgacttgttcagtgtatttatttatttatttatttatttatttgagacagtctcactctgtcacccagggtacagtgcagtggtgtgatctcggctcactgcagcctctgcctcctggattcaagcaattctcctgtttcagcctcccgagtagctgggactacaggcacgcaccatcatgtccggctaatttttgtatttttagtagagacggggttttgccatgttgtccaggctggtctcgaactcctcacctcaagtgatccaaccaccttggcctcccaaagttctaggattacaggcgtgagccactgcacctggccttttacagtgtatgtaagactaacactactcctctagaaacaaggctgtataccgtaatggaatttaccttcccaaccaagctgatttgtttagatgctgatcattggaaataaattattaatccaggaactcatgttgtttgttagtttttttaatgtaatggtttgaagcaggctgcttatgagcctcgtgtaaaaatgattctgttattagttccagggcataaacttgaatgacactttttcccttcttgctctatatgttgctatacaactgttttcatcccttattgttttaggtggttttgcaaaataatttgtgagataaatcagggttggaatgttagccttgacactaacttcttgtatgaattcgagcaagttatttaatttctctggtccttagttcctcacttataaaatccgtgaatactaccttgctttgttactatgaaaatgacataagatcatgcagataaagtaccaagcacagcggctggcacatgacaggtgttaagttaatggtcttgtcgtctttgttgttacagttgttgttattattactcaactttcacttctatgctgataattttcaaatttgtctgtccagtctttatctctttaccaagctccatagtccaaagtccaaatatctacttagcatcaccaaacaaaagtgtcaatagcatcccccaaccaaactcattctcccaggcatctttttatcaaaaaacaaactgaacaaattaaaaatcctagctactctttctcaagtattacatgtaagataacttgcataactagctacaaacaatagttttctttggttcattccccctttaccacccctatgttcattaaatggatggcctcacatggccttttcgttgcatttctacaaatactatttagttctggccttcatggtatcttgctgggctgtttccagggtcttctaactaatttgcatattcctacttctcacctctcaaatgcattattctatttcctacagatttatcttcgtgaaatacagtctggatatttcctcatacaaacttttgacaattctttcacatctaacagagaccatttaatctattagcataacagttacacttttccctggcttccaagctaagttctcattacatttcatcattcacctttgcactggtcataatgaagcctcttgccaatatcaaattttgatccatttcatacctctttgctagaacagtggtcctcagagtttaacatgcatcaaaatcacctggaggacttgttaaatcatagactaattagtatttgtagaaatgcaatcacacagccagttgcatccaaaagcctctgtttcagttaaaactgaggtaggtcttgataattcaccttaaatgtcctgtgtgtgatgctgatatagctggttctgggacatccttcctcacccatctcagttcaacaaaatcctatgcacttctcactgccattgtgtgggagacgtttcatctgtcacctgtcagaatgaaccattccacacattgtgttcatgagataggaggcaggactcaaccacagaggcgaggctcagacaccaaaccaaaatgaggactagctaaagcagggacagggcagacctgggcaaagccaaaaggcatcccagtgaggcccgatttggagtttacctgtcctgtatcactagcagaatgattgaggttttaggtggagccagattgcctggactccgctactaaatacctgagtgaacctgaacaagttccttgatctctggagctgcttttccatcagtaaagttgaactaataacagtacatccagcatatgttgatgtgaggattaaatgaattcctgcatgtgaggcacttagaatagtgcctgagaagtgctcaactattattggttttctagtagtttatacctttactacaatgctcaatgacgcttaaagtttgtaggcctatctccttttgagatgtcagtttccttgaaagcagagaccacgttgttgtgaatccccagaaacatagccctgggcttagcactttatagaaatccagtaaataaaatttttaattaaatggagatcaaagaaagattgcaaaaggatcttaagtaagtaaaaatcttctaaacaataaacaaaccatccatttctttttccctcatcataaagatgaataaaaatgaggtcaattattaataatacattgaaagtaggtttgccttttcctttgaattttctaaactctataattaaaatgacttcaaattggaagattgttaagaagaaattaatcttattggtaagtaaaaaagcaaatcccatggttgatgatagatatgacctgttagcaatagtcacacttttatattttatttccttacaatcagcatgtggagaccaacataatccaattaactgtaattcccttttgtagcatccgtaaagtagtttatgatactaaaacaccattgaagtcttatctctggtcagataatccaaatggattctgatttgcaaactaccagcaggtctttataaacttcaggaaaatagaatattttgacttccctgaacctacaataaatgtgatacacaaaaattcgtctctgaactctaatcctttgtaaatgctagccatcagttttctagacttctttctctgcacctgtttcttattaactgacttcttttaaaagcatttttttccacagtgaatatccagtatttcaatacatcagagcctctcagctgagcttcttgctcattgtgtctttttggacacaccacccctcttctatacgcccactccaacccatcctacatgctactgccagagcatctttctagaatgttgctcccctgcttatggtcatccagactctttcagttgtaaggaccttcatgctgtaccttctgccttcttttctatcctcaacaccctgagatatggaatctatgcctctagggtctccgacaacttgtggcatcccaaatgcatcatgttcttcattccttggcgtgattgttacttctagttgaatttttcttcatctcttctcttcctctctcccagctcctgcaccaccctcactcacctgactgctcatcgtttaagatcattattatgtgacacctcatctggaaagccttctgactacacccagatgaagcttgatgctaatcttctatgttcccatagcagtctgcaagaagttatataataacatttaccgtacttgattacatttttttctatttgaccaaacttcctatatactatgaaatctttgagcatagaagctagatctttatttatcttatttttaccccagcagctataacatgcctagcacaaaatttgggttcaataaatatttgataagtgaatgaataacctacttatgtcttcagtatttgttaagtgttttgaaagagaatgataaacaaagagaatacaaaaataatgctgtgtgtgtatacatatatctattgtcatcatcgttggtattatattatgaaatagcctctgttatcaaaggaggttaaaatttgataggtggtacaaatatatgaatagctaataaaaatgagtgcatcagtcactggctaagcactggggatataaagaaaaataaaaacaaatttctttgagacagagatagaggagagaccctttgtttaaatcactatagttaaattaattaggcatgccccaggagtgatggggttctcaggctaggattagaaacatggtaagcaaagtttgaaatgaaacccaatgtagggaagagtcaagattaacagcatagatagctaggcatcacaaactatcggcagagaccgggaattggtgccacaggtttgtttaggccagaataattaagatgataatgttgttcagtagtttcaacaagaagttgttgcacagggacctagctattttaccttactttatgcaagtagttgtaaaatttatacatctcccaactcttattttgtgtacctttgtagagctttagtggtgattgtggtgaagaaaagtcctgtgatgcagaaaatttagtttactcccatgaatccaactaatcgagataacttaggttaaaaattatcattaataattactagaaatcatctcttcattttggttgtcttaattgacaactaacagatgtcttatctggggataacatagtttcaatgaatgagagtagcaatatcttaatctaccagttttgtttaccttttatttcaatttttctgaagaaatacttccagacagaaaattctaagttagcaaaaacccaaatccatatccttttcaatgttaccatttctaaccctacacatatcaccaacatagtaaggggaatgataaaagccagaaattatattacattctggaaatatttgccaaagtctgtctacattggatgcttttcatatattacatcacttaaatctcacacaaaattaagaactctcatttgacaagtgaagaaaccagaatgttaagtaacttctatatatgcatttttgcttacaatggacatattatctgtatatgggaatttataggacttagtttatttcctagatatcattaagagataggttttgacttggccctgtgcttcatatttgcaaacgtaatataacttggagggaacaatagcaatggtgttgaaatttaaagccactatgaagcaagctttcaaaaatgactttgtcgaaatttaatcctatgattctctcccctttggagtacgtaatgtatgaaatcatccatggaattccagcaaattcagaatctgtttggagaagatggttaaataaaaagaaccattgtgtacggtatctatagagtacaaaaagcctttgactgaatggaaataagaacagagttggaagctctgagtaagaaaggaattaaagaaatatatatgggtgccaggaaatacatcaatttttttttatgatcctcactgaaagaaaaaagtctgttcatttttgttgctgttgttgcatctaaacaggactaccttttctcagctacctaaacgaaatatctaaaagcctggagagcagcataatgtcactaacgtcattttataaggtagcattatgcatggagttatgatgatgggaagatgttttatgttatgccattataaattaaaaatgcacaaagcaatgacacatgtgttatactttccatctgtggcacctgcttcgcaagtttcagttgcacctattatgttattctttacattcaaatgaaatctgaggagaaataaaaataagacagtcttgctcctaactagcttcctgtactggatagagtagaagaccgttccacctccttccaagagagtaactaaagatatttcatatgagcctgtgacatgcgcatgctttggtcttctcaaataatttccaaagatatgcacaaaacctcaaagcacaccgaaagcaagctaacgtggcgtgccaaagtagcccattagatgttcagaaataaaagcttttaaagaaaagttttaaaatcttagaaagtttgtggttacttccttcctccctctgtcgtaattcaaggaggccacagaaaaccaggttttatagaccaggtggtaatagaaccatctattctacgcacaggtctgtctcctcttgccagaaaggaaccattttcaaacataggactcctaagagcttcctgggggttactgtgataaatcatatgaaacagatcttgttgattttgcatacaagttttcatatttaaaaccactttgctcctttctctttgataggtatcatgaccatagacagttgattggacttgagttgagtttttcctgaggaagtttccaatgttttctagtagtacttagagtctcaggtgatggcaaccatgcaatatttccactttagacatagtagttggacaaagaatgaatatgaaaacggcaatcatgattttattctttctctggagaccacactggagagtattctgcatgtttgtagagaaaatcatttgaaataggttaagcctgaataggcaggcaatttttcaactaattccagcttcaaatctgttctctgaatattggtaattatttttcttcaaatggaattacctaaagagctaactctgttgttcactgtgtttcacaagtgtagcatagcccttgtgttgagaagatgtataggtatgatccagaaatttgaccttgtctttctctgctcaaaaccttggggcattgtattagtttgcttgagctaccatactaaagtaccacagactgggtggtttaaacaccagaaatgtatttcctcacagttctaaaggctggaagtctgagattaaggtatcggtaagttgatttctcctaaggctccctccttggtgtataggcagtcaatttcctcctgtgtcttcacatggtctttcctctgtgtgcaccctaatctgttgttataaggacaccatacatattggatggggacccacatgacctcattttaccataattacctctttaaagatccaatctccaaacatagtcacactatgaaatattgggggttaagacttcaacgtttgattttgaggaatggaagaacacaattcagcacataacaggcacgatgcatatttttgggtgatatatttgttatttgagtttgtcctggcttgcccccaaggacaaaataatatgattctagggaagagtaacaggatgtaaaatgtccagaactttatattcactttctgagcacctgatgaagccctctcctttgaggaacataaagcagcctcaacagctgtagctttaaaaacacaaggcccagtatgtagtctccttccatctctgtttgtttgaaaacaattaagtgaacaaacaaattaactggccaactggtttagttttctcagataatatcctcaatgaagtctcatgttacagccaaggtgtggaaggaggagctttagccagtgcagcacagaaagatgctacttttggcacagggtgacatcaccgtgtttgagaatgcagaacctctctaatccaccagaaatcagaccaaaccatcactttcaggagccagcacagcaagaaaagttgagctagttgagtgattcaaccaacttacttttgatccattcctttaaatactaaactaaaaatcttctatatccttataaacagtgtcattttatccacattaatatctaatctttcaatttgattttagggccaaacatattatgttttggatcgatcatccctctggcatctcttccatttgggatgtgactttcatgtacccagcaggccttttagataagggatccaaatggtcatctgtgctggaagcagggacatcatcctttatgagagtttcatagtgtaacaagttcttttcactgtattaatgagatcagggctattctttctgtatcctgggaaagctagggtgtcttttcctctttttaaaattgcaacaataaaataaaagttggaaagaggttttaaaagtgctatgaaaactattacaaggtaaagaagcacttgtttttaacacatgaagaagattttctttcttgacttggttactcttctattctggatagtccaagtgcaagcatatttcaaaaaagactaggttaaaacaggttgagtctagttaaaattggacctgatatcacaactgctggttatatataccaatacctacaaagcaatatataatacaagaggaaaggggtaaactcctttttttttttcctttgagacggagtctcgctccgtcaccgaggcggatggggtgcagtggtgtgatcttggctgactgcaacctctacctcccaattctcctgcctcagcctcccgagtagctgggattacaggcatgccaccatgccgggctactttttgttatttttttttttaccatgttggccaggctggtctcaaactcctggcctcaggtgatctgcccacctcagcctcccaaagtgctggtattacaggcatgagtcactatacatggacagtaattaaactcttaatgatatttaaatgctccttgttccttggaaactaccattgacctactatggctatcaaaggttcatctttcagttctttttaagaaaaattattcctaatagctactgtcaaattttttctttcaaatataatttgtaaagcttgatataaataagtttttacttaaaagataccctaaaggctcttcaagaaagagcatttcagggtaaccttgtttgggtacaacatttaggttgtgtgtgtgtgtatgtgtgtgtgatctcataaaattcacatggtatttgcattgtggagcttaacctatctttaattctgtttataagctttaaggcaaaaccataaccaaaatggatttaagataacctaattagagggccaggagaaaccagcacagattgaaaggattgtgagacatcgtgattcaaccagacttcttcctaggattggactataacatgtgatatggtttggctgtgtccccacccagatgtcatgttgaattgtgttgaattgtaatccccaatgttgggggagggacctggtgggaggtgattggatcatgaagatggatatccctcttgctgtcctcgtgatagtaagttctcacaagatctggctgtttaaaagtgtatagcactttcctcttcactcctctctgctgctggccatgtgaagatgtgctggcttccccttcaccttctcccatgattggaagtttactgaggcctccccagttgttcttctatacagcctgcagaactgtgagccaattaaacctcttttctttgtaaattaaccaggcccaggtagttctttgtagcaatgtagtttttgttgatcccgttcaagaaactgcatcgtactgagataaatcctctaaaacaaccaggctggcttacaatgtttgttcagtgtttcagttgccttagtcccttttttattttatcattttggcctttactcacctgcctcattctggtgacatattggatatgtttgattccttatgctttaaaatgtttttcaggtacattttcccatttgataccaacaattatccttctatcttcattttacaaataaataaataaatagatatacaatgaattagtggtaaatccagtcctggagtgggtgtttcatatggtctttttcctactctatcatatttcctcttcactccattgctacctaacaatttgctccatctgtgcccgtttcctaatgcagttgcttcttattaccaatttgttttgtatctgtttatataagaatctgtgccttctacaagtctgtaattaccaaagatgagagtcagtttacaggtaaaagcatagcctcgagttagacatttaaggataaaatgtaaaaattacaatcttgacataatagtcaatcaactaccatttgcaattactgtttatttgccttttccctttctgcttctgccagccaagattaagtctgaacacagtgattttaaacatagtgggggcttactggctctttatcctggtttcatcacttggcagccatgggaaaattgtttaatctacctatgcctcactttccctatctgtaaaatggacatgatgataacaatagcatcttcctcattccttgctgaaagcattaaattagataatgaatgtagagtgcatagcacagtccctggtacagtgtaagctctaagtaattgttggttatcgctttcgttgcaaagtagcctgaatgagttcatatggattttgttctataaaaagttatgattttgtcaagaataattaccaactcaaggtcatattaaggaaatatcaatatgtgtgtatctaattttctagttccctgaccacctatggtagacttcgtaaatctttgttgagttacttctacagacacttatggacttcactatagtggctctcaaccaagaataattttgcaccatggggagatacgtggcaatctctagacacaatttttatcatccccactgggaaatgctactggcatctattagataaaggtcagggatactgctaaacatactagaatgtacaagacagcccccaccacaaagaattttccagccccaaatgtcaatagtgtggtgcttttgagaaactctactctattagaaaagggaaaagtataagacatcatcactgtgtagaatctagttagaaaatgcttatcaaataatgcaaatatatttgtaataatgcctgttaacaccagggtagggttatggttagttcatcttgaggactggttggcttcatgagaaggcatactatatggacataacttcatgtttagataaactacagtggccttgcaaaatttgccttaacatcacctggtttacaagggatcttaaccttggttgattatgaaaacttgatataaaaattagtattatatttcaaaatactctttccaactatttgccatattgcctatttaagctacttgccgaagggctacaaattattattatttctttaaatggaaactacatgggaatctatagtaggaatcttggtttaagggacacagttaatattatatggtattttaagtagatataatcaaatggtatctattcatgggtaaattttctttagatatcactatgttcgattttcatgttcacttgaattaactgatattaatgtggaaatgagtaatagtaatgctgttttcctttggttaagccattatttgttgctgctgctgttgtttccttgctcaagttaaaatcattctcttttttacctgctgaacactttcctttagcaatttcaaacttgtgcaccaaaacggcattttgtgttggacttttctgataaatttttggtagagatagttgtgtgtgtgtgtgtgtgtttgtgtgtgtgtgtgtttaggtttccacttaaagttcagtgccaaagctacagtacttatacattttctaaatgtgttttaagcaataagttgtacaacatttttagaacatgtgttaagctatttctctaagaatgaagctcttaacaaaacataagcactctgcatgagatcttagcagcaaagtgcttaaaagataaagtaagaattggtaccatgggaagaacaccagctgtagagcacacaggtccattatgagaagtatggtagtgggtagggagaaaatgatttaatcaggagtaaaaccaattttattataagggcacgcagggggtgtggcaccatagtgagagggacatttcaaaatatctgacagatttcaacaatgtgaaaaccccgttctttaaagtgacagtaaaccccatcaggtctccctttttgatgctattgttaacagttgactgtttaaagctggcctgctaagatgctgtcggcctatttcaatagtgtgtagccaaataaaagactaattgttgaaatacaatcaatcaaaaatgattgcagggcagaaagaaggtctcctctgctgattttgttgtgtatcacattattgtgttatgattgaggtaggaatgaagactgaaagggaagattagcccgtctgaaataaacagattcaccttcatgtcttctctttgcaaacacactgttgagcaggaacaccacttactataagccttagaaacgatcgttcatttatttaaaaaaaaaaaaaaaaaaaaaaaaaagaactgctgaagatttgggctaatgtttttaaaaggacgtgaacattattagcaaaacagcccatgcagagaatccctacagtgacaattctcagcttttcttacattttggtgcaaaatgctcctctggattcataaaactgacatccaagggacatgtgaatgcgagcccaagacatcagtaaagaaacaaattttcagttgaccaaatacctcggcgcttgccagtattctcagcttttcagttaacccccagattgtctaaaatgattagtttaaggtttcatgaagccccgaatccaaaaccttttccatgttgcacgtttagaaagacaaatcgtctggctcgacagcagtgcctttgtacctcgcttccttttaattttatgtcaagatgtccctttcagacgtgaatgcatccacttcttgggtgagactaattccagacattcatattgagggtgaaaaggacaaaaataattgcccagcgcactttatttctattaaaaccttcattttgggatttactttctttagtatttcaacatctccactcactcaagcttcccaagcaaatatttctgttgtttctaaaaagagttggtaagcacttgtggtttgtctttagtgtgttatcatttttgacagctttgcatagcctacgtaggccaacaggggtctgtctaatattgttgctgggcatattttcctcactgagatgagaactaaaaaaaaaagattttgaagcagtaagaaaagaattaatatcctttctcactcagtattctcttccttgctgactttatattcaggcaaaaaaagggaaaaagtgttacccattattcccttgtacatagcaaggctaacacatgtaaagcaataactcattttctattgccatgtttagcatatgtctcctgttggctcagcaaggcctttaggccggtcccttgagccggccatcattggcaactcttagcccctcggcctcaaaaccaaatagctttgaatcatgttgagctgtgatgctaattttcatactgatgcattatgggaataaacgtatctgacatactgtgtcaatggcactgtctctttgtgtctcttgtttttttgttagctgcattcctacagatggtattccattgaaaatgttcccttcctacggaaagagggaggaaaaaaaaatgcacagcaccaaacctctaggtgcagaaggctgttaacggttgctgatgatagtaggcaaacattaacataataattagtgtcttgtaattgtttcattaaaaccagttgttccatttctcctcgtgttttcccagaagagaagctgaatttggacgacagccagtgggaggacatccacgttgtcaccggagcactgaagatgtttttccgggagctgcctgagccgctcttcccttacagtttctttgagcagtttgtggaagcgatcagtaagtacctcacagaaaagggcaggtggtagaataacctgacatcctggaattattaagtaaataataagaatgattataataataatcatggggaacagatagtatccccgatgctccatatcttacgttttcgtttttgtgttttgatggcttgttttatttctggccctgcagtattatctgaggtttgtttgtttttaattaggaaaaaaaatatgacatcctatttagggtagccaatttaactaagtatcctcaaatgaaaatagtgtctcatcaaatctgctttaaagggttcactgtgtgcacccctcatctctgcctttatactttcagaattgcaatgagtttgaatacaaagcggtctcgaaaaggatcctaagtgaattaaatattacatttcatgaaatatgtgttaaattatcaactaagacatcatgttctcttggttcactcacccttcacccaccaacactagtaaacagtcagccataatttgcttatgagcagcgtgattatcaaatgaagtaatggcaagtttcttctgttaaactggtgactttataagagagtgagttatatctactactaaccagtagtcattgtacactccatgaagcttccttttctgttttttttttaattcataaaacacacacacacacttaagtaaaagtgaataaatgaatgaatgaatcaatgaaaatcttttccaaatggaagggtacttctgctattaatccttggagaagcaactactggtacgtctctaaatttaatatcttagggtatgcttactgtaactgtgacagcttggaaaaagtttcctggcaagccagctgatttaaggaagaaaaagaaagaagaaagaaaggtaaaattaaaaaccttgcaagcctggcaggagcttaattaaaatcctaacgagacaaatctccaagaaaaaaaaaactgctgtattcaggaggtctgatcttggatggctgggtatgaagtgttcccattagcacaagtggagatttgggggtcctgtgttggaaaacagcccctcaacatgccctctaattctgtcattcacaaagccttcacccttgtttaaagctctggcaaaacggtatcaagaaaaagaagaaatttctctcccaaggtctttctcttgttgcttgctcacaatttcagattttgttgttgctattgctgctgctgctgctgctgctgctgttgttgaatgcagtaacaatactctaaagatgggttttgagttgaggctggaactcttatcccttgtcgtgacttcatctcatgacccctctacttcttcagaacagcaatgtttcatagttcagcatgctttcctaacttcatttgaaaagaagaaataaaaaataaacaagcaggcatttccataacagctttttctgatattctgtcttggaacacccaagcaacttacaatgttggaacagcgttctggtaggaaattggagggactttgcatttggatgcctatttctgattgtgtacatttaaagaagtcatataaatttcacatcatcatctccacacattcaagtgaggatgatctcatttggaaatatacttcggtatgtgctatttgggggctataactaggatatccatcatttaagcttcctttagttcacctgattctaaagatgttaggaaagtcattttcttagcttgagagatatggaaagcaggccctccgaatccacatgagagtatgtcttttgaatttctctaaggagtaggatcatctcagggatattctagacttaagtccaaattttatagaatttcagaaatataggcatggtaagaacggaacatggcagagttgaggcagcagactattgggattgatggctcttgcaagggtttctgccaacacctataaaatgggttatggcgagaatgaataagaaagtgcctaagaaagtctttcaaaaatgtaagagggtgcacaaacagtgctaaaagtgtttctccatatgagctttgtttgataatgtaatttggaagagaagagagaggagacttcgtccttcattgttcaaggcaacaagaatcaaactcagggttattgtgtcaggacgtggttcctgccggtgggttcgtggtcttgctgacttcaagaatggagccgtagaccttctaggtgagtgttacagctctttaagatggcacagacccaaagagtgagtggtagcaaggtttattgtgaagagcgaaaggacaaagcttccacagcatggaaggggaccccagcgggttacccctgctggctggggtggccagcttttattcccttatttgtcccctcccatgttctgtttctgtcctatcagaatgcccttttttcaatcctccccgcgattggctacttttagaatcctgctgattggtgcattttacagagcactggttggtgcatttacaatccccctgctagctacagagcgctgattggtgcgtttttacaatcctcttgtaagacagaaaagttctccaagtccccgctcgacccaggaattccagctggcttcacctgtcattatgatctgaaagtttgtttcccatcaaaatgtatatgttgaagttctcacccccaaggtcatggtattaagagatgggggggctttagatggagattaggtcattagggcagagccctcatgagtgggattagtggccttgtaaaagaagcccaagagaaacctgtatcttcttccaccatgtaatggcacaactagaagttgccatctattagccagagagtgggccctcaccaatacattaaatgggctgtcaacttggtctcatacttccaagactccagaacagtgagaaggaaatttctgttgtttatgaattgctaaatttatggcattttttatagtaggccaaatggactaagacactcagcagccttgcttcaactcaaaacagaatagtagaatgtcattattttttaatatgtaaaacagagggatcaaccaacagggtaatggggctgagacatatgatattggacagagacgtacatttactaacccacgtatttttgatataaccttgaagctagtccttgtgttctaaacctaggaaaaactctaggttgtaattcatatttaaatattcttaagcaatgagagaatggccacctagatccttggcaatggtaaaaaccacaccagaggaaatactttctctccatgtgtaccaattgtactaaaaagtctttcaaaattttaagaacatttataccccgtcacagggctttatcatagcttacatagcctcttgtaaaaatctatgcagtgagaaactcaacagatccactcgcgagttttcggctttatatggaaagggaccaaccaggtaaagtaaattcacaggacaggatgaattgaggacaaagaggctgggtctgggcctctttgtcctcagatcctagttcttcccttttattctctgtaccataggagggttggtcctagccagctatattttgcagatgctgtttttgtggggttttttttcgacttttattttagattaagaaggtacatgtgtaggtttgttacctgggtatactgcgtgatgctgaggtttgaggtacaaataatgccatcacccaggtatagagcatactacccaacagtttttcaactcttgctcacctccctccctctcccatctagttgtccccagtgtctattgttgccatctttatgtccatgtgtacccagtgttcagctcccacttataagaaagaacatggggtatttggttttctgtctctgcattaatttgcttaggataatggcctccagctgtatccatgttgctccagaggacatgatttcattcttttttatggctgtgtagtattctgtgtgtatgtaccacattttctttatccagtccaccatcactgggcacctaggttgattccatatctttgctatcgtgaatagtgttgcgatgaacatgcaagtacttgtgtctttttggtagaaagatttgtttccttttggatgtatacccagtaatgggattgctgggcccaatggtagctcagttttaagttaagttatttgagaaatctccaaacttacatgtgctcttgagatgctgttgcacccggtcaaagccactggaaggagatggtagaaagagagagaagacaaaggccagcagtttatgagtttatccccaacccgttcacccttgccacccatctgcctcaggtagcttttcagcctgaggctccttctcctctacagcttcagctttgaccagacagggcccatctggtttcagctcccatctggtgacacagactctcctttctttgcttttccagcctggagaaggtagtggcttcctgatgtgtctactttcttggttactccactcttccttatctggttctcagcttcttctttatatgggtaaccaattgtctgcatcaaattaattccctttgttggtgtaaatacttaaaatggtttctgttttttgcttacacacaagtaaaacatcatgtcagttgatgtcatggtacatgttgtcataacattatttcccttttctcttttattacccccaagcccagtttgtggagagttaacatttttatttggccccagattgggagatctgttactctttcatggaagagttaaaaggtggttagaccaaacagaattttgcatccaactggaatactttgcatctgaggagaaaatgctatttctagtacaagcaattaatgaccactggagcggtctgaattactttaatttttattatatgtttgaaagttatcacatagtccaagaagagtgaacagaaggcatttactttttaaaataacttctttttggaccaaaaaaaaaaaaaccccattaatatcataagaccctgcaattgccatagtaatcccttgtctgataatactcattggggtaacaaaaacactagggattgttttatatctcagaatccaagtacagcaactattgatctgaaattctatacttgagatcaatccaactgggtcacctgcaggttatttcatggggatttaacccactgactgcaaagatttaattccctggaaatgacttgtactgaaggcattattagtactgtaaatgtgaactcagtagaaaagcacagccagggagttttatgataggtgatgcaatcttgtggctagaggcctgcaggggtccagacatttccagtagatctaaatcctaggaaatgtactaactttaccactgttcccatctttttcttctggtaactctacagatccaaagaaaaaagacaacaagcaatgttttttctgttttaatgtctgcatttttccaaagttcctgaaaaagagaaagggaggagaaaaactcattggcatttctaataattgtctcatgtaattctcaaaataagaaagcaggagatattggagaaatggaaagatcatctgcacaataatttctagctcataaagtagttactatgagaatgagaatagaacaggattttcttactccatgttaggcacttagtaagctatttaaaaagaaattagtttttagagaagttataaatgcacatagctcaaaaaactagacttggcattcaaatacaaatataaatactttgtatcattgtatattgccttgagcaatagctattgccaagtatctgtattttatatcatcctacagaagacccatatgtcctatgtcatcttatataagactacaagcattttttctacattttaaaagctgagtttagaattaaattaatggtcagaaatttcagtattggagttttaggttagaaataaagtagaactttccaagagtgagtgagatttcaatgtttagtactagatattaaaagcattcatgccttaaatgttgacttctctgggtacattttaaccctgcactctgatttctatgatcaattgctcaatatctccttttgaaatttatttatatgtacacaatgttacttttctatttcatatgagtattttaattgtattaagattcttatttataattatttacttgatcaaattacaatattcaacaaacaaaatcttacagaagaagttaggatgaaaagcaatggattgggccctatcacatcatatcccctgacctactcgtgagaggaaacctcatttagtgattttaatttttatctcttctggttactttcataactctagataatatctctacttttgatttatcaactatggataatatctgttacctaatattgtttcattctactccacttcttttagtatgtggtagccatatattataattgcaagctaaataatatgcctaaacctcgttttcttgtttcatcaacattcaacaatatctgctaactcttccattcataaggtgagcatatactccttcccaccctttccttaatctttctatagtttatttttaatttttaataattgaggatttttttctagttctactgaggtataattggcatacaatgaactgcatgttttaaaagcttaactttgataagttttgacaaatgtttgcaccacaaccaggaaaaagaacatctctgttattcccaaaagtttcctcttaatccttgacaattctctttccttcccctttccacctgctctgcactcccatcccaagccaccactgatctgcttcctgtcactatcgatacatttacattttctagaattttatataaatggaatcatacagtatgcactcttttgggggagaggctttttttcattcaacataattattttgagatttatccatgttatattagttcatttttcattaatgagtaatatttcattatttgaagataacacaatttgttcagttgtttatggatatttgggttgtttctagtctttgattgttacaaatgaagcatttacaaatctgtgaacatttatatacaaatttttgtgtggacaaatgcttttagtcttcctggtgatacttagaagtggagagctggttcatatggtaggtatatatgaactttttaagaaattgctaagctgttttccaaagtcattgagccatttttcaattcccgtcaacagtatatgagagttccagtttccccacatcctcagcaacacttggtgtggtcagtgtttttaattttagccattctatgtgtgaagtggtattttgtggtttaatttgcatttcactaaagattaatgatgttaagcatcttttcatgtgcttattggccattccattattttctgcagttaagaaacctactttttcaaaaaaattggctatttctttgctattgagtttcaagagttccctatatattcttaatgttagttctttatcaaatatataacttgccaatattttcacccattctatggctttgttttccttcttttaacagtgttttcagaagagcagacatttttaattttgataaagtccagtttatccattttgtcttttatggatcttgctgtgccttcacgtggactaatactattttcttcaacatctgttctgttgttagtctcagccagtgaattttttttaatcttaggcattgcagttattatttttagaagtttgcatttttaaatatattctgccttaaggtgtctaatttttctctagctgttttagcttttattattttaaatgatgcataattgtacatatttatggggtagaatatgatggtttgatacatgtatacagtgtgtaacaatcaaatcagggtatgtgagctggcagttgttgatttgttgaagtttccaaagttgccttttgtgtacaaaaataacttttcctcccactcctgggcaatgttccatacattttccattattagaatgcaatcaatgctaactccgtgatcaaaaacaattttatgattccaatgccatcacttttggtgtttttttctggcttgactaatagtaatatataaaaccatatgaacatatatattgtgttcatatatatatacatatgaatgtatgtatgcataggacacagagattaggcaagtcggtgctaaattgagatagtaatgatgttacatacaagtcttcaatttaaaggctacaatcacacatgcctttgaagagtgtttttttaaatgcctggttttttttaaatgattaattaaggagtaaaacaagttgtgagaaatggcatccataagatcaactgagcaccattaaaatgcagactattagccaccaaaagtagagattatcctgtgcctaaacggaactcatatccctgtctatacatcagtcacatcctcatcagataaaaataatacattgccctatggcaaaaagtacctattgcatgttctaatggtttttccccccatggcctttattccattttgcctttagagtatactctcaataggtaattgtggggggaaaagccagtcaagtatatttgcaaatattttctttactcttgactttatcttgccctttggtcaaactatttctgatgcatcatcaactccatgatgacactctttaggagaaaagaaacagagcttgcaaggcacttgactaaaaacggttgctaaacatgaaagcatgatagtgacaaattgccttaaaaccagagaaagagcagggtgtaaaggttcatcacaaagaaagcagagatgtaaaaataatgcagtataaaaatatcctctattgcagcatttcaaggaaatttgaaattgaaacaaaggtaaattttacaaagcctgtttttttagtttccactgcaagctaacattctcacagacttggtatttttgttgtggttgctttttaatgtgtgtgtgtgtgcacgtgtgcacgcaaactggaaagtttatggctaatgcctagcctgtctcttaactcattctaattatattcataatgaaattgaagaaaaatacttgactagagccaaatggcttgcacaggtgtctttttgtaagaatggtttagtgctagatgataaacaactggacctccatctccttaatttggcttaatgaaaagccctttataagtaaaactagaaggtgattcagaattaaaattgggccttgactcagaaattaattgagtggtaagacatcagctccattagaaaatgtggtgcttgtctttttgcctttcctgaaaacttttattttacttgcactcctttcttccatctacgtaaggtcactttttcaaagcaataaactcttcaagctgagcaaccagccaggcagccttcatgagtcagcttccctagcatccttacttctactgaatagacctgcttttaaaaaatagataacaaaacgcaaaatttctcctcaaaacttggtggaaagcaattatcttcacctattcttctaatagtggaattgagtggttggttttcactgcatcaatagattgtaataaaactgaaggttgggaggccttctatcctacactgaggcttctgcctaatttcttatgctttgcttgacaccacattgtgatcaccactgatgagtcctctaaaatatctgcccacttacccccaactctgactcaggccatctctaggagaatggtctctcctatttcccatattcatttttttctctacccaacccagcatgattctagttctaaaatacacgcaaactgatatatctggcttgcatttcattttgagaaaaatccttccaaggtcttcaaagtcctttatgatctggtcacccacaaggtctccaacttcatcatttactgttccctgccttgcccattgcattccagcccattggtaccctggctcttctttgaataccccaagcacattgaaagtctttgactgctccatctgtctaccgaacacactctcccagattgctactccactgtcaagtcctcagggaagtctctcatcagctaagctaaagtttctacccgcaccgcacaccaccacctgtattcaaatcctgtctccaccatttactatctagacctagagcaaatatttaatctctctaggcctccatttccacatttataaaatggagggaaaagttgtatcttcaccatggcaattgtaaaaagaatttcatgaaatgcacttatttacagaatccctggcacacagtatcaagttcactggtattatcatattagaatataatcagagtgtcctttagttaacagtctcagagctttagttaacagtctcagaggaccttgctgtccattctaactaatctttccacttctctggaaaagccatttcaaattattgtcttaaagcggccatcttcattctgctttaatattttgctttgagaatttcacacagcaccaaacatgtttcatatgacaggatattctcttgcttcgtgacccagggatcccatttccttcatctcatgacatttctcctttgttctgccagatgttctcaagcccaaccccacttggataatccaaagcctaccactttattatagaacttacgcctttatcataacccaaatgctatccagcttctccgacctgagcttgccttgcttctatgaaatattagcaaatctgtgatgttcacggtggcaccagaagagccaactccaaagtgataccttctctcagttgggaaatttgtaacactgtagatcccaaaatgttatcagttgaacacagggacagacagacacacacacacacgttctccaaactggaaatgtttcactttttctttcagttgccacacaatactctagctttgaaaggtagactttttattttttaattatctcaagagaactttcatattaacctctcaggagctttttttttttttttttttttttttttttcaaattttttgtaaagacagggtctcactatgttgcccaggctggtctcgaactcccggactcaagcaattctcctgcctcagcccccgaaagtgctgagactacaatcccaagtcaccatgcccagcctcgtgctattttcaaagcctgttatggaataagaatggatcctttacccagtactcttgtttgcctacattcagtcagacattctcatttgctcaagcacttgtcctttctccagccctcctctgtcaatacaagaattttccttaaatagcttctaggactatcataagcaccttgaattgtggcttttcttgatctggctcattcctactgctctgcagagttaaacattagatgtgatggctcctggagtactataaatttcctgggggcattctgctcatgttggaacagtggaatatccacactgagaattgtcatgtggtttagagaatggaatttttccctaaggataggctcatacattttctacctacactttctgaacagaaacatggaaaatgaatacactattatagaaaataagtagtggtgctggtttaagagtaaaagtaatatgtttggaaggatgacagcagatatatatatatattttaatctatgaactataaaaaaattatattggataattatgagtgttttcttttcattggcttatttatagttttctatttaaatgtgaagttcctcccacttccaaccatttaattacatataacacctttatttttcagaaattggaattctaaaagatcaaatacctaaagcctgagtccatgattactgtctagccagacagttagttcttggcccctttcctttttcttctcaccttgagtgtccagcaggtgaaaggttgaccctttcccatttccagcccattcctctgccaagtaacggatgggcagatctaattagtaccatctgtcccgctagttgcaggtggttactgtcttacaaagagatgaaagcaacaatcttttaagcttttcttccaggtccctaactctaggcacaatggtaacattattctttgacaccttgtgtgtattattctctgaatatctaattggcatctaagaagaaaccattacctcattgaaatattctttggaaatttctatgtgcttgtgtcatgttatgaaaatgttttagaaaaagtcgtcaggaaaagaagaatgatcctgaacaaatattagacccagaaaggcttcagaagctcctgtctgtaagcttggatttgtgatgctcagagcttctgcgagctgggccccctccgtgttaactgagcagaaatctccaccaaggagaaagacaagccagagcacaactagaaaaaccactttggtcaatgtcagatttccagcaggatctttttctaacagccccttaaatatttttaaaacacttaaagtgtaacccgtagagcctgttcagtgctctcctttcttcctctgcactttcaataatttatcatgaatcaaagtttccagacccttcatcaccaagatcacactccctcaaatgtgccctcctaaggtttggaaattgtctcagtcagatcaggaagctatagcaaaataccagagagtgtgtggcttaaataatggaaatttatttctcacagttctggagcctggaagtccaagatgagggcaccagcatggtcagttcctggtgagggcccttaccctggcttgcagatggccaccttctcattgtgtactcaaacacaagatcattgtgtcctcaaatacaagaaggagtgggctctgatctttccctctttctgtaagggcactaatcctaccaggagagccccaccctcatgaccctatctaaactttgttgccccccccaaagacccttctccaaataccatcacattgagggttagggcttcaatgtattaatttttgggacacattcagtgaataagagaaatcatacttcagtggaccgttttatttgcacaactttatcagtgcagaataaagcttcctcctatattctcacaatatcttcctcttactatgataaaatatttgattttttccttattaatattatactattgggatccaaaattgaatttagagtccaagttctcacttttaccattttctctctcagataagtttgtacaagtttaaatttccatgctgaaatgtgcacaccatcttgtaccatggtacaagagaattttgctttaagttttgcatattcaaaagacttatgtcacctgagtctcataacaacaggagctgggaccaaaacccaagtttttaactacaaattcattgtgccttcctcctagtattgtgatatttacaaacctgagcagtttgtcttccaagtccatatttacgtcctcaaatacattcaaaaccatataagacaaattgcaaggccatttaaaacaatggagcagttagagataaaaatttacaacatttggggaggaaattcaaatattgtgccaaaaaaaaaaaactcatccgacaaagggctaatatccagaatctacaatgaactcaaacaaatctacatgaaaaaaacaaacaaccccatcaaaaagtgggcgaaggacatgaacagacacttctcaaaagaagacatttaggcagccaaaaaacacatgaaaaaatgctcaccatcactggccatcagagaaatgcaaatctaaaccgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccataaaaaatgatgagttcatgtggtttgtagggacatggatgaaattggaaatcatcattctcagtaaactatctcaagaacaaaaaaccaaacaccgcatattctcactcataggtgggaattgaacaatgagatcacatggacacaggaaggggaatatcacactctggggactgtggtggggtggggggaggggggagggatagcattgggaggtatacctaatgctagatgacgagttagtgggtgcagcgcaccagcatggcacatgtatacatatgtaactaacctgcacaatgtgcacatgtaccctaaaacttaaagtataataataaaaaataaataaataaaagaaaaaaaaatattaaaaaaaaaaaaaaactcagagaagagacattccaaatttacaaagtgaagttctctagacatttggacaacatttagaaagaatttgaatcactaatactataaactattagactagtgggaatttaaataaaccccataactgtccatatgattacaattctaatttctagtatacttaccatacttttacttacatatagccaattgctatgtgtacatttcactatttaagtttatttttataatactcctttgtggttactattattcttcctattgtttccatttgggaaatttagactaatcaatattaagtagccttcctaaggctaccagctgggaatttgcagagctagaattcgaacccataactggaagattccaaagctgttactcttaaccacacaactgtagtttttgactaatttgaaaaaaaatgattacaagtgtctatttagaaatgagataattagtagattcagatgtagttcagataaagactttatgttgttaaaaactacaatgggaggaaaccaaacaggacacaaatgaattttctctgctcatacacgtactcaaaacctcattgtttacttaagacttccatcttgactattcaatttaaaacaaattcaacatttttaattgctttctgtatccaaggcaacattacaggtactcattcttgtgcctgggtcactggaaaaatttttaaaagtaaaataagcaccagtgaaattcaaacacacctagcagatggagaaggctaaaggatatgtaaatttatttgtaacaaacatttaatttatcttttaggaatgttagctaagagcacctattctgtgcaaaatgcatcactagaagaaaacaacaacaatcaagctcccatattccaaatgcttaaaggtagaaagaaggcactatgtccttattacaatccccggcaagtgaattaggaaataacattataaaatttcttagaactttcatcatatgtgttatttaattaaaaggtgaaactgcagcaaagtgtcacttcatccctcatgtcatgtgccagaaaagtattttcatggagtctataaattcattatttcaaccctccatacccataataaaaagagctcaattataattaaaatactatgtctactcacattcagtggtattccactttttaaaaaatgtttaacgtctttgttaaaacacagcaaacttacagaataagaccacagatcttaatagtattgtaagagtatttttagttgggacattttaaaataaaatttgtttcccaggcttgtatgtttgtgactcctttttctggcaattaattgtaaattttctctactgagttaaatacacaaaactgggtataaattgtctcttgtctaggtacagaccaacgaaaatatcgttttatgtctgtttatctgacataaacttctctggagtaggagacatttcttactgatctttgtagttccggcactaaatgaatttttaaaacaatgtgctttgtggtggttgtttcaagtaattcctcctagaacaatccatagtagttaggagcaatgatctcaaactactgaaatggggaatcagaaggaagagggtggcgagaaggtgaatggcagagatggaaacaatgcttaattcaatccattttgttgacagtaaattcaagaattaactgtttacatctctccaaatgttcctatctgccttctgagctctgttatacagctactaccagaggactaggtggactctagtattcacattttctacatgtcgaagaagtattattactacttagtttccagaaatttcatctcagtggcttaaaagtttatgagagaaaaagggaaaaattaaatgagcaaatcaagtcttttgaccaggctaatgaattttgcagtcttcaaagggttacctgaacttctgctagtacaacttgccagccttaaatgcagagagcaatggtggagagaacagtaaaactgtactataaaaataaattactgtcatgaatattaagcaacaagaatataataaacatgactgtttgcatgattctgatttattggtactgatatgcttataaattatgacactaagtgtttattctagttgtttcagaatatgggccaaacaaagctgggtggacacttcctgcagacctgaccatctgccaccaaattcctacttcatcgctcttgtcattgcgtttcttatgtcagtggcatcagggccatgtatgaacaaccattcccttttagttcactttgcagactgaagtaggttgcctttccaggacctggtgtgacaaccatcatcatgaagtttgtgatgtcttgcagtggaacaactgcagctgcaaagcatcctgaaggctgttccaacttacgctgttaaacagtactcacttttgacataagagggtccattactgtatttatgaacctcttggcaccagattggggatttcccaatgcgaagcagcactgcattttgcatacttgcttagcggtgggggctccataaaactggtgctgagaagttaaagacctaaaaacaaacaaacaacaacaaaaaaaaaacaaactgtgtattcatatagagtatttcaactgccataagataactacacaaatagcactgttgttctttctaatatccacaagtaaaagttattaagatttgctatcggtttttacattatttggaaccagatatttgttcaacagatggctagaataaggtatcacatgagaaaatagcattctcctgcttcaggtttttagctttcatgttacatctcatcaaaagttacttcaggagattaattattttaaaattttcttttctctaatgttggtggaaacctgcaaggaagacagccagtaaatttacagtaagcttaatgaaagatgcaattttcacacagtaaagtatgctataagggtataagttggtgctgcctgtaaagaactatttatgatataaacttagctgtagatgaaatgccaaagttcatgatgagacaaggcctgttactgctttgaatcagaactcttagaaaatttgtagaaggacttttggctatatttagcaaaagcctttaaaatgtgcatgcattgtactgacagttatatatctagaaatttaccttaggacattttcagagatatgcaccaggatgtatacaaacttgcccctcaaaacgttacttataatactgaaaaatgtagaagtatgtgtacaaacttaaggaaggttagataatggcccatttatattatgaaatactaagcaattggtaaattgtgatatagaaagcattatttcacaaggtaaaacaccagtaaatattaagagaatataagtatgatatggcatgtatagtataagcctattgtaaaatatgtttgtaaatatttatatgtagagaaaagaatgaaaggatttacttcaaaatattagcagggaatgattatacaggtttttttctcttttttgttttcctgtgttctgcaagtttctgcactaagtatatttgtagtgatttttttttatgtataagaagagggtgagtagataatgttgggggggatttcagaatcagttgtttgaaggcttctcaaacctggctttttgatccaactcacctttgtggaaacagattcctggacccacccaggtagatgttgattcattatgcctagggtaagtttccaaaatgttttctaaaaaaaatcatgaggaaaccctcaggtgatcctggcggcagtcacatttgggaaccattgattttggttctttttccttggtgaagccaaataagaggagagcagctcttcctactcgtagtatgttgacatcacagcaccttgtccaagccatgctatatgctcctcaaggagagtactgaagaagtaagaggtacattccctgaactagagaagaacatgtgagcacatgtgatctagcagcacaatgaatgatgaagacaataaatgttctacagaagggagagacaaaaatgcagtgtttgggaggccttcatgaaggaggcattaagagtatatggagtttggagagccagccagggaatgttggctccagccaagcactgactccagccctgagaccaggctgctgttttgtggaaagtgaggaattggggttgaaggcagcaatgattttggagacagcagtaggaaacaaaggagagcagatacagttaatccagtattgtgaatccctgaaagcaaagcagtaatttcttatcctcctgcctatcacagaactttccacagaaaagggactcagtaaattcttggtcaataaattaactaattaattgcggagaattcaatactgcagatgggttaaattttatgctgcaggcagggaaactccattaaagatttttgagaaaggtagtggaaagcagaaacccatgttttagagaagataatgtggtggtaattgtcaggatatgtttaagaggggaagggaagcaggaaaccccattgtgatttggcactacatttggctatcgcccaaatataaccttgggcaagtgacctgagtcctctgggacccatgcatggatatgcctcaagaggctcatgtgccactccccagaagattggccaaatttatgtacatgtgaatctgtgtattttctggagcaagattcctagatgtgtgacacctcccctccacccacccccccccaccaaaaaaaagttatagagtgttactgaaagtatactttaaagactggtagcatcagaatcacctcggatcatgttagactgtaaatttgaggtccccactccagacctcctttatgataaccagtgaatatagagtctaggaatctctttttacaagctctccaggttattaatatgcaggcaaaagtttaagaagcatctagtagcttggttacatctaaggtgttcaccaacttaaaaatatttcactattttgcaaaagaataaaaggaagaaatgaaggaaaagaagaaactttatgtaaaagattacaaaaaagaaaagttgcaatgatttaatgacatctcggttaaacggtcttggaagaaatagatgggttagggtttgaagctagataaccaagaggatagaaatgtacttgacagaaattgagaagctgtgttgatgagttgttttgcacacagtagaaaactgagtcaaacacaaattatcagtcagatgattattcttactggcattgctcctacagacagaatccggacagttgtaggggcaaaaaagtacaatacattttccttacccattttgagggccatggctgacacctctataacaaaagaaagattagtaaggggaaagcataacagatttatttaatcaaaagtgtgacacaggaactttcagaaatgaagatccgaagacctagggaaaactgtgcatttttatgttaaggtttgatagagaacgaacagccatgtagaaatgtggttggacaaaagtatgatctaatggtaatagactgggggtagggagtggaactcagcaaggcctgtttgctagattcttttctgtgtctctgtatgacattccttcctctgggtacagggcaggacacccatcacatcagggtcttcaggggagaagacagaaagttagagagtgacatttctaggttttatggcttgctttgaggaagagttctagtttatatgatcagcttccggggagaaatgagaggagaaaggagtgcaggcaaagatcagagagaacttcctgcttctgaggcccttctaatcttcttcagttcaaagcactcagcatgccaaaggaccatacttggaggtatcatgttctgagccccaacacaggtcagtgtacctttgtaaggaatttgttcaagattacccaactgaatttttacagtgactggaacgttgaatagccagtcagaagttgacagtgatcagaacgcaagttcggccagatcaatgataccaagatataagttgctgcgtgcaaaaaaaatcaagcctaaaacttggattctcacgtgaaaaatataaatgtgtatgcatgttaagccattttagttctagtcctcattttaaatgtctcgatggttcttgataaattatattcactttatagcacatacttttatctgagtatgtcaataacaactcagaccccttctatctgctatccaaatatagaacagaaagtatagaaaactgtatgttgggggacacccactgccatataattgcgacaccacttcgtacagtgagcatgtttggagtaaaagtaatatgattggatgaagatgtatgatgcaaaattcctattacataggtttgagattgttttacatctttaaacagagcattaagaaataatcaaaaatggttaattgaacaggcaaaaatgaactttggctaattttggcataagctctccagctctacaagccaaaagatatctttaaagtaaaatctttaaagtaaatgaaaccaactcccttgattcaagaaagagaaaagatctgcagattgaaaagaacttttaactctaagtctacactgtcattaagtgtacttagatttgtaccatataattattatgattgtagcaattaatcaactgattaacatgtagggtcagcaggatccagtgatcttatcttgaagcttgaattaattaattatactttcttcaacattattattttctatttgcatacccagtttgtacaagttgccccttattgacaaaatgtggtttagtctctgtacttatcacagcaggtatgagcactcactgaagtacttttgctcatataaagtcagaattataaggaaactgaaatgtcgtcaatactttctgaaataattgtcttttatttttcattatcaaatatataaattatacaaattaattagattcttttgaatggtagggaacataagatcaaataactcttgtctgagtaagtcaaattccgcgatactattgaagcatcacgtggtggctgtattattcaggaaattcagcttatattgcaagaaatgccccaacctgcaccttgcaaacacaagcttttttaaaaaatattttttaaatattttcaaatacataatctctcttgcagaatctctttggccaagtttttgcaaaatgttcaagatggcattattcccattcgttagatgaggaaactgaagcaaaacacatgaagtggtttgtccagagcctcccagatagctattctggcagtaatggaattgaaaagctctttcaccaaatatgtactgaaggatttcttcagcacgcactaatgttgaaagtagaaacagtaagatgagcagggcatggtgttgcactcaggaaattcacagtccagcaggggaaacagacatgtgatgagatatttacaagtgcagcaccataataaatgtatgaagggctgtgagagcagaagggtaagaatgtcagtgcattcttctattctgttgctcatggtgtttcagaatgacactcttgatggagttgtttcatatgaaagaagaaggtggaatgcaaaagaaaaaaaaagattgtgatatgagacctgttgcatatgctaaagcagcttttttctttttcctagaagccacttattagcagggcctgtctcagttggaggctctgccttttttgcttacagactgtctgacgcctttataaagtgggccactgcattgttgattactatacaccagggtggtctgtgagccactgttttctgccatcccacagtgagacagcatcttctgacgttctggtctcgtatgtccttagagaacggtttgtgtttcccaagaagcttaagtctggatgatttacatgtaacattttaaactccagttgtgtaatgccttgactgggatttatatatgctgaaaacagtttttcagttctgtatatgacagttagtatgtattgtattgtctaccctcatttatctatgagaccagagatgtgacccacagtaatgaggatctaaaaagtgtgtcctctactgcaaaataacatcatgcagtagatgctctgaccacatactataatctcataatcaaatgattaagtgcttgtcaatccaaataagacgtgtttaattttgacaaaaagaaaagaaaaccgagagtagcaattgggttaagacatgaaatggtcagtttctttctgcctgtgttgagtttcttttcacccacatactcttttgcttttttccaagagaaatggcacattttctggatgtgagagttggtcaaaagatcacaaaaaaagtcaaaaaataattctactctgtgaatgaaaaatggatatttgtacttaccctcataagcattaaaagaaaataatgcatgaaattccatagaaatgtgcctatcatgttatactgactcaaaccagaagacctagagtatgatattgctaatataatacatgtggtgggtatgagtggaagtatgtgtgtgagatttatcattgccatagtgtaaaagagttgaattagcttccacttgactagatgagagctcttagttcttattttgaaagcaatcaattgagcatggttaattaggatatcaccaagtagttaaaaaaaaaaaaaaaaagaacataaaaaaagcaaggcacttattagaaagtatactttgaatctgctcacattacagtgctgatcgaaggattatggaaagaatacaccaaagcaggagttgttaggtgctttctacatgaacacatttttcttcaatttcaacaaattattatagttattttatgtggtactgcaaggctgcctttatgtgaatcattgagttacaaacaaagaatacatttcagtcatccaagcagtaattgtaagaggacaagccaaaaagatctcatttggggaaaaaattaatctttaattctgtacttattctgtccgtcagagctcttttatctcaatttacaaacatacgtcgctttatataatgttaaattacaatgaaaattcaaaataactagcaacgttaactagctatccaagatttatatggtatcattgaaggtatgcctttcacttaaaatgtcccagtgtgagaaataaattaacttttctcattaatatggaaaataagaatggttttcatattttcacagacatgccctcttcattatattttgatgggtataagactcatttcaaagtaggtccagaaatctagcagcccaagagggctgagtattaatcctcggaatattagtccactcagaggattgatactgcagcacccagcttgttccctacatctactaataaactcaatgggagtcctcttaaccctgggcaaggttgaacacttgcatgatttgaggttttcaaacaaaagtacaaaaacaaaatgcacattctgccctaatgcttagctggtttcttgttactcgagttctataatttaaactttagccttcttgtatgcattaatttatgagttactgtgcggccaccactgaatgcagcaagtatcctgctatttgtgtgcttgaatgcagaaacatacaaatgttaaaattttacatgcatgccctaattgttcaagtaacagtattaggcagatctaagtgctagtagcctacagggtaattcagatttgaacatatattatttttccctgcagaagattgtttttatgtcaagaataagagccatttgttcctcttctcattcgtgaactcaagagaataaacttggatctacatgttgaagctggacatgtcaagtccttgactgttcatgtctactaaatccttgggctattttgggtttttccttccctccccacacctcctcctcacgctttgttataaaactacttcaatttacctgaaaataagtgtgaatccaggtaaaaacctaaataatcagaaataatggctttaaatttctaaatgaaaagagttaccttgtatccagtatggtagcagaggttttcaccacgccctgtagtcacaaataaaatgtcctatgattttcatataatcacagtttttccaaagaaaatcctttgctcataaagatgcagtgttaggtgcacatttctccatcttcatctatctttttgccattctgggagtgaacagtaaggtagtctttgcagttcaactatataaaagagggtcgtatctctatgaatataacaagacatagtgcaaaccacacttttagtctcagacctagtaatttataagcaagtcaaaagatttctctgacttcatttcataacccctagtcaatgtacgtgagtcttagcatagtcagggtcatagagagcaaggtatttcctaaaaattcctatatttatcaaatactgtaaaaaagcaaaacctctctctagcaacaagcttaattttcttctatcattcatcatcatcatcatcatcagtgtaaccagttgcataaccagcatgtggttctatatttcgatgtttgctgaagaagcaagacactgaaagtcagatctgttgttcatttcaaaacagtcctcaaattctcctttggacaaggaaagaaaactttggagaaactgacatctcagtccctggttaggaagtaaatatggaagtgcaaaatggcatttttaaacaaaactgctttcctgaccgtaactgaattttcacattgtcagcacttccattataaacattttttttagttgggagtttataacgcaaatgtaaagatttgctatgggctaaatctcaacccaagagcaaatgtttataccaattttgaaaacaatcagcttgcccatttgtagttatgcatgtgttcatcatctgttattgcttgtccaatgctctccaacttctgggagaaaaagcagacatctggagagaagaaacaatgtttgctctccagcagatgtagtctgttttccacaatcattgaataaggaaggtatcgaacaaatgtgtgccctttaatacaaggaaatgaaaatgacaagattctgcctgcatgccaatactgtggaaatgctaattggacagtctatgaattggccactttgaacaactagaactcagagctccacccattttacaggtggaaggaactagtatctaatatgaatgacaacagtgaaatactttcacctataaagtacattacactttagggattgccagagtaagtgaagaataaccatttcactaaaaactatttttaccacaaatatttaacattttccaaaattttataaattgtttcttgtcttccagtttcatgttgttggaggttttttttcttcttttaaattccgtcagtaaactaagtagtcaattttttccctggggaaaaaaatgataactctaaaaaatgttatctagctatggatcctgatgggctgagagatagatgctgggactatgcagatttgttttctccaaaatgatataacatttcagttttctttggtgaagtgtctatttttattacctacctgaggtggcactatcattattcaaacagcaagaatggtttaccaagaaaagagtgggttgggaagtgatttaaattctcctgcttcaggccctaatgagttccaccacatcaaacaagtcacgtgtccgctcagatctgtagtttgcttctttaaaatgggattattgaattaactaacctgtaatcatcttttctggttctaaaatgtgatggttttatggtgctataccttacagtaccttcctcggatgtttgcagttcttcagtgaaccaagtctttcatctgattttcccatagtattgggtactgcacccactaagtattctcaaggttaggagcagagccaaatgaaggagacaggaaagcacctttgccttgttttgaggaaggtaaaattgaaggtttttacacatggcaaatcctgattgtcaatacaattcatttggtattgctggggtttctgtggtacgtactgaagatgaaattaaattcttggtttaatttgttgtatctatatggtggcagttaacatacctcgctatttggtatataatgttattttattaccaaaatccttacagtaaaatatgatcttaaaattaactctagagtgtgattacatagcactcgtctcatgtttcattttcacccaaatcagcaccataggttgtgcatttttgctgtgctaaagttacattcccatgttgttctagaggactcctgcaggaaactcctgtatctctatgcactaagtacattgttcatacataagactgtcaattacttatatcttgtgatcagcagaaaaagtccactgcagtgaattcactgaaatacaggtttcctagtcttacccagaataaaaatcagggagcatttaaatttgtttgctattgttatgtgttcattttcaataaaagctatagtaatacaaaggtaaaattgttctgtattgaagtgattcatacagattttttcatcaaaattatgagcacaactttcacccctaaatgtttccccacgccctttcataatttccttcctccactccctggtccctgccccagagcaaataatttgcttttttatctggtttattttatgtagaacaatttattttaaatttcattaatgctgttgttgtgtatcaagtgattttattgctaagtagcattccactgtatggatacaacaaaatttgcttatgattttatttacttgttgatagacatttggagtggtcagtttgggcttattacaaataaagctgcaatgaatacttgtgtataagcctttatatgaacatacgctttcatttctcttgcataaatacctaggagtggaatgactgggtcatatggtagatgtatatttaactttaactgccaaactgtattgcagagtaactatatcatttttcattcctaccagcagtataggagatatgcatttcctccacatcctcattaacactcaggatggtcagttaattgtagccatttaagtaggtttgtacaggtattacattgtggtttgtatttccatttccctaatggtcagtaatattgggcatcttttcatgcttatttgccatcttcatgttttctttggtgaagtgtctattaaaatattttgcccagttttattaggattttacgttttctgattatagagttttgagagttatttttgtcttctggatacagtggaaataccatcctttctcttttttgtcatctctgcatttttatcagatgtctgttgtccatgtaagtagaggtttattttgagactgtccactttgggtcattgatctatacatctaactcaatgccagaaccacacttctttattagtgtaattttgatataagtttgagagtcagatagttctctacttttttcttattcaaacttgtttttgctactctaggtcaagggtcagcaattatatttttcctgtggagggacagagagttgatatttcagggcttgtaggccatatggtttcttttgtaagtactcagttctacacttgcagtgcaaaaaacagccataggcaatatgatatgactgtgtggctgtaaagctttatttacaaaagaaggcaacaagctggaagtataccgcaggtcatagtttgctggcatttgtgctaagtcctttgcatttccacattaactttagaatcatcttgctaacttatatatatttttaaaagcttgccaaaattttaattggctttccattaaacctgtagattaatttgggaggaattgacattttcacaatatagggttttccaaccaatgaacaagttatatctcattatttaatgaggtcttctttaatttttcacaacagtgttttacaattttacacatacctttggtcatatttatccccgagtatttcatattcttaattctattgtaaattgtatccttatttcatttcctgcttgtttgatgctactatacagaattgtaactggttttgtattttgttttgtactctgcaacattgcaatactcaattactggttctgatagttttttgggagagcatcagatgttctacatagaagattatgtgatccttggattaagacaataatattttttggctttctagctggatacattttttttcctgccttattgcattggctaaatctctagtaccatgttaagtagaaatgatgagagtggacatttctgtcctgttctcttctttagatggaaagcattcaatctttcattattaaatatgatgctagttttaggtttttccttcccatctgtcctgagtatgctaagagtttttaatcacaaatagatgctggattttctcagaagtttttctgcatctactgagatgaacataaggtttctcttttctagtctgttaatacaacaactacattgatagatttttaaaatgctaaatcaaaactacattcccagtacaaacccacttggtcatgatatattcatttttgagtttcattaaaattttctttagaattttcatatctatatttataaagcatattaatctgaatgatttttttccaccttatatctttgtatggttttggtaccaggacaatgctggccctaattgaatgagctacgaagtactccatcctcttcaattttgtgaaaaaattttaactagaaattcaatttctctaatagacacaggaacattcctaatttcaaggaatttctccatttcatctattttgctaaatatattggcataaatttgttcataatattttcttatcattcttttattgtctatggaatagtgatgtcatctccctcattcctgactttagcctcaaagggaaggagaatacaaatatttaaggaactgattaaaacttaagaaacatgaaataaaagagatgagaaataagtcttcctgaaggaatactacctgccccccatactgggtcggcattccttatcgcacttttcttaattgtgtttgtatagtctgggatgactagccatttaattcctgttttgtttccatagtgccagaacagggcacagtacctggcatataataggtgccaaaagttattcttctactgtgttactgtgttatgaatgaattagtgtagtcacttcccagattctggaagtttttctactattaagtttttatcctgaaggcaattaaaatccactgaggattttaaacaagtacatgacatgattagatttgaaatattacgtgtatatttagagaatgcaagggggtagacaaaaaaagactggggctagggagtcagtgaagaagctattggttatttaagcaatattcagggagtagaaattttagaatgggttggccaatgaccatcaacagtagagaataggggtattagatctagggattgagagaaaaatacagaacagattctcagaattatgatttggaagatttgttggagtgtggtgccattaagtaaattttaaaataatggtataatagaatgctttatatttcaaaatgacaggtgcccagtttgctacctatataaattggctctttgatgatttcatccctgcaatcatcctcagtgaggtcactataacttactcaaaaaggagttgagaaaagcataatatacttaggtttgtgataatgtttcattatcaggtatagcactgattcagccaaatcactacaattgatttatgtaagtgaattttgcaaaaagtgaaaaagccctttaaatatgaaatcttttggtattaatttttgtatagaaattgtgctaaaatgcatcacatacttccctaaagtattttcagattttgccagtcattctgagaatagatacaagcatcctcatttatccaattaataaattgagactcaaaaaggttgactgacatttctagtgtcaccgttttgaactgtcagtctgaaacccaagggtttttattctaaatctggcttctttcccccttgctaaactacctctatgtatattgtgatattatccagtaatgttctcttgaatatatggaaattaattataaagacaaaagaacaaccaaaagttaaaatatgacctgagaggctgaggaggcaagaggattgcttgggaccaggagtttaagattagcctaggcaacaaagcaagacccgtttctaaaatataaaacagaattggctgggtgtggtggcacacatctgtattcccagctactccagaggctgaggtgggaggactccttgagcccaggagtttgagaccagcctgggcgatatagcaagactctccatcaaaaaatgttaaaatacgaattctgataaactcatggcaaaggtaataacttatttccctggggcagcattttttcccataagttattggggtacaggtggtatttggttacatgagtaagtttagtggtttttggtgcacccatctcccgagcagtatacactgcaccatatttgtagtcttctatccctcgaccccctcccactcttccccccaagtccccaaagtccattgcatcattcttaagggcagcatttttcaatgaggaagtaaaacatggtgttatggagagaatatgagccttaaagtcaggtaaacttgggtttgaatttgggccctgctacatactgccagacacagtgtggtaatcaacaggatttcaacacatcaattttctcatctttagaatgaatctgttatctaactgataggattgttttaagtattaatatcttttgatgcataatttctagcatgaagcctggcactgttaaatgttagttttcctttcttccccatagtagagttgattttaggagcaaggattttagcttttgtatattacagccttactaaactaggtaactgcctggtggtatgaaggactttactaaccttggtaaaaataaaaaattaccatgcagtttggaagaactaagtacatagaccaaaaacaagaatcagtgttttcctgcttctacaaatccacagtttgactcttggcagtcagcctcaccaaggttgccccaccttaacaagtgatgccaaaaaaaaaaagttccaaaaggagaacaagacaactcagcattcggtacgtccattttccagatttatgtcaacaactagagaatatcatttggttttcttctaggatcaaaaagccattagcttctatgcagtatgtggtttttcactcactgcagatcttgtttaagcacattctcactctgaactgattaagtgctgcttgatttctggatggcagttgcttataagttataatatttcttagttataatagtttcttagttattgtgcagaatccacaatgatgcttaccttgcatacaagatgatgtttttatctgcagaagtcatctttgaccacactacccacagatctagagtaaaaagacaccacaaatggctgaaagtgtcaacataaataactatcaataaatgttaaggaatgtggcaaagcatttggcttcttgtgtcttcccaacctatcagagctaactatggctattattgtcaaaagtgatgctcccggtttagttatatacagtatttataaagtgcccatcaccatggtatctaaacacttgggcagtctaattaggctagtcaattacttgtgcaaaagtagaagaggtacccttccttatatcccactccactggaaccaatttgattgtgtttttaaaagcaagaaaagccttctgtgagaatagctttttaggccccttgttccaagatgaaaagactgtctgggtaaagaaatgactgtttcttattccttgaaggtgataatgttctgaatcaagcaactctccagtggtagaaaacaccacagcccagagatcttgattgagaacattttattcccttttcttttgaacttcactctgggggcaggtaacggaaaagtgctttctaaaagcagttcacctgcatgtgaattatttccaaagccttccttggtgagaaaactgtgttctctcctggcctcctgagtcagagaaagagtactcctcctcttcaggacatttaactgggtcagacctaaagcagaacttggtcacaaagacctcccttctgacttctattttggacagacatggacaaggtttctaagacaaagtttctggtgtgtgtgtgtgtgtgtgtgtgtgtgtgtgtgtgtgtgtaggagtgaggacatgttatccattagtaaaatcactaataaacatttttagaatttattgttgatcaaatactttaaaaaagctatttgtggccgagcgtggtggctcacgcctgtaatcccagcactttgggaggctgaggtgggcagatcgtgaggtcaggagatcgagaccatcctggctaacacggtgaaaccccctctctactaaaaatccaaaaaaattagccgggcgttgcggctggcgcttgtagtcccagctactccggaggctgaggcaggagaatagcgtgaaccctggaggcggagcttgcagtgagccgagatcgcgccactgcactccagcctgggcaacagagtgaggctccgcatcttaaaaacaaaacaaaacaaaaactgtttctgtacaaatgaaatactatgtttatgtgtttctgaggcaaactgaataccacgcttattcagaaaaatagtatgtcgctgatgtacacttcaggctaaagaacagttgtctttttgtactagcaagatttcttcctggaatttattatgaattcaatttgatatgaatctaatttacatgatatcttatttcataatgtttttcatagctatgcaaaaatcaagtcaacatggcctgtaatgtttcaaagtataatttaaaagttcagagaactagcattttaccttgaaaatgagtaaactattgttttgttctctagtcattccacctatgtctatcatatcgcttattgcttaattcagattttaaacagtcttattttcctgtcatttcttcatgtcacagtctctcccctcctgatttgatttgttgatttgtcattgatttgttcctattgtggccttgggacataatttcgagactttgttcagttcaaattatttcagtacctcagtccttctgattctgttccttcagtttggtgttcctgttttgtattcattccctgtcataacagttctctcctatctttcaatatacattttttgaaaacatccctatgcggccacatcagttccttcagtaactacttttctttctcatcagaatcatttgaaattgtaattcccagaatttcatcttttagagcactggattcctcttgagccatcttcctgtacagaaattcttaccaagggatcttaatttgttctctggccattaaaatgatggttgcaattattgaacatctacttcatgacaggaattttatgtgcattatcttgtttactctctaccactctcttataagctaggtttatcttcatcgtaccaatgtgaagactagagttcatagaagacatgtataggcagtaatggacagagcagggtagaacttcgggtgtatttgtatcaaaagcctatactcttaaccattatgttcatatcttgtatctcagaattaaactttcctaattattttctcctgtaaactactgagagacttccaattattcttatgttggtatcaagtactgtgtcagttggatagggtttagctgtaattgacagaaaatcaactcaaaagggtttaaggaaagaggcaattttttggctcatggaactagatatccagaggtagggtaaattacagggtttgttcatatggggattcaaagatggagatcacagactcaggcccatttttttttctgctctgccacctgtagagctggcttcatcctaatgctgattgcagcattgtggagaatgctcaccagtagcaacacaaaccatgtccttcctctgtcacttctggtaagagatagaggagggcatttttcaggaatctcaaacaaacacttcctttcacttaattgatttgacttctatcacgtgcccatttcttaatatagctaggaaatttccatttgagttaatcacagcttaatctcgaatcagggactgagttcggctaatgatgagtcctataatagatcactgaacaataccagaattctctttagaaagagaaggagaagaatagatgtaggatagacagtcaacagtatctcctgcccaactcactgactacctatcaagcacatgcacccttctgttcaacatttactttcacagccctcgtatctacttgaaaccactcactgctcatgcaacctcatacagctactcttccatatatgttccaaatatagctggcttcaaaaatcagaggtgtgatgtgacttttctatcttaacaatagctatccgccaccaaagcacttaaaatttgtaagtagggaaaaaagggataacaataactaaaatttctatttggtggggatctaatatgcggcatagggggtgatggacatgttaattactttacttgtggtaactattacacagtgtatacatttatcaaattatcacattgtgcagcttaaatatattcatctttattcattaaatttttttaaaaaaaattctatttggaaaagtgaggagcttatggtagtttgtgtgatattctgaccaagaagagtgtgtctttcatgccctggctgggtagtgatttcctgggtcagccagtctgatagctcttagttctactttctgaaagattcttaggtatccattgctttccacagtcacgggtgagaaaggaggacattctctagcagtatcccttccaagccactaccgccctaggggctagtggagacattaaggagttgtctgcccttcctaggcaggcatgggtttatgtggtaatacaggcccttttaaaaatttagaagacttctggtttgtttctagtctatttatcagctttcattagttctagaagtcttttgtgggaattctggaaatacccatgtcttagcaactagtttctgtgttctgcccatttctctggcacttggtttagtcaatgctttttatcttggagtttttttttcccccaagagaatttgaagtaataagtgggtgttcatcttaaggaaacatgctagaagtagccaccatgggccaacatcctgaattttgaatttttcctaccattgttcctaatctgtgggtagacacgtggtctgtgttccaaaatacaacagatgtgagtctcaaatgttttgctgccatgtgacaagaataattgcaaacttcatagactaggatgatggggtccttcatcccttccatgctaactcttccactcaaacttacctctctgtaaaacctattacttaaagtgtaccaatttgatctgttttttttaaattgtatcaatacattcctccttcctcctccacattctgtataattcttcaactgttgaatgtctttcctattctgtaatcccagaaattttaggagacaatgggaattccaattgcatttggggaaaagttgtttttgccgatactgctttcaagcagataccaacgttccatagtttttggcagaatttgggaaccaacaaagggaaatgtaccctaacagattaaagcagggttagtggtttaacctgtctaagaatcaaagggttggaaacaaggaagactttattttaaaatcgtaagaataagaatgaaccctaaaatgaacactttatgaattattaggagatcatttcaggaaattactcacttagcgacagacctgtgtaaaactcaatgaactgtacatgtgatggatctccactggggtcatcttgatttgagtaccagtatgataaattgaaaagtaagggctatgtgcttaaagaaaagattgggcttaccatacgtttccttgagataaatcttctcctaattaatgaccttttacctaggagtagaaacaacaaagagagtttgtgatggccagcaaataacacaaggctgtgtcctcattgtatctcatcccacgttctattagttttctattgctgttgtaacagattaccacaaacttagcaacttcttacagttctgtagtttagaagtctggcactggtctcactgggttaaaatcagagtgttcttagaactgtgtttctgtctgaaggctctagggagaacccatgttcttgccttttccagtttctagaggcctcccacattccctaaactgggaataaccagcttcctgcatcttcaaaaccagcaacgttgcatctctctgacattcttccattctcatgtctctcactgaccacaacaaggatttctttgcttttaaagaccaatgtgatcagatcaggcccaccccaataatccaggataatctcctcacctcaaagtccttaacttgatcacacttgcaaagtcccctttgccacgaagatagcattttcataggttccagagattaggatagggccatcatcattgaaggtctattattctgcctaccacgttaagtcgatataacattgcttacatgataaacacttgaaatgtgacattgtttttatatagattaataaaacaaagaatgttcaattaatgtcaattatgaatagagggagaaggaataaatgagagagacaagggtacaaaaaaagtatgtcttcttaaggagtatgtgttcttattaagaaaataagattttaaatgatgactccttgaaaataagtgctcgggaggagccaagatggccgaataggaacagctccagtctacagctcccagtgtgagcgacgcagaagacgggtgatttctgcatttccatctgaggtaccgggttcatctcactagggagtgccagacagtgggcacaggtcagtgggtgcgcacaccgtgcgtgagccgaagcagggtgaggcattgcctcacttgggaagcgcaaggggtcagggagttccctttccgagtcaaaggggtgacggacgcacctggaaaatcgggtcactcccacccgaatattacgcttttcggaccggcttaaaaaatggcgcaccacgagattatatcccgcacctggctcggagggtcctacgcccacagagtctcgctgattgctagcacagcagtctgagaccaaactgcaaggcggcagcgaggctgggggaggggcgcccgccattgcccaggcttgcttaggtaaacatagcagccgggaagctccaactgggtggagcccaccacagctcaagaaggcctgcctgcctctgtaggctccacctctgggggcagggcacagacaaacaaaaagcagtaacctctgcagacttaaatatgcctgtctgacagctttgaagagagcagtggttctcccagcatgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaagagaaaactggaaactctaaaacgcagagtgcctctcctcctccaaaggaacgcagttcctcaccagcaacggaacaaagctggatggagaatgactttgacgagccgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaagtttagagaaaaaagaataaaaagaaatgagcaaagcctccaagaaatatgggactatgtgaaaagaccaactctacgtctgattggcgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatacccagccaaactaagcttcataagggaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaatgagcaaaatcaccagctaacatcataatgacaggatcaaattcacacataacaatattaactttaaatgtaaatggactaaattttccaattaaaagacacagactggcaaattggataaagagtcaagacccatcagtgtgctgtattcaggaaacccatctcatgtgcagagacacatataggctcaaaataaaaggatggaggaagatctaccaagcaaatggaaaacaaaaaaaggcaggggttgcaatcctagtctctgataaaacagactttaaaccaacaaagatcaaaagggacaaagaaggccattacataatggtaaagggatcaattcaacaagaagaactaacctaaatatatatgcacccaatacaggagcacccagattcataaagcaagtcctgagtgacctacaaagagatttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacaccacacctattccaaaattgaccacagagttggaagtaaagctctcctcagcaaacgtaaaagaacagagattacaacaaactatctctcagaccacagtgcaatcaaactagaactcaggattaggaatctcactcaaaaccgctcaactacatggaaactgaacaacctgctcctgaatgactactggatacataacgaaatgaaggcagaaataaagatgttctttgaaaccaacgagaacaaagacacaacataccagaatctctgggacacattcaaagcagtgtgtagagggaaatttatagcactaaatgcccacaagagaaagcagtaaagatccaaaattggcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacacaataaaaatgataaaggggatatcaccaccgatcccacagaaatacaaactaccatcagagaatactacaaacacctctactcaaataaaccagaaaatctagaagaaatggataaattcctcgacacatacaccatcccaagactaaaccaggaagaagttgaatctctgaatagaccaataacaggagctgaaattgtggcaataatcaatagtttaccaaccaaaaagagtccaggaccagatggattcacagccgaattctatcagaggtacaaggaggaactggtaccattccttctgaaactattccaatcaatagaaaaagagagaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcataaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaggcattcttatacaccaataacagacaaacagaaagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccaaccccatcaagctaccaatgactttcttcacagaattggaaaaaactactttaaagttcatatggaaccaaaaaagagcccacatccccaaggcaatcctaagccaaaagaacaaagctggaggcatcacactacctgacttcaaactatactacaagactacagtaaccaaaacagcatggtactggtaccaaaacagagatatagatcaatggaacagaacagagccctcagaaataatgccgcatgtctacaactatctgatctttgacaaacctgagaaaaacaagcaatggggaaaggattccctatttaataaatggtgctgggataactggctagccatatgtacaaagctgaaactgtatcgcttccttacaccttatacaaaaatcaattcaagatggattaaagccttaaaccttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcagaaagtgggctaaggacatgaacagagacttctcaaaagaagacatttatgcagccaaaaaacacatgaaaaaatgctcatcatcactggccatcagagaaatgcaaatctaaaccgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactatgaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtggtttgtagggacatggatgaaattggaaatcatcattctcagtaaactatctcaagaacaaaaaaccaaacaccgcatattctcactcataggtgggaattgaacaatgagatcacatggacacaggaaggggaatatcacactctggggactgtggtggggtcgggggaggggggagagatagcattgggagatatacctaatgctagatgacgagttagtgggtgcagcgcaccagcatggcacatgtatacacatgtaactaacctgaacaatgtgcacatgtaccctaaaacttaaagtataatttaaaaaaaattaaaaaaaaaaaaaaaaaaaaagaaaagaagtgctcaagggaagtttgttaatttaatctttgggaaaatgcaatttatcataatttgtgataacttattataaaatttcagaaaaaaaaatacactgatggcagggcacggtggctcccacctgtaatcccagcacttcaggaagccaaggtggattgcttgagctcaggagtttgaaaccagcctaggcaacgtggtgaaactctctctaccaaaaatacaaaaattagccaggcttggtggcatgtgcctgttgtgccatctactcaggaagctgagatggaaggatcacctgaacccaggaagttgaggctgcagcgagctatgtttgcaccactgcactccagcctgggtgacagagcaagaccctgtctcaaaaaatacatatataaaaatatattttttaaaaatacatatttttaaaaagagaaacatttaaaaaaaaaagttgaaggagaaagggttgaagcatgttttgtagatttagtaattttagaatgggaactaggtaacactgttcgcaaatctgaaatgaagtctaagtttcaaatctcataggatagaaagtactgtgtagatattcagatttatctggatcttgacaatatgttgatgtaacactcccatcacttcctaaagggttaccttactgccttgattctattttctttttttttttttcttttttgatcattgcattgttttcagcatacagagcaaagttaggcggcagctttcagctctgaatggctaatgaattgttcatctgtgtgtagaatctccctggtgcaagctctgtgtgagtctctattcctccctattcaaagatgacatcgtcaattgtggtgatcctacccatgtatgcagatccagctgaaaatacaaatgagagactagcattcctttctaaaacccatgctttaaactatgtcctttgtttgcaggtgcaattagctagtttgacaagcctgttatctgactcttcttttttatacagcctacatgaccatctcagtctaaataagtcaccccatttctttttctgcagttcatctgtcagttattttcttgtcttagagaagcctgaagttctgatatacttgtggttcaaatcactcttattgcaatcctttgatgagtaatttcagctttccatctgaagctaaatacatagacaattccaatgaaactcttcaagaattctccataaaatcaaggatctaggccacaaaattattctgatttataccacaaaatttggttccaataatatttcccaaagaggaaggatgggagaaaaattaaattcatttagaggtaaaatataatttaaaagaaatagtcttctctctataaaagaatcagaattttaattgttttttaacattggaattggtaaccaggttgaaagtctaaactatcaggcctcagacccctgagcttaaaccttaaaaccttaattatagctaacattgattgagcatttatggaccaggtgctaatctaagcacactaaaagtatccacttaaacttcacagcaaccctaggagatagatagtataattgtctctatttttcagataagaaaatttcaggtatagaaaacttatttaccttattcagctgcccagtagaaaggcttgtgttcaaacttcacctgtgtaatgtcaaagccagcttccttacccactgtactatattacctctcccatgtctcctattttgaggcatagttggacatgaatcacttacctataccaagatggaacccagtgaggaaagcacaaacttagatctaatgcctagaacagtgcctagagtacagcagattgaatgaattaatgaatgaacaaactaaacctcccatgttatggctcagacctttgaaggacagccacaagtataggtaccatgtggaaattttaaaaggtaatgatagcaacagccatggtttgttgaactacatttcctagttcacagatgacaccttctagctgtgtccccacaatgctggaaggggcaaggcagctctctggggcctctttcataaaggcactaatcccattacctaattaggtttcaacatacgaattttgaggaaacacaaacattcagatcctagaaaatatattttataatccagcaaaacacttgcctcagggtattctgctagtctgggaaaatgagagttctcagacctgaaggacagggagatggccacagggctccagtatggagggagccaggatatatctgatctgagaacaccaaaatggaggcaaaagggcaccaagtggaagtccagtgtatcatgctgaagttaagtttaggctgacacaagcaacaagggtagcatcctgttcaagctgtgtgtgcaaggcatgtagactagagtttcttaaatgcccattagtgcttaaggtaaaggcagacttcagacaccagggaggaattgagccccagtgtggcagtccatgaattaccatggaatagacagaagaggcttgaaaactctaagaatcagaccccatacagaaaagctcttgctgcttctcaacatcctctgagcaaacccacttctgctcccaaccacatttcagccacctttatttatatcttctacttttattcccctcataatgagaagacctcacctgtttctctgtatttctagtgctactgtattttttcctggtgtcaacgtattttctgtgtaaaacatgtatcttatattggaggttgagccaggccagatgacaaaatctgggtttgaagatcagcgagactgatgactcagacttttgcccagcaaaaaggcagtgcaaaggatgcggaagatcagggatctacctaagtgcactctgcccacccgtgccaattcttcacagcagcataccccatgttccagagtgttcgcagcctgacagagtaagggacccgataggtcactggagaccagaagcctctgttggcatcctgctctttgttcagccagtggtggtgaacacatcaccattcaaacccaccctaccaccttagaccaaatttctttttgtaccccagtaacatctacccaagtcctcattgtctcttattccatcatcaggtccactgcaggcaacagaacatgccctggcctgttaaatttacaggaaaactgtgttttatatgtaaaactatttctaagtatatattttaaggaaaataattgctttgcatattgtgggcttccaaacatgaacactttatctctgtttaatcagcaggtgaattgatgcactgaactgaggctaaacagcaggccaaggacaaagaaagctattggcagaaattactgaaaaagtactctcaggaatactcatttgttcttctggctttcattacactacacctcctttctatagttatattttctttaagaaaatctgctaatggcataccatctgagaaaatcatgtgtcagaaagctaaataacatagtctatgtaactagttgaacaacaattgaacattagtatgaacaaggttcatgcaatataatgcaatgaagacacagctttcggttttcttttgaaggggtccttttgcaaaattattattttgatttggtggttcaaaagttaggcttttttaattagttttttttttatatcgctgggggatttgcttctaggtatgcatgtatagtactctgagtatttctacttgagtggctgcctggaagagtagctccttagaatctgtcatgagcaatggctctttttgacacatcagaggagttagctaaagtgcatcattcttgatttaggagataattttgcctttggtgagaaaagtgaaggattattgatttgactaaagaacttcatctttatggacatcttagatgagattattttagatattgttttatctttgcaaaattttagtgtgattaagcaaataacacacttataggtgtccaattaaacaaatagtggcaaaaaaagtcattgcatttacttcaggaatgatctttagttgggtcattattattgaacatgaaaaatgacctacagctgtactgtaccttcagttcgttttgctggaggtactttcatgaaatccagttacccatcatttatccctatctatctctgtataatctttaaagatgtcattatgcagcatattcaactgtctcctaacacattatttgtaaagtttttgattgtctttatgtattcctttaaatataatgtagcatatccatataggtagcttcataacagttgcttaatgtgaattccagcctgcactatcctcttataagctgaagataagagaattgtcattcttgatctattcaggttccataataggaactttacagaaggttttatgtataaaacagacaaatagtgtgtacttggtgctatgaaatgcccattgttaataaattttagaaacatatcagtaattataacttaggtcctgtcatgcctgctttaataaaaagaatattttacctacataaaggtagatgaattacattatttggaacaaattggtagattttcacttcaagagaggtataaaatatagagagagtcattaaggtctggtaaaagtaaagcactgagatatagtattaggcagacttatctgaggtgggcttcagtgtaaactgaggttctcagatatgaaaaaaaatctaagtggaacataaaaacacacataaatgacagacaaaaacccataaagtggctcattgttagaatacaaagaactatcacaattcatggatgtaaagagcccaactatgagacaaatgcccataaacgcataatagaaaactcaaatgatgttaactaatggatgtcactacagatattttgtgatacattttatcacataatatctgtgataaattttgattccaaaatttagcaaaaccgcactcgagttaaactggttcaatttaataaaaagtggcagaaactaaactcaggtccactgatacatgtaaaatggaagtctggcccaaaaagacagtccagtatgagactgggccttcctccacttgccttggaaccttgtcacactctagtttgagaataagttaaataaaatgaatttccacattatttgctttgccgatggtagagatatccaaagacaatggtaaagcacataatttagagttgattgaaactatagtttgaataagcaagcaaatcaagaagttactgagacacaacaattttgcattcctgtactttcaagaattactgaaaagttgagttaaaaaaatatgtcagaaaggaagtatttacttctctccataatagagtgtctgctaataaactttccctcctattctaaagagctatgaaattggacacaatataagaggcattaagaattatacagaaaaattaagaaaagggaaccacacaatacgagccccatgattgtgccagctttccacctgggcacacttgatgctacagcatggggaagattcaatattggtaataaattaaaaaaaagaaaaccttgattcttactttacaacatatacagcgtttgagattacttaaaggtaatattcaattctatatagcatctagaaaacaaacagagtgtagactacctttgagacctaagaagtacgcagagacacagaaagcacgtttatgggcataacacaatcttttttttagacggagtctcactctgtcacccaggctagagtgcagtagcatgagctcggctcactgcaacctccgcctcctgggttcaagcaattctccttcctcagcctaccaagtagctgggattacaggagtgtgccaccacgcccagccaatttttatatttttagtagagacagggtttcatcatgttggccaggctggtctcgaacccctgacctccagtgatatacctgccttggcatcccaaagtgctgggattacaggtgtgagccaccacacccggcctaccacaatcttaatgtaaaaatataaattggattttacaaagtcaccattaaaaaaaatgaaaaggcaagccttaagttgggagaaaatgttcatagcacaaatatctgataaaggccttatattgtgtgtgtgtgtgtgtgtgtgtgtgtgtgtgtgtgtatatatatatatatatatatatataaacaactcctgcaaattcataagacaaagtcaaacaaccctatacaaatggggaaaagaataatagtccttcagaaagaagatacacaaatgatcgatgaacacatgaaaagtttcttgatattaaaagtcaccagtggataaaaattaaaatcccaatgggatatgagtttatacccaccaaaaaggctaaaattaaaaagactattaatgtgaaatattggtgaaaataatgagcaactggaactcttgtacattgctgatgagagtataaaatggtacaatcattttagaaaagcatttgtaagtgtcttaaaaattgaacatgctcctaatccatgaccccaaaatccttctcctaattgtatactcaagagcaatgaaaacatttgtcaaccaaaatgacttgtaccagaatccacaagcttttttcctcatagccaaaaactgaaaaatgactcataagctcatcaaaagggagatttgtcaacaaattacacagagcactcaaaaataaggaactgcctctattgactacaatatggatgaatcgttaaaattttttcttgagctaaagaatccagacacaaaagagtatatacctacattattccgtttataaaacattcaagaataagtgaaattaatctatgactaaaatcagaacaatagttgcatatgagggagatggagattgactggaaagatgtatgcaggaaatttcagggtgagaaaaatgtcctgtaactcgactactgttggttatgtgagggcctacatttatcaaaacttacaggcatacctcagagagattgtggggtcaatttcagactaccccaataaagtgaatattgcaacaaagtgagtcatacgaattttttggtttcccagtgcatataagaggtacgtttatactatactgtagtccattaagtatgcaatagcgttatgtttacgaaaacaatgtacaggccttgattttaaaatgcgttagtgctaaaaatgctaatggttatctgagacttcagtgagtcataatcttttcgctggtggagggtcttgcctccatgttaatggtcgctgactgatcagggtggggggttgctgaaggttggggtaattgtgacaattacttaaaataagacaacaaatagatttgccacatcatgggcccttcctttcacaaaaaattgctctagcgtgcagtgccgcttgatagcattttacccacagtagaactgctttcaaaatgggagtcaatcctctcaaactctgccactgctttatcaaccaagtgtatgtaatattctaaatcatttgttgttatttccacagttttcacagtatcttcaccaggggagattccatctcaagaaaccactttctttctcaaccattaaagttttgtcatgagatttgagcaaattagtcatttatcttcaggctctacttctagttttagttctcttgctagttccaccacatctacagtcacttcctccactgaagtcttaactcctcaaagtcatccatgagaattggaatcaacctcttccaagctcctgttaatgttgctattttgcccttctgcctatgaatcatgaatgttcttaatggcatctaggatggtaaatcctttcaataaggctttcaatttacttcgcccacattcatcagagggctcattctctatggcagccatagccttataaaatgtatttcttaaataatcagacttgaaagtgaaaattactccttgatccatgggctgcagaatgtatattgtgttagcaggcatgaaagcaacattggtctccttgtacacctccattagagcggtaatacattgacagtgatctgcttctctgagcagtaggactcaacagagggcttcaacattctgtaaaccatgctacgaacagatatgctgtcatccaggctttgttgttgaatttatggaacacaggcagattagatttaacataatttggaagggccctaggatttttggaatggtaaatgagcactggcttcaacttaaagtcaccagctgcattaacccctaacaaagagagccagcctgtcctttgaagctgtgaagctaggcattgacttctcttgtctagctatgagagttctcaatagtatcttctaacataacacgtttcatctccatttaaaatttattgtttagtgtaaccaccatcatcaagtatgttagctaggtcttctggataacttgctgcatcttctacatcagcacttgctgcttcaccttccacttttacattgtagagacagctttctttttaaaacctcatgaagcaacctctgctagcttcaaacttttcttctgcaactttctcacctctctcagcattcattgcaattgaagagagttagggtcctgctatggattatgctttggcttaagggaatgttgtggctgctttgatcttctatcgagcccactcaaattttcttcatatcatcaagaagtctgttttgctttcttatcattcatgtgttcactggagtagcacttttaatttccttcaagaacttttctcctttgcattcacaacttggctaattctttggcacaagcaacctagcttttggcccatcttggctttcaatatgccttcctcactaagctcaatcctgttctgcttttgatttgatttaaaggaaaagaggcatgcacctctttctttgacttgaaccacttagaggtcattgtaggttttttcattggcctaattttaatattgctatgctgcagggaacagggaggcctgagaagagagagagacaagagaatgacccattagtggagcagtcagaacacatgcatttattaagtttgctatctcatatgggcgcagtttgtggcatcccaaaacaattacaacagtaacatccaagatcactaaacacagatcactataacagataaaataataatgaaaaagtttgaaatactgcaagaattaccaaaatgtgacacagagacacaaaatgggcacatactactgggaaaaaggtgccaacagacttgctcaaccaaagttgtcacagaccttcaatttgaaaaacaaacaaacaaaaaaaccctcaatatctgcaaaatctgcaaagtgcaataaagcaaggtatagtcaaatgatgtgtgcctataattaaattgtatatttaagatttgtgcatttcagtgtctgattaccacctcaattttacttcaaaaaaaggaagtgattgaaagaccatttatggtatgtttcagtttgtgttattgtgttttgatcatacatggttccagtactcatcccattcattgtgaatcttcatggttccagtaattctaatattgacccagagtgccagttaattaggcttaaagcaaaagagatgaaatagggaattcagacctgatgagcttgctcagggatttatgtgtggtgaacagcaagtgttttggaatacatggttagtgtatctgttaactgaaccatgaatggaaccatggaatgtgtattgtttatcttttgacattggtgtagggaataaaacaagactccttggttgttggaaccctcacccctacttgcatacggcttttctggattttcccagaaagatatatttttcttcctcaagtacccacagaaatttgtaccatttttctgtgccttgcattttaattatatctgtgtcatatcacccctcctagttggtgtggctaaaaggctaaactctgctcactatctctgccacccatagcacctataacattctttaatttagatcaagtacttgttgaaagttttaaatatttgatggatttgatttgattggactggatgaaataacctttgtatttaatggaaccacagaccaggaatttgaggaattgaattcatttgtgccttcatataatgaagttattgagtacttatcacatgcaagacactgagctaagaaatcttaaaactcaaagatacataatatgtagtacctgcatgcaaaattctaccagtctgatagggaaaagacaatgtgtataactgatacacaataaaaggcagaaagtcatgtgaaaaaagagaggaagagaggctttcttatgaaaatccaaaagaggtcaggtgcggtagctcatgcctgtaatcccagtactttgggaggccaaggcgggcagatcacttgagcccaggagtccaagaccagcctgggccacatggcaaaaccctgtgtctattatacaaaaacataagaattagccaggcatggtggtgcatgactgtaatccagctacttgggaggctgagataggagaatcacctgagcctggggggatggaggctgcagtgagctgtgatcatgccactacattccagcctggctgacagagcaagaccccgtctccgaaagaaaaaggaaagaaagagagaagaaccaaaagaggaagaatatctttgcctctatttacactttgaaacccttactttcttttagaccaagcttaactcctatttggagtatgcatcttgagaaagccaaaataaatactagcaagtagtttttgaaattttcttgtcaataaaaagtcaagaaaaaacaaacattccttagaggggaatattcagtattccttctagaattataagtgaatgggaagtgatgccaacagttccaaccaagtttgttcctttcttcctcacaacagcgagcattagcctgtgagaagccctggtttctaatttcatctctgcccaaaactacataggtgtcctggtcaattcacttaattcctctgcatcatagtttttacatccataaaattagagaagagaacagaatgttttccaaggtctactccaactctaaaaatgtcatgattctatattctgtggctctgtgatcctaattacttttgataagatcatttatgtgattttggggattggaaagagattgtcaagtttcccaaacttcattgatccatatgctaacttcactgattgtattttcagtagtatcgatgttaattatttttcctaaaagcaaatgacttttatacttaaatatatttagctttatcctaagcaataatatctatgaaagcatacattttttagtgttacttatggttttttaaatatgcattaaactaaataaccattaaatttgtctcttatgccaccaataacatatatgtattctactttaagaaacactgctttgctgtagtaagtaggaaagtctgatccaatatctttgctagttgattagaaaagtcaatcataaatgctatcagaataggtcaacctatatgcaccagtatccacaaaggctaaaaaaaaaaaatatgctgcactcaaccagaatcttcaaaaatcctgggattcggctcttaagtgggtttgtgcattacctggaaaacaatttgcaaaacagatttttaaagttcagagtaaattggagaaagggctacattacatttgaaccttaataaatacttaataacccataagacaaatagccatgaattactagaatgatttcaagcacagtgcttctgcagagtcaacctgctcttatttttgctcattataaaacaggagttataatattgcaaagtttattagctctgttgatttgtgtgttttataaaacaagacatttgaataatatagaaccagagccattaggaaaatctatttcctttttcttctctatctagtctcctctgcccaagatagcttgaaaatgtctttctcgtagaaacagaaaagcatgaagattcctccaactctgtccttttttatagatgttgtttatttcttgaatgagggggtgcgtgtgtgcgtgtgtgtgtgtgtgtgtgtgtgtgtgtgtatgtgtgtgtgtgcaagcttaggtcctcaggtggaaccgtggttcctgtgctttcgtcctcgaagctgtttttctggaagggaatggaggcagctgtgtttacagctcaagtcttggcatacatttaccagaatctattattcatatcattcagtatcagggagagatctcaggccacctgtctatctgacaaattcacccttttgtgagctttctgttcatagcaaattatgttcacattgatgaattgagtttttatgagcattgctaactaacattctcacagaaggccaggggcaagagcctgcaagtgtttctggtccataagtaaatgattaaaaaaaaaaaaaaaaaaaaaaaaaaaaaaggaaaaaaatggtagtgtttaaagacaatttgccatggaggaatagttaaatcatttggcaatgccttaatatttataattccaagactttccataaattattgcaaatactcagcttataacaaacaaaaacatggaaaaaatccacacaatatttttctctgtagcacagaatattattgaaaaattgttctgcattttgacaggtaaccattgaccagggcaaaacatggggtagttgaagaatgcccagcattaataaatctagcaattttatacaataatgtggaaaacttgcagcaattgtagcttaaattccagcttggtatttccatagatacaaaatggatttccttttaatctctagtaaccctatactggttatggagctaagccatgtggcttgagttaaataaatgagagcaatctttcacaaaaggctaacagaaatccttctaaatggtgggtggggagatacccagtgttcatgacagaaataaaaattttctttggtttacatgtagaattggttcttctcttgggcctccatggcccttgcatttaccctgactcttagtctgcatttcatttaaaacagctgaaaaagagaaggtggtttcaccagagagacacgttctagttttcctgtacccacatttcaaagcgctaattccaaatctccttaaaatgataagcctgcataggtggcagagccactagtcagtatatatttacataaaaagcaacaaaacagaaattttacagggcagtgagtaatattatcaataaaaatccatgacttctcagttcactcaagaactgtgatcctatcctcccaaaagacagattactacctttgataagggacaatcctattctctgaaatcttagtgaaagtcagtagaaaattctaaatctcttcatagtagcctgccaaaatgtgtcagacacatcacctttcagtgcaaagacaccatagcacaaagaacacttggcattatcccttgaaaatgcacacctttcgaaggagcaaatgggaagtgtagtctgttaaacaccatatgtgatggagctgcaccagtctcatttccccttccaaacgctacaagctgctacctcattgtggtgtgtgtgactctagggggaaatcagtgacagctgagtgtctacctggtcccaatgtcagttggcttgttgaccacttaagtatgcagttcaatgtgatactatgctttagtgacctctgagaaatagaatccctgggcctttatgttaatttagtagcgtatgtgaaacttttgcaaactttccagtagctgcccttgccttcagatttgtgggtaaaatgaggagactggatttgcagtccttaaagtatggaaagatgcagacgggcaaatttctttgaaaatttgtcttgacatttccttccagtcctaaaactactatggataaatgcttctgttttattaaaaataaatttgtggagagtcatggccataaaagtcttcatcacaggtttgatcggaattttctgtggtaagcatagcgaccattcatccagattctctataaatagttcagtttccatatagttcttccttttatccaaccgtatgttcctatttttgttcagacaatatggtcaatgaggctttaaggcaacaggaccaatttacctgcaagaatttttcactctaagattacagaaattaacacaggagatagaaatcgaggtgttttgtctctaagcaagcaatttgagataaagaatgcattctttggtgccagaggcatggcaagcagcactctgcagcttggtgccctattcatagtgtcaagcagctacaggaccaccattttgctccttgaaactgctacagcattttaagtaatgctagaaggctaaaagttgactgcagctagtagagcattgttctttttttaacccatgtgataggtatcttcagcagtgtcaaacaaatttgtagagctggtgattagttgcccaaagagcataatgtatgcattattaattaaagaaggtaagtttggctaattgtcatttctatacagtagcagtgcactaagatacattttaacaatctataaataattgataattttttttctttcatcttccttcctagtttgcataaaactaatgacttggtaaatgttactctcttcaaaatattccaccgcttctatgaaaattaaactaacgctgtaaccttagcaaataaggagatttttttttttccttttattgcaggttaaaaaaagataggaattataacacttaaaacaaaaatgtgattctgtggaaagccaaatgagaatcataaataatataaaatcagcaatgaatgtgactttaagaaatagaattgactttaaaaatgtgaaaatgcaaaaacatgattacatatatacatatatacacatatgtatgtgtgtgcatgtgtatacacacacatgcacagatatatatatatgtacacgcacacacacattccagcagccccaaagtcttgcttgttcagctttcaaaagcctaaaactacaaccaaaagctttgctccaggatatcttccaagtctggtgctggtgtttcagtacttaccaatagctacatgaataatccttcaatctcattagcagaggacacaaaatttttctcagctgaagtatttgagtttacttcctatatactttgctaatttgatcatagcacctagatggatccttatgagaagagatttactgcagcaaacctacccacttctcctttttcgcaggagttctctgttattcttacgaatccacaatctgccagtctggtgtaatagcacaagagcttgcttactctctaattttcagtgcaactgaatacattcccggagttattgatggcactgtaattttacgtttattttgtttggaatacattgtggttaaaaaaagatttctttaagaagacccacaaactaaagtattgcctaagtgacatattgttatttaagccttcgtcgagtcttacatatgcttcattatgataaaaaacaggttgtaaggactgattctgtgacctttttttctcattttaaccctactgatatgtcacccatggcaaccttaaactgattttaatagagtcgatcctattattcatttaaattgaggtgcaagagcacttagaccagggaaatttgcattcagcaaatggggatttgatgagcaaaaatgataagatatatgttgtataacatggcctattttgctagcaaataaacagctcttgaaattgataaacttcagaatattttatcctcaaatgtttatacataaatgattaaaatgcattagcaattctgcttttgaaaaaaaaacatattgggaaaacaacacagttgtgttgcttaaatttgtaattaacaaatttattactaattctgttcagttctttaatatgctgcattcctgaagaagaacattaatacacaatggcagaaagaagctaattttaagactttggagaaatgaatgtcttttaatgctgtgtgtttctcttatctacatgccacattattgtaataagtacattcaggaataatttcttttcaaatatttttacaaatcttgctcttatttgcatgcaagtaagttgtcagcttaaatctttgaaatgcaaaatatatctcatttctatatttcatcaaggagcctttcatgtttaataaattacaacttagatcctccaagactttgtttttcattaactaaaagcaaaaggatacatttaaaatcttaatcacaacctgcaagggtatttgcatgttgctgatatttgtcttgatgggacttttaatatttgcaaactaatcaggatagcaaggttataccaataatttctgaagacaaaaaactttctgcattattttattatattgaagaagaaaacttaaaaaaaaattccagtgtcttagcctcaataatctgtacacttttttgcacacatttatctcctaaagattttaattggacaaatggccacatctcagaagcactattgaaaaatgtgtacaagaatgtcacatctgggttcagtctagtcttttattagtgcttgatcagcatgtattggacagaatcgttaacacaaaacaagcaaggtaaatcatccactacacactaccaccctgataaccaccttgtgccactgaataaaaatgtggatccaggagaaatcaaaggacatccttcactcatttgatttgattccagtttagacagggggttaagggtgtttctgcttttttggggttttagtggttctttttagtttaaccaaataccctagctgatcttgcagaaagtcttctggactctgaaataggatggatcatctcatctcagcaaaaacaaaaaaaaaaatcttgacagcataatatccttattggggggtcccatgggccacagcaatacaatgtcacagaagaggcaaacttctgctgaacttgctgcccagagaccttcagttaatctttctctctagaatggaagatcaaaaaaccccgagcagcttaaaaaatatgcagctaatgtcatgtagttaaactgatgtagcatgcatgttgttttgcaagctaaccggttaaatatggctttgctttaagattcccatcaaatttcgtttttatagagaaatctctgaaagcagtaggggttgagggaaggtgaggtaaaaagaaataaatcattgtagtctcaggaacagtaatccttgttgaggattttggctgattgatataaataacatcgtccccgccatctgtccgaagagagacctttccagtcagtgttaagctgcaacggcagaataattaatgaatggtgtcctttgtgctggtaataaagacaagacaaattatgttataatccaactgctgctcatttgtcacagccaaataaaatgtcaaataaaagtgaggggggcactgtgtttgtttaatggactgcaagctacctgtttctgttgttgacagacaactagaatgtaagttttgaatgttgcaggaaagcaaacctccacaccgaagtcgcatttgctcgggagaggggggtgggcttgtagggtgaccatgggggaggcctaacacatcaacattgaagtaagttttaattagagagctataataccaccggctcctctgagtaagttggttgtgattacagtgcagaagcactgcctggaaagtccaagttcaaaacacagtcgagctatttgcaaatctgtaagaatttggtagggctctcatcttgcattttcaggatagacacattcatccagttgctaggaaagccaaataatgaaaacatagctgggatttagcaagttccattgggaattacctatgatagagggcagggctgcacttcctcagaacatgctcctgctgtaaaaattcacaaacctggcattcatacaggcatctgtcgcttgctctaatgccagttcatagtatacatacaaacatctgcttccgtgcacaaagggatacagagcgcttgacaggtctgtgttagcagggttcgcaatgccagttctttatgcaaaaaccctaatgcttcccgtcaagccattagaagtgatacaatcagcccaggccccattaagccatcagtgtccacctgtgataaagatggccatttgttttcttaaagcccacttaatgtctgcttaactcaatttgtcaggaaatgtagaacaatttcctcacagcctgaaatttggtagtggttcaaagtcaaaaggccaggtctagtcctattcaaatgatataataaacagtcttcaaatcgaaatctctcttgagaagctgatgtttactttaaaaaaaaaattatgttagctggaaaagaataacatttgtgtccagtattattattttttatttctaaagtcctggaatatgtctaccagtgaaaaggtccattgcttgattgtatgagaaaataattttattctctttacaaattcagccagaaattggatgtagaaaaatgaaagagggcctggcgcggtagctcacgcctgtaatcccagcattttgggaggccgaggcaggcagatcacgaggtcaggagtttgagaccagcctgaccaacatggtgaaacccctctctactaaaaatacaaaaattagctgggtggaggctattcaggaggctgaggtggagaatcgcttgaaccctggaggtggaggttgcagggaaccaagattgcaccactgcactccaccctgggtgacagagcgagactctgtctcaaaaaaaaaaaaaaaaaaaaaaaaaaaaaaaaagcccttgcaaagcactactctcaatatagcaatcactcccaacccctaaggaatcccactgtaatatgcacacatttactttttagtctaattctatttaaaatatttcccaccttgcttacatttgttggagattagtattgtctttttatatcccttaaaagtgaaaattaaatgactgtttttgaacatattttattgtgaaaatggtataaatgccatatagaggcttactttgcccccatctcaaatcacttttaatcacagggccaatttcctgtgcttaaatgtgtctggtcagaaaggaatccgaagacacttctaagattaaccaacagggggctctcttaaatattccagatacactgacgtcctactgtttcaaattagtggtccatacaaatctaacaccaattttgacttaaaactgagccaaaaaccttaattcttgtttgtccaacaacttctgcattcaaaatatttaacttctggttccttgtgttcccgtggactagaactgggagctatcaatgttaattctaaagaatattttctcagctcattttgcacataaggtacactgaagaattgagtcaactgtctggactagttgatcgacagatattaaatgggcatctaatacttgtagaacaattgaggcaaaattaaagtttagggatatgaatcagctgggtaactatcttatttctctacttttctctgcaagtagagaaaactttaacggacctatttttcttaaagaaaagagggattgatatggcttaaaggctcaggtatgagaaaaaatgtgtgtttcaatacaaatattttgaaatgaacagctgactattttcttacttagaaatgttactgtgacttctcatccatgaactagtgttatgtgtataggttttattttccactctttggaggctcagtccaataagcaatacaattccctaagaaaggatttgattgaggaagagccagaaattagaatatgaaactagaatatatttacatacatggcactgcagggtccttagtcctccttcagactgcaaatatatagtctaaaggcattttatatcttctgtactctctctgcaagtgcccctacgcccaataacttcacccaggagaagatagtggcaaactcagactttgctttcttgattctagaatatattcactaaataaaaggttaactgcaacagaaatacctagaggaaagtctagcacacaattttccctgaagtgatttgatctgtgcaaatagtttatctttcttttggcatagaccaaactaaacgttatcattttaccaacacagagaattacttttattatcaaaataacacaaactcattattgaaaatgtggaaaataaattttaaaaatgaaaaaagaatccatactcctattatttaagcataacttatcagttaatattttggtatattcctaccagtctttttaattaactgcttagcaaaattatatggtatctaaacaattgtacaaaattatttttaaattgcttctttttacagattaaaaaataataaatatttattgaagttaacttgaaatttacagaaaagtgaaaagaaaaattactctaacaataaccatgttttggggctatttcctttgacatgttcattctgcatttgttttatcctagcctgcttaattttaaaacatgtgtaacataggaaaattcatatgtaatacctaattgcttgattttctagtttttatcactttaatagccctccactcagttttttcaataccattattatagatacaaagcaggtttaccaagtattcctacgaagagaagtaaacattatgccactctctgcagctttgatatttttgaaaggaataaaaaacttgtttagtatctctccagagcaatgttccaatgttgttttctagcaaactccagaatgaacagcaccagtcattgttttaaataatcatcaaatgcccccagagctttcacctgaaccatcaagggtggaccacaagaaaggcatttcctgtcaccaagagctaagtggaagccagagagaagtaatccaaggaggcctttggagttttagatccaaattaagtaaagaagatgcttagttttgtttacagtgtctctattcttgagttgtaaattttgattcatcacttagtagaattacataagccttcacgtaaacttttcaagaaagctgtcctattataaatctttgcatacatgagaatgtctttgttattttaacatgcaaaagacaattttgagtatgcacacaatttgagggccacaatttctttcctataaattcaaaagatactgccttgttttcttttaggatttagtgagaaaagtgttaggaaagactaaatgtttatttttttagtcttctttttctctgaatatttgtagaatgatgctctatccttgccatttgaaagttttgccagaatatatcaagatagtataccacctcgataatattttcttagaacctcactgtcattttcaatattgaggtagttttttaactcacaggagttttcttaattttgtgcttgacttgcatatttttcaaatgttctggtttcttcctcaagtatacttataagctgtagataatctcttcattctttgacttccaacatgtcttctttctcatcattttttatgtctccatattctgggaaaacttctctggtttgtcatccgtatcacaaacctaatttttctggagtaacaatttgaacttcagtgcaaaatttaattttgttttgcatttttagttttcacactgtccttcctcaaatcatctatataattgtcatcttattctagtgatcttttcatcttccctgtcctctcctatggcttgctgatccttctcattccactccctgtgtcaaattttattagagatactaagtagcttcttaattgtctagcagttactgtaagagttctaagctttttatgagcattgttctctgagttctttcataggtcaaacgttgttggaaattttgttatgtttactcatctcaaaatgtagaaatgtatgcaacattctatgcacactgatttttaccctctgcttcagctccagccttagcattttgtcttgaagctatactcaaatggcaaatttataatcacagctcttacattaattcttatctagcatacttgttctcttaaggcactagtatcctgacatcgaattttctcccaccctaattccttgactctgtggcactctaaaagataaagtgcataaagcattagaattccaagaatttcttcctaaagaattttgccagtctccaccctttcttccctttatgttttacatatgggactacacaattcctatggggatatgtgccattatcaggactttccttctgccttctacctacaatatcctcagttatacttcatggaaattgctatctttaaatgatcccagtatgaagagaagtcttgatgtgtagcttagaaaggaaggcgactggtgagaaggggcagaagggaagcattcacactacttctaaacagcattaactgtgtaggaaaaagctgcccagttttttggttggcataggcctggaggctttgattctaaaaatcagacacttgaagaaatataaggatgcttctatctgctttcaggaaggcagactctctggttcagtacttcaatagctcatgcaccactggcactttccaattaagaccaacatgtcttcgagtaagttattcttaaatttttgtcactatgttactctcagtccctgtttaaattattataagaattctattatgttttctttgctttgaagcaaatttagtgacaagtttcaagaggtggttaggtgttgccaaccagatgccatttaaaaccaaaagtcatgatttgcatcagctctttgcagagggcatcacactgaaagtttgcaatcaaattcttccttggggtgtgacctctgcctatggctacttctttacagttgctgttgcgtctttacctggaaatgataacgggccccagaggggaatgtttatttttagtcctgccatttacaagggcctttgagcttctaagaagatgcttagagttacaaaatgtaaatcaatcatttcattgtaatgatagatttcagagtattattttttccatttggggaaattttttttcactatctaaaccacaccttggttctttataaaaagaattttggattttacatcatagaaaaaaaagtttctcttggcttgacttgctggtaaggaggtgtgcgaatggtctcaagttatacatttgcagagaaaataccatccagatgctcaagtcagccttttttttggcagacagctaaaaaccataccaaaactgagtctcaagtctttaacaaaagaattccaaaagctcttacctttggaacggacattaattaaaagaagcagtcatatcccccgtgatcagagtttaactgctattaatcagagttcatcacacaattaacactttgaactgattagcaaatgaaattatagcaagaaatgttgaggttaggacagcggacggacgtactctcttgcccaactcacagtccctcatcttttaaaagaagggaaaaaaaatgaagcactctggtcataacgaattgtgcagattttgttttcagtgaggtgtttgccattacatattgcacataatgtatggcactgttaggaggaaaaaattggagtcaaagtggctggaaagttaggtctgctctgtagcactgtgagattgttgacatctgccgaggttggagcgctcagtaagcaggaaatggggtgtcactctgagtggtagtttaccattatcctggcatcctaatgaagtgtctgcagtgcacagagcttctggatggcatcttaacgcacggctaagcaaaagcacttctctccctgtcactgtcatccatctgcctgcaccctactgtagccaatgggatggaaccatgctacaatgtgctataagccatttagagttgcacattgcataatcagtcccatcaaatatgtaaaaaatggctattattggttattctcctcaaactggcacctggagtttgatacatgaaagttcaactttttcaagtactgtttctgctattaattccactccccccaacacattatctaaatgggaatgagttgcatcttcattgtcttaaggcttattaatggattgaaagtgttgtatgaatattcattaataatttcactgtacatcacacttggagaattcatcaatttacaatataatggaatggtcattttctttgtgataaccatttttaagaaaaggacaactcccattgcagattggctgttttcatcttagttggcagggagagtttgaggtcgttcaataggttttctttttaaagacatagagcacttcaccaagtacatttgaattttaagctattattgccaatgccagatgatggaatttggtgttttaatattacctccgatgaaattaaaatgcagtgcaaaagaggatatctgttgttaggtgacagaagtagagcagggtgtgtgtgtaatcctcccgaaacttctggataggttttgcaagcaaggctgcaaagcagctagactctcatggtaagaattgaagtagtaagatggtcacaaagttgaggaggagctttctgtaataggcaggggcaacaataatctgctaaattggggcaggggggcagggagggtagggttagataaataaaagggcataacataatttggttgcatcaggaattttttcacagacattaaaactatggtaaacataacagcggggaagcttgcactgccgcacagtgggaagcttaaagcgtctgcctgcactgtgcctggctcaactacagctagaagtctccgactttcattagcactcaacaattcacccagttccccagaaaaggaggaaacccaaggcagcaaagcccctcgctaattattgtaaatgctcccaggttacagtatttgggtgacaataatggcaagagggtgtgaaactagaaccaaagagtcattctgaaatgaaaaagaatgaaggagttgtttgttgcttgttatttttatttgttttaaaccagtgtagcccttcgtttgatgggtaaagcagtatgttggaatattaggccaccattttacaatgaaattttagaagactgcaccaaattgtgtgcaacttcttttgagcaacggaagtacaggttaatttcacaaatgacctcctccccttggcctccaaatttatgtgagtatatttcacaagtctctgcaacagaaactgtttcctttgaaggaaatttgtaataatacaaaaaattacatggaaccaaatgttgcaaggtaggcagactaacacacatcactgcaagatactgcacctcaggttaaagttgatatttttttccccttcaagaatggagtcatttgagaaaaatattggacttcttcaaaggaagaggggtctactttggatgcctgtaagcatttaaagtgatagtttttttttaatggaatgataggtgtttattcttgctaaatccagactcgggaatctggtttcttcattcatatccccccagctgctgtcagcaatgcagcacaccagcgttccttcatgtgcgaatatttctccagcactcatttgcaagagagtcgaagcaatattaaacaccacatctaaacctcttttaaacacacaaagcaatgggaaaacacatcagaactagaccattgagaaaatcctcctttcaaatttactgtttgcttcacatgctagtataaaatatcccacaaagtcccgtttgtgatccatttgaaacaatcttgatttgcttaaattgtcacattcttcttgcacatttctttctaaatgcaaaaatggcaaagaattctactccctcttcattataaaagtacagaatttctggcttgtttattcctaatggaacacttgagaaagaagaaaatatataaatatctttttcagaagattagttgtctcaatctttttaaaagggaggatttgttcattttttctccatggtaaacaacttgggctttgcactgtaattttccattgtcaaattaatgcatttcattttactgacttgaactcatggttttaaaacatcagaccttttaatatctttatttcttccatactacgtattaatgtatgtcattaggacgttgatagttagggatagaatccaagcatcttataaaagaaatttgttggaggaatcttctactccattataacttactaacagtctgaaagaactcactagcaaaataaaactggtttacttcttataagaacatatttccaagctaaggatttcaggcttggaatgagctgttttgagtatttcaaatcaagcataagaaattttgtctgatctactggtaaatattctattgacaaggtcaagaacagagaaagtctggacaccatgtcagaagagagaataattattttttttaagtagacagtctttcaacttcaatttctaaagtactgcgcaggctttatacagaatgtgcaggaaagtttcttaactataatgaaagaatgttcatatttacatctgccatatatgtggtacttcaaaaattaaaggcgtgaatttaaaaatggctaatattttcaagaaactataaaaagaaaggggtgggggagaagaatacaagctgtggcaaaaatctaggctcagcagctttctgggggaaatggtgaaatgtgactatgtgatttataatgagaaaaggtatctacaacatacaattttctacctagctgcaaataataattcatagtgatgtcccttccagataaaagacctttgctatgtaggacccatgtggtaaaatgatcatgataaatgtcagaccagtgcaggtaacggctttacaaaccattaagattagctggcagttttttttccgatgataacagtaaccatgctgtgactctatgtggtaataatatctcagtcctgataaatgccagagccaggcagaggtgtttatcactcccagttcagaaatgctgactaaagttgccacatgttgcctgtttttcttcttttacaatagtctcacaatttaaaaagctgaatcataaaattattttataacctatttttaaaggattttgatgtttgtttaattaataactctctctgctctcagcgtcactatgtgaccatgtcagatgaactagctggacagtttactatactaaccattatctcctcttcagaggtcttttgttcaaaatgaatggttaaggataaagtttaatatgccttcttcaaaaacaatatttttaacccaaagacaggaaaagtgtttcttaattcacatttttcttaattgtgatatagatcctagttgttttcaagtgagttttctaatcccttataaatttaattggtctaccaatggaaagacacacattgaaaacctcaaaccttgaaaagtatttgtaggatttccacccttatgaaaatgtacaaagataatgcttaatgtaaatagctagttgagtatttgaattactggcttatgatgaaaaagatttcaaatgactcaaaatagtaaagactttttttaattaaaaaaaaggttgtaaaaccagatataaatgaataaatatagtttcaagaaaatcttcacaggaaaattgaattagagaaattcagagaaataaacccatgagctttattttctcagcacagactatcgcctaaggatgaattagtatctttgtaggttacagaaatgtacttggccaccatgacacctccaaaattactttgaagagcaagaaattctaggaaggacaataggatcatgcttttcctgtgaagattgctgctggagtgtcagccactgccttacgctccaattcagacaaatagaggcatcactacaaaactgaggagtgcaagtttggtttaagaactggtttcagattggttagtctgaggaaatgttatcatcctaaaattgattggaccaaagcaatatcccctttattaaaagttacttaagcaggatatggtggctcatgtctgtatcccaacactttggaaggctgaggcgggtggatcgcttgagcccaggggttcaagatcagactgggcaacacggtgaaaccccacctctacaaaaaatacaaaaactagccagacatggcagtgagtgcctgtagtcccagctacttgggaggctgaggtgggagaattgcttgaacctgggaggctgcagtgagctgagatcatgccactgcactccagcctgggtgacagggacagaccttgtctaccaaaaaaaaaaaaaagttacttaaagactaagacttgaatacattttccaaactcgccccaatgtgagatcatagtgcatcataacatagatagatacagccacatgagaaagaaaagatattattactttcctgaatgtatttgtgaatgtatcaagaagttaagcataataattttgaagacttccagaaattgattaaatagaattttacactcgttgatttgtatcaattacacatctgaattattttggaatgagtaacatctcagaagctttttgagtttcacaattatcttagatgatcccttcagttagaagaaagacataaacttcactgacacctacataatgacatgccttatatttaaacatctattatgacaccttttgtaatttatctgcccctccagattgtaaaatgaaaagatagcaaccaactttgtatctgccacaggttgcacacaggcctgaataaatagggttttcttatttatatataagatagatatataatatatatataatttcttaagaaattatacctttatttttaataatttatggctagagagcagggatagaggtagaaggaaacagagattaccctttagaagatcattcttaacatccctcctaagagcatgctgtacatggtctaattccttcgggaccaggaccagaaatggttctggaaacagtgctaaaggggccagtgagttgaagcttccctcatttaacaaatccataaacttatgccaattaattggccagagtaatttttgatactgacaattattgactataaagagttgttcccattttttaaattcttcctaagagggcttgtttattcaaaaaaacagccaaaacatgaatatctcctggaaggagaaactgtgaatacaaggaaatctggtgtagaaaagaggtgatcagttccaactctcaggtgatcctccctagagaaagaaatgtcttatttgagtcagatagattcagttcctgcttggtctttcctgcaagtaatgtacctctcttctcaggttgaactgttttgacacagtttgtcaacatcaaaagccaaacttacaatgtatttgacattgccttccttttaattaaatataaatatggcttttctggggtttggggagaagggcacagaaccttgaaaaattgcaaattgccaactacgggctacgctcaaggcggtggtttttccttgtttatgatgcaatgacacttctatttatgatatactgtaactacttaggaattttaaccaaattctctgataattgacagcattccatatatttacaaagctacaacatactgtaccctgttcctacttttaggaaagcatactaaatagtaaaagtatgacttcatttgatttcagaaacaaccttgaaccaggagcagttatgtatcagggatgatagagaagacaatgagaaagaaatatgttttaagggaagaggacttacaggggacttacttaaatgatcacttactatgtgtacatttatgtgcactgaaatatttaattctacgaaaatccaataagatgtataatttttctgtattttcaagtaaagaactagaagcatcaatagttcaagcaacttgcccaaaatcatacagcatagcaaaaattctaacccagtcttttccagattcctgagaagtggtatgtcactggatataccgattttcttatttataatgtgagtttgaagcatgtgtatatttgtatctatttgtgagatttgaatttgcccccagagcatctcctcttaaagcaactatgagttactcaaagatatttatcaagcaattgttgtcatccctgagatgactcctcaatgggcaactcaagttttggcattaaaaagtgtatcctcagaggtttgtatccagttgtaaggcatgctgaaacaaataaaatgatctctggagatactccttcctcctgtaagcaagcacagtctctaactaaattcggaaatggccacagtacaaaaactataaattgaatagaaactagagaactgctattcttccaaatatagctctgacatatagggactaccatgtttttcatacagggtgcattagacatttcagaataactttcagaagcagaacagctgtggtaccactgacctctttaaaacaaaggaatacagttgtcctttaagaactgtagacaaatgagatgaatattactccctatacattgattactgggataaactggtcttttcttcctctgagtggacctatataacaaagcagaatttatttttaaatgtgatttaacatgaagctataagaacaataaaggcatggatgataaggacagaaaagtgtccagggacattggatccaaggttcttcactgtacagaactttttccatcatcatatacagctttatcttatctcttttctaaaaggcattgggttgtaaacgtgctttagtaacaacatttcatgcagatgaatgcaagtgtaactatcataaaccatattttgaaaaatgtgccctcaaaactataaagccacattcttatcataacattaaaggctatttcacatcacgtaggtgttacttctctgaacagcatggaatcattttttaaacttgtttacaacaatgagtttgatgtagtttgagaagatgggggcaggttggtgaggaatgggtattagtaagaaacagttgagaatcactattggatggaaaaaaacgaagcactataaaaagttgtgtgtgcaattgtgggttcacagcttagagattgaagaggctatttggatatgggtggagaactaaaatggaggtatttcatggaatagaggcaaaaataaatcataatagaataagggcaggagtaaatgcaaatgaaagagggaaagaattatggagttcattacttctggaaagattttgtataagtctcttcacatacagtttgcctaagagtacaaaaagttccttcctcctcccaccagtcataatgtaaaaagttagtgatatctcaaagtcttctcagaaccttcagcgcttcataatgagaaaaacatatgctgaaggagaaatattaatagaaaatgctgtctttcagatgctcactgaatcaattgaagacagttgacacatctttagtaagctgtttatgaatcttagctcattaaccactcctgtattatgtatgctgattccaattcctaatatgacacatcaataaaccagatctgaaaaggtgtcatttcgattttaatgtatccaattgtatttttagatgtttctccacttgaagtgtttgtgttatttcctgattttacaagctatggaagagtgggtgtggtattgatttgaatgaaaaaaaacactgctttactataaccttttcagaagattttgttctgattatgttgtaagaaaaataaattgttcctccttaatatttcagctctctctaagccatggtacacttccccatttagcacttaagtataacttggccacaaatatgcatgcaccaatatccaattgtctgattccccaagaatgtgtgaaagtggaaaaagagagaaaaatatttctataaaatattcttcatgtagaatgtttcttataggcaaacttggaaaccgacatgtacttttcataaggatacttatacataactgacctgctcaccaatcagaccatcaatttctcagcctatcacaaagtatttaggttgttgtgtaatgttgggctactatagcaattgtactttcaccaactggcaccaactcagttcatgaattagcaactacattttgaatgtccctgcaaccaaatagtatgctaactgctgggattaaaaggtgaacaagacccagtggcttgggcctcaaaagaggtgagaggggtgcaggggaaggtgaacatttatatagtactttgttttacttgtaattgtgcttggtacattacatactatcttgtttattcaacaaaactacacttttagatcttattcaaagagagtaagaaacttctccaagaccacacggctaataaaaagctgttacagaattcaaaccaaggtccacatattccagttcatggtcacaactttcattagttcactcactaattcctttttcattcatttaacccaccacatgctagcataaaaattgcctagctttaaaggaaaattccctatttaataggggaatttgacaagcattcaagcagtacaaataccatgtgaagtgttgtgtaagtagaatattctaaatgcaacagaactcaggagagggagagctgactctaagaaagctcacaattattttacctgttggcttaacggacttgactatgtcttaattcctgcccaaacaccatgaaagtgtccttgcaaatcagctctttctaattaagcaacggccaatcttttctaaccccaccctgactggatcatgttccctataagtaaagtttgctggttggaaccaacaagactactccccacttcttgcctgtaaagcttaatttatagctgctacttctgtagccctcaatgtcaactggtcccttttttggagactctggcattaacctgattattactttagtcagagacttcagtgaaattagaaaggtctcttctcctcctctctcctctcctctcatccccttcccagtttcatactgattgcttgcacctagtagttcaccagatcctcaggtaaactgtactggaatcatgccaaactgtacagaatgtatccacctcttgaatgaatatatatatatgagtgtgtgtgtgtgtgtatacacacgcatatatacacacacaattatggttgtgtggtattagcttcaaacggttggatagaaagcattcaagcatccccaatagctctgacctgggcatactatgccaatttcactctcatcttcattaacttgtactttttttctggtttatgatatttcataggccccagttggtcttgtgaagcatcacattttcttaccatcattaagctccaagagggctttttactatttggcagaaaagatgaggtctggtataggctatgatgttgcaactttcttttttttctctttctcgctcccctttgtttcttttttttgcagttgtccaagccatattatgttggaactcttctaagaataactgcaattttgaaagctttgactgtgggaggcattatttataggcctttgtggttttagaaggaaaaagaaaagcttccaagcagagttctactaggaagactgcccccatcccactttagccaaataccatcttctgcaggatattttcctgtaattccttataaaaaaattcttttgcgacaacatattaaagaacctgccagtttctaaactaactctttcttatcctactgtcataaagtttatatatctattgaattggacttttgtaagtacatcttattattaagaactgtatttggccttagtatcagagatccatcctcaaaggcttcagtacacagggcttattttcttatgtcaaagaaacccagtgggccaggcgtggtggcttatacctgtaatgccagcacttaaggaggccaaggcagaatgattgcttgagccctggagttcaagacctgcttgggcatcataaggagaccctttctctacaaaaaataaagtgagctgggcatggtggcatgcacccgtggtcctagctactcaggaggctgaggcaggaggatagcttgagcccaggagttgagactgcagtaagccatgttcacaccactgcactccaggctgcacagtagagcaagatcctgtctcaaaaaatacaaaagaaacccagaggcagacagtgcaggactagtatgactgctccacagattcgagaaagctctttctacctgtgtatttcactccacagagcttcagttccccagattagctcatagtacagccactccatctacattcaaagaaacagaaaggaggaaaggtacacaggctaaaagctaaatcagctcatacatgctctcccagaaggcctgaccaaccctgtcacttcagtctcattggccagacttggtcccatggccactccagctccaaggcagctgggtctattaccatcctcttaacagtgggattgtcttgctaaggaagaagagaatggttattgggtggatgtttgccttacatattagtcttttttatatcttattttccagctgtggcctgtttagaatcatcaagagccctgtgctagaagttaaagtatagaaaggaaagtgcatgaggtgtttaagttcaataaataattatacctctagatgataaggccctggttaaaactgtggaaagatgaattccctagtgtactaagtaaatcaatttttacttttccatctataaacaaaacaaaatgagagaaatcaatgtggtatgcagttttgaacaacttcctattttataaaatgtttatgaccaggaaatatgctatttcaatttttttttctgttttaccctcttattttaaagcaaaaacaaaatgtgtaagggaaaaaggataacatggaaataatttttaaaacaattttcccttctacaaaatcaagcaacaatagaatatttgtaatcaaatcacactatatgtccttgtttagtttcccattgctacttaacactcacacaaacttaaaacacaaacttatcctcttacagttatggagggtgcaagtctgaaatcagtttcagactgaaactgaagaggttggtaggcctgcggtatccctagaggctctgtctccttgcctttcccagcttttggagactgtggcaattccttagaaagcagcccctcatcgcataccctctcttttctgctcccgttgtcacatgagaactcatatcaccttttctgactctcattctcctgtttctccctaataaggatctttgtgattccactgggcccattgagataatccagaaaaatctccccatctcaaaatctctaactgatcatatctgcaaagtcccttttgccatgtgaggtaacatagtcacacattccagggattcagacacggacatctttggaaggcccttgttcaccctaccactccttgtaaaacaggacatttaagaaaaccaaatgttaagatcaggaagataatgtcaaagtcacattgttgttgctttcatgttaagattatctcacagtacagccattctatctacattcaaagaagcagaaaggagaaaaggtacaaaggctaaaagctaatcagttcatacacagcctcccagaaggcctgccactgtcaaattcagagtcaaaataaaaagaaactccttaataaccaggttgagtccacctattccctttgactactgactaggactcttagttgctagtctcagtccaaaattttctcaagaaaattttctcatgtacctgtacctatgaaatcttgttttttccctaaccttcctttttatttttttttccagaaaagcaagacaacaacacaagaattgaagctgtaaaatctcttgtacaaaaactccctccgccaaatcgtgacaccatgaaagtcctctttggacatctaactaagtaagttgtaaggatttctggatgtgtcattttatagtcatttcctaaatgggcaatattgaatttcacatctctaaggcaagagtttccaaatgcgtacatctcgtattttcccttgtagctgaactaggtctttctgcagaagctggagaatgtgttagggataggaaggacaatctacaaaaggaacttctgaaataacttatttttcaaggccctttcaactagtatatgtttgctgattgcttgtcagaaccatcgcctggaccctgggatgggtcatcttgactttgttatctaacataatgaaagaacatgaaatgattcagacatggattcaaaactcagccccaccatgtaccacgtgctggggccacaaataagttacttaaaccctctgcaaccaatttcctcatctgtaaaatgttggctcagattgataaggtgctatccatgtaaatagctaagagaggagtcttccaggaaaaaaaaaaaaaaaaggcaaatgtaaagccctagaagcccctaagagctggaagtatttgaaaagcagaaattaaacccgaactgctaggcccaaatgtggaggcaagatgggatcaggagctgaagtcccaagtatcacactagcatcagatcacataggttcttgtggtccacagtgagagatttggattctattctaaattcaaggaagaaccactgaagaatgctacaattgagggagtgtaaaagattgatctggctgctaagtggagaatgcattgcaaaggtgaagagaggaagacctaatggcagacaaccacagtagtacaggcaggagatattggtggcttgagtggagccctcagagagaaatgggtagagatattgtggagatggatcaggctggacttgctgctggttgggataccattgggaaaggaaaggagaaatcaagtgtgcaaattttgggtttcaacttgggcaagtgaagaagcgatagtatcgcagagatgggtaaaactgcagagaggaacaagttgagtaggaaaagcaggtttgagagctctattttggacatgttaagtctgaaatgactgttactcatttgccttctgttaacaccttcttcagataaggcagagtgcaacgcaagttatgaggttttagctttcatgatatatgcatagtaaaattgaagcctgacagaggttcaaatagattgagcagttttgcttttgtgagattaaatctccttaaacacctcaatcactcataatttgggatgagtcattcctacagattattcaactaatctattacatgatttttcattgtgaatgtaatacatgcaattgcaccccccaaaattaagcaacagtgatgcatttacatttaaaaactgaaatctgcctaccactcttagcctgctgaacagaagtaactaacatttttgtatgtatccttcctgacctgttcctaaacacatgcaaacatatgtgtgtatggttgcttctaatgttaaagtacatcatattgcacatattattatacaactattttgtaactcatatacagacttctatttcattaaacagacttatcttattatttctaatgatgtcaatagtatttcatggtatacacagtccataacttgctaaaccagttcattgcgttagggaacatgttttaatctgactcatcattttctgtcttattttactctcaaaaggggaactttatcttaaagttcagaaaatctcttactattagagtgttccttcttgtcactcccacatactggctacggtgagaaatccaatgtggtttagtgaaaggatcttgggctttaaagaaatagaaagagagacctagagtcaaatccttgctctatgctttactcccattatgatctcaggcaagtaaaatcggattaaatactatcaaccatatcttgtggttatgagaattaaatgagataatgcatataaaacgcctggcacaaggtaagcattcctcaaatgttaattcttttcccttaggatccagacacaccatgaaagcggtttcaagttacaagtaaatactggagtgcttatctcagtaactttaactggacaaagtcataaaacaaatggaaaagtataccctttaatgctatgcaataccttgtcttaaagttcttgagaaatatccgttactctgtcccaattattcccttttttttcaactgaagaaatagctataaaataaagaaactaagagtcagctaaatcctccttcaaataaaataaataaaacacacagaagagaatctatctagttaaaaaccttcaaaggatgacgatcgtccatgtccaggccacataatcccagttttaacaattaatgcctgatcctgttttttacatcccagttaatttcctaatcttgtcagaactttcatttagttcaatagagatggaaatagatgttttaaattaagatttaagatcagattattatatcacttcacagtattcacattttaagattgattattatacatgggaagaagtgttgtttgctagccaccaacctttcttgggtggtatgactatatttcaccctgtaccaatttataaactgggtttaattatgcacgagtgtgtgcacacaattatatcttgttaagcatttttttgctaagtttttgataaacagccaatcgtggcgtgtcatcaaagcctgagaagactaaataagaagattgtttaacaggaatttaaatatattcgtgtttgaaagaatcattagaatgttttccttagtcttaatgcatttggtagttcttcagaaaatctatcgtcaacccttgtatgtagtgtttattccaaattgttgcaaatatatatattttgaagtttgtttagtgagggtcagggaatgtaatgaagtgccaaaaattccacttgacctacgtactctacagtcaacagaaaagcactccatttttgcagagctctgagttaaatgcactcctcaaagcagatcagctatcaactgggaaagcttaatgcggcacagttggactagaaggtaaatgcaaatcctatccacaaaagccagaatttttaaaggattgtgattatattaagcataaggttgcacaatggctgcacaggctgactagtctcagagtccagagtcttcattcttaatcaaactcagggtcaagttctatgcatctgctatcatagcttaagaccaggaattcggaataagctatcatctcaagatcccgtcagccagaaacctttattaatagccattttcacaaactgacattacagtgataggccctggaaggtcctctggtaccttctgaatcatcatataaatggcaaaactgtctctataaaatacaagtgtcaaatgcattttcctatagcctgcttctttggaaaggcagagaggcagagtgaagatgaagttagtgggaaggaggacctagcaagatggtttacttgctgatggatagtagctggtggttgagagccagtaaaggggttaaataataactagggaatcgttaaccttttatgaaccagaaaattgcatgatgtgctcagtgttaatgtaagagtcatctgacagcagagtataggatgaaagaggtagaaagaggagagaacccaggaggtcccaggggagttgcaattggattggagtgatggacgtcaaaaggaaagaaatggccaaaatcttgagatttttcaaaggaaaagtccacacagttttcatttgtctcccatatccagtcagccatagagatacatctgagatttcaatgataagtacttatgaaaatagtccccctgatagcattatttttaaaagcaaaatgagatattgtttagaagggtgctcttttctctgttttccaaaaacagacatgggaaagaagatgacgaggttgtagcaaactaatgaaataggatgaatccgattttggcaggtgtgtattaatcaaggcctctatatgctgctggttgggatggacagctaacatatcggaaaacccgtatatgcaatgtatctcgagaatgcagacttttcaaagtttcatacctttaaaaccagtcacatagaggtgaaaagtttatgcagataaaattgtccatggtagcactgtttgcaacagtgagcatttggagacaatgtaagtgttcagtgataggggagggttatgtagaacaggatacatcatattgccttagtaaagtgtagttcatggtttttattttctttctgcttcaacttggagaaatgctgtgttaaatgttaaataaaatcagagatacagtcttttgcatattcaaagagagcataattataaatatgggggaaaaagttgtgaatgtagaaaagactataaaaatatttactaaaatgttgatatttctttgagttgttggattgtgagagtttcgttcctgtgtttctttttaccccctaataatggtataggaggagacattgaagttaagggaacaaagaaaccaggctttggagttaggctgatctgaatgcaagtcttggctctgccacttactggatgtataaccttggccaattcattcaactctaagcttccattttgtcatctgtcaaagggagattataaaagaacttatttctgtagtgagaagtatatgaataatgcttttgaagagtcttgcatagtacttagcacctaagtattaaataaacattttacatcaatgtattttttaaatgtattatattacatgtattattattacagtattttatagtgagggtaatataattattaatgaaataaatatagcaagaattaccaaggcagtgcaggctaaattactgctaaatttcatgatttccagaaaagtctttatcccatctcaggatctttttccaaaacttgagtttccttactgtcctgactcagccagtttcccagagtcccagtgagactatttcacatgtttgacaagctacatcacacccccattctcatacccaatccccactcttttctgtctcagacaccctgtcagcctggctggcatattgtcccctggtcttagttccaactcttttcaccctccaagtgatagtttgctaatgtgatcatctagtctgccggcctttggggcaggcataaggaaattggaaataggcacaggtctctctatgcctcttatgaagagcctcctctgttagaagagtctccctaatagacttctagttcccttgctttgttgtataacttctcagagtgattttcatgatcagaatttcctgccaagacaaacagaacaccagctttatgaaagcctgataagtaagagattttgaagccagcagggccatactctgtgtcccagtcaccaatataaacactcctagaatcttatcaactacatatccacctagaatcttatcaactacatattcacctggaatcttatcaactacttatccacctaggcctggtgctgccctttggaagtactagaacttttgttgtcatgactattagtatattctagatattgctgaagtctttttccatattttcatttccatgataaaaataatacataattatggaaaatttagaaaataaataaagtctttccacagagctaaatttaactagttgaccagatttcctttgtggcatgcattttgcaagccaaaacaatctcaaatttgtgaggggggtgtaaggactcaaaagaacttttatgtacacattatgcatgcacacattactcagagaaaataaaatgtcttagaaatgggcaacttttaataatgacttaggaagtaatgttatttgttgatttttaaaaatagctttggaagaatatatttgctgcagattttacgtgcaaataaacattattgtaggagacttgcactttgtaaaataggttgaaagttaaaatcttcccttttgcattgactctaaggaagttgtccagctgttcatagaattccaaggtgaaaaaatgatatggctgaatagacaaatctcatggactaatgccaattgaatgcctcattgaaagtagaaactgttgagccccagaaactgttgagctggggctattttgtgaaagtaaaccaatatttaaagcttctctgtggtcttcatggatattaaataaaatattctacaaaagcatgtcagaggcaacttaaatgataatgacctagaaatataagggttgtatcagaaaacaatggagacaaaataattcgtccaccctgtctttaaaatgacactgtaggtatttctgatgttttggtggggagaaattagatatgcttaaagaatggacttcaaagcccacagccatcacccttctctctggtcgtcaggggccatgctggtgacgctctctgcctcccatccaggcctctgaatgctcagctctgctgtgcttttgagcacgttatgtttttctgtgctgtcttctggcactccattctttttctgtacactttggtctttcacccaaccacaatacctgatatccaaagacttgcagacatggatatttttactggaaaatgaggaacctgtgcaaattattattttcttttactctctcttttctttttttttctcttttcctgtgggacacgggttgtgagttgtttgaaataagccagaagcttcatagctcctttgcttttgtatttgaaatggcaccctgatcactttaaagagctaatgtacttcctatgggcctgaaatttctcaactggactcccatagcagaatttggcctggtagttaagaaaattaattactctgatcgcgagggtgaagcaatagttcccaactccccatagtaatcattaaaatgtcatctacttaggagacatcttggcatgggatttataaggtttgtgagctgaggactaaggttcagtgatccttccagcagtgcctcctcgttctagaggaaggctgtgggagataaggttttaagacgggagtgaaattattactttagatctttagatttaacatttgaatggtaacattcaccactgaaaaataggaaacaacaaaacctaaagttgctaccatcccatctatcattgttgtctctattgttaagtgatggccaactgtatgagggtatttccctcatgagaggtaaaatttttaagttgccccacccttctctactatgaatcttggcctttaacctaatggaaagaatttggaatcagaagacatagtctcaggccccattctcagcccttagaaactgtacaacattgagaaaatctttcaaagtctgtaaccgtcccttttgttcaggtgttaattaagtcaaataaattcatatttgtgaaaatgtttggtaactgtaaaattctacctacaaattccttcaggaagtctcaaatgagtgcctgctatattccagacctgaacaaaatcaggggttggaaaagtgtggcccacaggccacactcagcctgcctcctgtttttgtcaataaagttttattgaaacacacatctatttgtttatgttttgcctatggctgctttcatgctacaaaggcaagaggtcacaataagtcataacaaggtacacaaggccaaaaatatttaccatctgacccttcacagaaaaaaattgctgacccttcaactcaatgttaaatgcataaagaggattcctaccctcacgtatcttatcgtctcctgaggcagataaattagtaaacaattataataaacatgatgcaatatctaaaatgctaggagaattctaggcagcagctgaaatttagcttagaaaaatcaaaggatgccccccagaggacatgaaacaagctatctttaaggatgttggcttggcagacaacagacctactgtagggagagagaatactctgtacaagaacatggaagagaactgcaatgtggtaaagaaatggtgagtcctctggaaggattagagaattaggaattataaagagaataaacagtggcagattatgagcctctaacgttgtaaacaagttaaattgtgaagaataccatacagtctgataaggagcttgaaattctttctgtaggctaagcactgtcgctcactcatttaatcctagcactttcagcggttgaggagggaggatagcttgagctcaggaattccagatcagcctgggcaacatagtgagaactcatctctacaaaacattaaaaaattagccagacattgtggcatgcatctgtagtcccagctactcaagtggctgagacaggaagatcacttgagcccaggagttcggaggctacagtgacctatgattttgccaatgcactctaggcaacaaagcaagatcgtgtcaaaaaacaaaaacaaaacaaaacaaaacctgtagacattaggaaaatcactgaaggatctcaagtggagaggtaaggtaatgaaatttgtattcataaagaccacagtttttataagagtgaaggacagcttgtagaagggcaacaccagaagtagggaaaacagtagaatgctggtatagtagtccaagctagagatccccagctaagggagtgatagggagaatgggggaaagtgatggatacaagaggcattgaagcagtagatgcaacagaacatgtgcaccaagtacatgcgagaggttaggaagacgaaggattccaggatggcacccagattttgaattagctgaatggtgatatccttaacttacatttcacataggaaaaggaccaaactggaggcatgaaaaaagcagaaattttgttaacataatgtgacttgctcattgttatattctattagcaaaatccagtcaaggataagatatatatgtttggaatgcaagaaaggtgattgagatctagggacaaattttggagttgttggtttaaagatggcaatggggtaaggtcatgaatgcctccaagggaccgtgtgaacccagaagagagtcaagggtgaacccagaagagaatcaaggacagattcctagagacttctaacattgaatggatggtcagagaaagagataacagaaaaggagtctgagaatggcacgcatattgatagaaaaaacatttggcaagagcaaaggtatattttgtgatgaaaactactcattacacaaggaacacctagaataacctcagcttaacaggacactgggcagaatttataacaatgaccagttactgttcttaccttcacccttcagctttaaaaaaaaaaaaacccacaggaataagtataatctagcaggaaaaaaaatgatattctatagcatagccaggtcctgaaaatataaagaactaacctggcttcttctgctcttagagcactggctccagaagggcagaaatttgtgtcattttgattcctgctatatcccctagcaccgtgtcctacatagatactcaataatttttgttgaacaaatggaatcgcgttacttcattgaacaagatgataatctaatagccagtgagtggttccaggtaacatcaactacgtaagcctagtgtattagtccattttcatgcttctgataaagacatacccaaggctgggaagaaaaagaagtttaattggacttacagttccacgtggctgaggtggagagacctcagaatcatggcgggaggcaaaagacacttcttatatggtggcagcaagagaaaacaaagaagaagcaaaaatggaaacccctgacaaacctgtcagatcttgtgagacttattcactatcacaagaatagcacgggaatgaccagcccccatgatccaattacctcccgctgggtccctcccatagcacgtggaaattctcagagatacaattaaagttgagttttgggtaagaacacagccaaacatatcattccatccctgaccctccaaatctcatgtcctcatatatcaaaaccaatcatgccttcccaacagtcccccaaagtcttaactcattccagcattaacccaaaagtccacagtccaaattctcatctgagacaaggcacgtcacttctgcctatgagcctataaaatcaaaagcaagctaattacttcctagatacaaagagggtacaggtattgagtaaatagagccattccaagtgggagaaatcagccaaaacaaaggggttacaggcccccatgcaagtccaaaatccagtggggcagtcaaattttaaagctccaaaatgatctcctttgactccaggtctcacattcaggtcatgctgatacaagaggtgggttcccatggtcttaggcagctctgcccctgtggctttgcagggtacagcctccatcctggctgctttcataggctggcatcgagtgtctgcagcttttctagacagacagtgtaagctgttggtggatctaccattctggggtctggaggatggtggccctcttttctcatagctctactaggcagtgccccagaagggactctgtgtggggactctgaccccacatttcccttccgcaatgccctagcagaagttctccatgaggaccctgcccctgcagcaaacttttgcctaggcatccaggtgtttctatacatcttaaatctaggcagaggttcccaaacctcaattcatgacttctgtgcatccacaggctcaacaccacatagctgccaaggcttggggcttccaccctctgaagccacagcccaaactctacgttggcccctttcagccatggctggagtggctgggatgcagggtaccacatccctaggctgcacacagcacagggaccctgggcccagcccatgaaaccactgtttcctcctgggcctctgggcctgtgatgggaggggctgccatgaaggtctctgacatggcctggagacatttttcccatggtcttggggattaacattaaactccttgctacttatgcaaatttctgcagctggcttgaatttctccccagaaaatgggtttttcttttctactcattatcaggctgcaaattttctgaacttttatgctctgtttcccttctaaaacagaatgcttttacagcacctaagtcaccttttgaatgctttgctgcttaagaatttcttccaccagataccctaaatcatctctctcaagttttaaaatttcacagatctctagggcaggggcagaatgccaccagtctctttgccaaaacataacaagagtcacctttgctccagttcccaagttcctcatctccatctgagaccacctcagcctgtatcttattgttcatatcactatcagcatttttctcgaagccattcaacaagtctttaggaggttccaaactttcccacattttcctgtcttcttctgagccctccaaactgctccaacctctgcctgttacccagttccaaagtcacatccacatttttggatatcttttcagcaacgccccactctattagtaccaatttactgtatcagtccattttcaagctgctgataaagacatactcaagactgggaaaaaaaaaagaggtttaattggacttacagttccacatggctggggaggcctcagaatcatggcaggaggtaaaaggtacttcttacattgtggaggcaagagaaaatgaggaagatgcaaacacagaaacccctgataaacccatcagatcttgtgagacttattcgctatcacgagaatagcatgggaaagaccagcccctgtgattcaattacctcccactgggttcctcccacaagacatgggaattctgggagatacaactaaagttgagatttcggtaggaacacagccaaaccatatcacctggaatcttagaaacttggtattttcagactagtactaggaaatattccatcttaagggtattggtaagcaagttcttcctctcaagtttatctcccctcacctgatatttttcttttcatcctgacaaacaagcagagctcttctgattataaaaataataatacttttaatggggctgtttgtttttcttgtaaattcgtttaagtaccttatagatgctgtatattagacctttgtcagatgcagagattgcaaaaactttctcccattctgtaggttttctgttcactctgatgatagattcttttgctgtgcagaagttctttagttcaatcagatccaatttatcaatttttgcttttgttgccattgcttttggcatcttcatcatgaaatctttacccgtgcctatgttctgaatggtattgcctaaattttcttctatggtttttatagtgtggggttttacatttaagtctttaatccatcttgagtttatttttaaatatggtataaagaaggggtccagtttcaattttctgcatatggctagctagcactatttattaaatagggaatcctttcaacacacattggggcctgttggaaggttgtgggggtgtgagatggtggatgggaggaaggagagcatcaggaagaatagctaatggctgttgggcttaatacataggtgataggaagatctgtgcagcaaaccaccatggcacacgtttaactatgtaacaaaccggcacatcctgcatagttactcctgaacttaaaggctggaaaaaagagatactcttaatattaagactgcatgttaaaagggtgcaagcactacaatgaatgagttctaaaagaggctggccacaccaagggagactcagtcagggaatctgtgaccacccatcagtgatgggtggagcctattagatcaattactgcagtacatagtaaaattgccagttcttctggtttcttatctgggattagtagcagatcttgaaatacaaaaatttatttctacatcttctgtcataattctcactactaaataacttctaccacttctagctcctatcaggtcaaccccaacttccttgtctatcatttgagatccaatattgccatactaccttgaattatttagcatcagctgaagaaaaaaaaaatcaccttgacttaaaaagcttgccctctgcttttaagtgtataaagaaatttggttcccttgttttatggagcaaacttcaaagtggaagggagaaaaaaatcaagcagacctcaagtcacctgatttccagtccactaaaccacactctgctttcttgccaataccaatactcgattgtgtttccagggaagaaggaatggtaaaacaaagagtgagaaagctgagccaactgtgatagaggcacaggccaatccctcagactccttttttctaattgaacaccagatataatcccagccctttaaataaaattacctaattaatcctaattaattagtgagcccttatatttatagaaggggttttcttagtgtctgtcttctcaccctccccacttccctgcctctactacatttctttccatctaaaaagaaaagtttcatttttaggggtcctttttaaaaacaatttccatgtcaacatttattaatgcttgtgtgtgtgcatgcatgcctgcatatatacacttagagcacgtttttttagaaggcagtaatggtgctgccttttatcaccttctttctcctctttaaatggaaagcactgaacccagatgcccaaccacggaagatattcttccagaagcagcatctggcttcctggcaagcccttcaggcaagttgtttggggagcattgctgttgtctctcggtctgtcacgtgtatcagataccgtggcctctctggctggcatgtcccggtagctgccaattcctttcagttcacctttaattctgagaaactagtttcctcattttcatttcttactggacttatttttctccccactgcccataggaattccaggacaaacctaagtcctcactgctttctgcctgtcaagctcctttccagacctccgtcttttgaacccaaatgaaaacctcagccatttactcctacattaaaataggttattttaaataatatttcttagccacttcttgtcagcaaagctccttgtaaactgtggagttgttccctgaaaagaaaaacaaaacattccatccgagtcatttattctggtctgtacacaagacatgaaagtgttcttgacatttgtgtattatttagttaaatcgtattggctccctacatccttgtcacaccatgaacaaaagagcatcacggggctgggaaagacgagaccatgctgcagttagtcaaggctgtgcagcctttacacatagcacccgctccaggaaactgcatttcttaaagtggcttttttttttttttacctgttaatatatattttttaattgtgaaggatcttctggggttttttatggataattgttaagaacacagagtccgatggtagcccacgcaacaggaagccgtgacaaggtgctgacaagtccggcagcagtacccagaatgcagaggagaaagcagaaattagagctgcagggtgacatccaggaatacttaacacagggtatctgcaaattttcatgtcgttggggtttttttttctcatgcaagaaaaaagtacatattatatatgagatttcagttctcaagactgtaatgtctaggctgagaaaaggctgaagttgagcaatggacaggaggaaatctcagccataaataatattttgtctgtagctagtagcagactcaacccacacttgactttgaagcagtacataactagaaccctaggcttcacttgaatgagagtccctagggggcaaagaaaggaggttaggggctgtcttggtcaggccattgggaaaaatcttttttggaagtagctacaaaacagtagagctcaaatttaaggttagcatttttgagcctattatgtttctgcctcaatgacattttttggtctataatttttccccagctccattcattaatatgtaaaaagaaagtttaaaaatacatgccaaactcacaagttttacactacattattgcccttggtatagaggttcctgtatcttatttctggtcatttcttctcctcttctatatcctacccatattctttttaactaaactgtttcctcatacatttttccactgttctctacctttcctcccaatattcatcatcctctgcagattctttctcttgtctgtactctgaaaactcacttcacattcaaaacattgttgcctacatcatctgtccacacatttattcatgaaacaaatacaggttgagtacttactgtgtggtagatgctgagctggaaatgaagacacttttaccaggaaagcaataaagctctaggatctggaagcttcccttcccatgtctgggagtgttcacatccctcaatctcattcttaatccccattttctggctctatatccttccacttctaacaggaatttgtaaaccagcctatttttaacaggcattaagtcagtccttccattggactaagtaaaccccttctcttctttctcatttcaaagagacaacaagtagaacacgttgggacagaaccgctgtaaggggtgggcaagacataggttggttctctggcactgaaaacacctcttttcctgctctccatgaactgatggtcaatagacgcctcttcatagtcttccctatatcaattttgtacattcatttctttacttcatttattgattttcatttacctcccatagagtttgtgatacgaaaagataaagaaatcactccaaatgaacttttgtctaattaatctgtgtatatgttgttgggcattaaaacagattaaatttgcttacatagtgaaaaggcatgtaaagtgatatgttatctaaatcagaatttttttccatctggacacttcatagcaatcatttcacatctcagaaagattccattctcaaacacatctcttctttgataacagcacaactctgcccttgcaactctgccctcttggcttcctgctcacccatcttttccacttttctttcatttccaactgccattccagagccacgtacttcccctggtgctaacttttaagtcaacagaagggaattccattctctctcctggtgccacatttcctatttagggccagatattccccacagagatattgaggcattttactgctagtttacatgtcctactatatttttctaactagtgggaaaaaagaaataaatgtacgccctgccctctctgacctcatcttcctttcatatcacatttaaaataaccaattcctggagtggcaagctcttaaagcaattcatacttccctggcaatcacagaaatgtacccttcatcttggcagaggaaggcctatttcttccacctgttgtcacattctttttattctctgcatgggtttcccacacatacaccctataataagttagataaggttagaagcaggtggctacatagagaatcaaaagaaatgttcattgtcatgtacgagaaatttctgatcccaaagcacttttttttccaagaaatggtaatatatagaaaattggcctgcagttagttgtatgtaggattgtggatactggggagagtgggggcggggaagatgatgaccagagagagcgttttgttcgtcatgaatgcagctacctgaaaaacactagctaattagcagtctgtagccacacaacacagcagtttagtataagaagtgaacaatactttacctaattgaaactacagagcagacttaggtaggctgaatgtaattacacagattggaagtcagccaggacgccgaggttaacaatcccttcactcacaaaaagcaccacgggaactttaatgaccacaagtggtaagggccgctatcctgcagcccagcgaaaggcctcacctctcgcaaccgagactccatcagaagagcctaatggcgtcaactaattgctagaaaaaaagactgccctctatcgacgcagatgcacctgtgccgtgtgactcattcaccaagcacagtaaacacttttaagtactagggcgaagggggattcgaatgaatgagggcatcgagggggtcaagtggtggacaataggaactgtgaagtctcctctgcctgccggtcctgtggccagcacttctgctgcactagcttccctaaaagaggcacacgacttcccaaacttcagtgtgctcacaaaccaaattacctagcaatcttgttaaaaaatgcagattctgggtcgggcacggtggctcacgcctgtaatcccagcacttttggaggccgaggcgggcggatcacaaggtcaggagatcaagaccatcctggctaacacggtgaaaccccatctctactaaacatacaaaaaattagccaggcgtggtggcgggcgcctgtagtcccagctactcgggaggctgaggcagaatggtgtgaacctgggaggtggagcttgcagtgagccgagagccactgcgctccagcctgggcgacagagcaagactccgtctcaaaaaaaaaaaaaaaaaaatgcagattctgattcaagaagtctgggatgaggcctgagattctgtacagagaacaagctcccaggtgccactgctgctgctggtctgcagaccacactttcagaacaggatctaaagacaagaaacaggaggaggaaagaggttctctgtggccaagaaatcaaagtctgggctaaaagaaagaggactttaacatggggtttgacacccagaattatcaggtttgcatcatttgtcctaggaactaaatgaagcagaaacatggagtgtccaaaataataatccaatccaaaacccactctcagaatggctttttccatggggagaagaaaaggtaaagaacatggtctctgaatgtgctttataaatgaggtgcctactctgcaaagtgtccagctgtagtgctgtggcagggggatatcagcagtggtctgtcaggacctgcaagagccaaaagtgtctgactctcaagatgaatcaagagaagacaagatggcagaatgcaaattgtcaaagcttaacctatgaacaaggatgggagtaataattttccttcaaatgtttgcaaaataaaatcaaagttgctgaaaaacgtggacctttttaaactttttttttttttggaaacggagtcttgctctgtcgcctaggctggagtgcagtggcgggatcttggctcactgcaagctccgcctcccgggttcaagcaattctcctgcctcagcctcctgagtagctggaactacaggcgcccaccactgcgcccagctaattttttgtattttagtagagacagggtttcactgtattgcgcaggctgttctcgaactcctgaactcaggcaatccaccggcctcggcctcggcctcccaaagtgctgggattacaggcttaaacttatgttatgcaaacatggtttactgctgtgctacctagacttccataataaagcctcagtatagcattaaaaacttaattgttggttagattaatttgtattctttagttatttcctcaatgctttttatactaatttctatgtattttgtgacttcttaatgacagaattcactttagatacttgaaaagaaacacacacacacacacactcacacacacacacacggcaagacccaattaatcactggttggtgcagtatggttttctacgtttagacatgctgcaaacatgttgtaaactagataaggctggagtttaaatatacatttatcctaatatatacctcatcagtatagctgtaaaaaatgccgttacttgccaacaatatataaatttaggatatccttcaaaatttatcatttgaagtgttcagctacctgaagctggcagggcaaagtacatatacaagcagaagcacataagcaccaatgaatgaagcatgcctatggagtgcctgctctgtgttccatactatacgcaggaaagtggagaagataaaagtgtgcaatcggaagtctaaggttttgcctttgcagtgctactaatgtaacaggaagggaacaaaacacttaagaaaaaacagaacagagactaattaactgttaaacagtatgtgcagcctgtaattcaaatgagaaatgggctgaaagagttgagaagtctccagtgaaaggtggagctggtgagatttggatgttccatggagtggctggagaaaaaccaagagggaaccaggatataggtgtgagcagcctgtcctgtggccagaggcaaaggagaaggagagacctgagtgcagggtggggccaggttatgggtggggctggcagaaacttttcttggaatctgacatctcaggctataggaaaccaaggcaggttactgagcagttgaaaaatttctgcttttgtatttaagtacagtcacacaccacataatgacacatccatcaataatggaccttacatatgatggtggtcccatgagattatgacactgaatttttgctgtatcttttctatatttcaatacacaaataccactgtgttaaaactgcctgcagtatttagtacagtaacatgctgtgcaggtttatagcctaggagcactagcctaggtatgtagtaggctataccatctaggcttgtgtaagtacaccctataatgttcacataactgtgaaattgcctgatgatgcatttatcagaatgtatccccctcgttaagtgacacactgccatctcaaacaacctatccattggtcctatgtgaaatggacttagggatggaggggctgaaggaggaggctggggctgaaggaggatgctggagcaaagccggaaagccaacagttctcttaacgtgactacggagcaattgttttggtgttggctgtggagctcattgggaagagaggaattcctagggcagctttgaagtaggtcaggagtattcgctggtatttttgatatgaatctccacaaaggactggaaagagtcccagacagtgccacagggtgcaatctatagattaaagagagtggtggtgccactgataaaaccaggtcatctgtgtactcttactgagcacctactgtatgccaggcactgttctaggagcttatcacacatcggtcaacttaacaaaaaccatccttgccctcatgcaggttaaaagggggagtcagttacagccttttgcgtaggaatgacatgaactgacttccgttttaaaggatcactgtgttgatagtacattctaggtgaacaagagtagacacagagaaaaactgtaaattatccagttgccaatttaattagaaagcagtatttgtgggtggacagtgctgtgtgcatctgcctctgataggttaagagaatctaaagaactgggctccagccccagcttcagtatgaggttccacagtgacttcaggcacgtcacttcacgtctcagccactgttttatcaccttatcatagaaataatacctaatttatccaccttcatgtgtgtgtgtgtgtgtgtgtgtatgtgtgtgatctaatgacataaagaaagtaaaatccaagagtacatactgttgcttcaagtttgccacaattggaaacccaagcagagaaattcgatcttacattaaatccagtagctggagtggagaggtcactggattcagaagcagaaaacccaagtttgcatcctaggtttatgactctaaccgtgtcaccttggataacagcttctctgagtgtcagtttcctcttcagttacaatacctaatacctcaaaggacttttagaaaattcagagttacatgtgaatgaaagcccactataaactctaaatcatcgaagagacaaagttgtttcttaccgccctgtcaggctctgactgcaaccatagagagctgtactactacccctggtgtaaaattgtaattaatccttcctcatatgtgggttaactttaatccttcagggcaggaatcattttttcctggaccttgtagtgttccattgaactggtagagagtcaagcaataggaggtatttaacaaatcattttagcaagtgggtaagtggaggtgtgatattaaaggaggaaatgtaggtttgggaattaggtttttagaggaatatttcaaaccatgaaagtgcgtgcatttaccaagcatgttcagagcccctgaaaaaaggatggagttaaacacaactttcggacaagcatagtaagaataactagccagcaaaggaaaaaaatgtagaaaataaaattcacaacgatcagcattataagagtctgaagagcatcatcaaatagtaatacacaacttctgctccaaaaggatcaaaaaacatttcaattcgctatttcacagaaatttcaatcagaaatgtctaataacctccacccacttatctaataaccacactctagcacagagataactcaagttcctcaggagagcttcaagattcagaagttctttctgaattaccaaaggataacaatgtggtgtccattgtaattttaatactaattttgttgttcgattattgttaatccacatatgataagtgtttttgaccagagcatttgcttaatcagaaccttctatactccatctaagtaaaagaagttttattgggaatgaaagaaaattgcacataaaaccttttttcatagcctgtttcttaaggacacagcagtcaatcttgtgacatacctagccaataatctccactgcctctccgaagcccacttctttgtgtctttttaactgacattttggaattcacctgaaaacaccaagaatttgccaagacaaatttggcctgtggagaagacaccatattcaacaccaatctggagaaaacaacgtactctgctcttttaattcattatgattttaacatttattatcacatcattatcacaatttgaggattataacttgttctcagaaaactggcccctaggcaataaagagttaagaccagaaagttcactccctgtgcccttccttttttcttatcacaacccctccttccctgtggttccacaaaatgaataatgccttagacatagttatggcaatgctaatatttgaacagtaaaagataccttaagaccttcctcaagattttttaaggactcatttaatgtcagtgtcaaggttctgtgaggaataattaatataacaaaacaaggtctatgtgcccatcgattgccagggaatttatgcaggtaactcattaatgccggtgggggttcagcatgtaaatcccgaagcctcgatgaggaaatgggaccaaatgatttttccccctataaaaaacacaaacaatgacaagtataaaagcagataacctgaatatctatacaaacagctatatggcttgtaaaagttttccatttacatcctgtcacctcttctttgtgcatgtataaaagatgggacaattatttcaacaaacctacccatataaatcaatgcagttttgctgtgggaagactgggtgtttaaggcatttaatatttcagcattgccagattatcaccaggatccatttcgcattgtggtcaagtgcatgattagcactgtgacagggtattggccattttcatatgaagatctgcaaatcctagtaaacaaataccagttggaaaaattaagaacaagtctgtggactggaatgcaccctacttgtaatgggaacaaaaagctggcaatcaattttaaagaaaaagctaaatcacagcagaatgacctactttaaggcatttgccaaagaggcagtgtttttagacagctcttctaaagtagcgtctttctgtctatgccatctgcagatttattactctgcctgaaaaaaacaaccaaaaaaaaaagaaaaaaaaaagctttatttgaatgatactgagagcctggtctataggaaagattccagtattgtgggtaccacacccacacctactgatgtggtccaaggttttgctttagaggcacctaattaagaaaccctgactcatttacatggagacgtttgatctaaattacactccaaaccacaccaaattgggagcatctgtgaatgtgaaatgtttgttccctgtgacggctagaacagggccagctctggacggcacatgttcaagtgacgaaaaatatttcacatgtaacgtacttctgagacccacttttccactaataattcatagtgaacctaaccaagtatctgtacctccacaattatttcaggctgtgaaaaattatgtcactatttttttcctgctgcaagaaagaagtagaagaccacctactttgtttgctgtcattgataaagggccttaactgcagccaatagcaaaaggcaaacctggatagcacaaaggctggtcactatatagatatataaatctcagcttgggatccacagacacagagcagtgatctaaagggctaagtctcagttaccccctccatcactgccctaacctcttccagcctttccactcggcttgctggttctcagcaaagctttgccttccaactccactgaggctgtacttgtatgcaaaagagccagcccttaggatgaggtgagaatattgatagggtagaggtagcatcaactgcaattagaggacatgtcatttccactgggtaaaatgtctaagaaagtaaaaagaaaacatttctgccattggatgtgatgaacagtactcagcctacagttcacacgaaagagtgttgtatttcaagtataataaacagagttttatagatacagtcaatcctgcactttggtacctgatggccgctttaccttattcggccatatatcacctatatttcagtgggagtccaaggaaaaagaaagaaacttttaaaaaaataacctcaggttcttttgtttaagaaagatattaatgcatttatctgatgtactgttttttgcagtagctagaatgagatttgaatatattaatattttcagcagcagagcccagggactccagttaataacttatggatggctacatagatatactttagacagaggtaaggttttcagctctcatgttggtaaggctcagacagatcgaatgaacggggctgttctccatgagtctttgttgtgggcatgcattgtaatggtatggagacagagttcttctggttgtctacacagcctggattcaataaactgttatatatgcatattatgacaatgtggtcaaggaaaccagattttttttactctaccttcaaatgcctatggagcctaaatctggtgcttatttttcttgtcctcattcaatatgttaacatattcataatttgacacaggttacgtttgttttataattaaagttatggagttagctggaaaagcattcagactatactgaattttttaaaaatgtgtatcttttttctatattatactgcagtgttcaatgtgaatctgaagtctggataatcccagactgtgttagtttgctagggcagccataacacaatacgacacaccaggcggcttaaaaagcagccatttatgttctcacacttctggaggctggaagtccaaggtcaagatatcagcaggtttgttttattctgaggtctctccccttggcttgcacatggccaccttcttgctgttttacccttcacgtggttttacttttgtgctttttttccctggtgtctctctgcgagtctaaatttcctctttctataaggacatcagtcaaattggattaaaatccaccctaatggccttatttttaacttaatgacctttttaaaggcccagtctccaaatgcagtcacattctgagctaacggtagctggtgccttatcatataaattggggtggggttaggtgggataactcagcccatatcacacacaaagggtatattcacatccaagctgttgacatgccccgtaccaatgatgtatttatttgagccccaaactaaaacctaaattaatatttgtaagtctggagtattcttctagtatgatttttcagtcacatcctctatgggaatgaaacaatgatgactttgtaaggtttaggggaacaagcagcagcatgactcttctcataccttcttgctagactggaaggaagcagttcctgtgtacagtaagtgttaccacagtgcccgaccgagccccaccccgccttcagggaccccggtctagaggcataagtgcctccctctccattactgccgccctccattaggagcagataatgcgtgagctaccactctcacaataaaacattgcacttacaccacacctttcaactcagcatttccaaatgcttgaaaaatcattattatttttattatttatttgtggaatcccagcagtctactcagcactgggaagtgcagtgaaagccacagagctatggtctcagttacgcagacttaaaccgacactcaagtttcctccgcgatgtaccagtaaaaagtctgaaggtggacgtttttgcatgtgcatgcatagcaagaaaaaaagtgaaaaggcaatttaggtctgagttacccctgcggctcacatacctgagaaaagagccatttgttagtattgttctgataaatgaaggacccaagcaagaacaaagcaagaaagcaaacacagttttagaccctacagctcagaaaatggaaatgcatttccctaatcaagggcatctacaataacacttttaaaaggattattaagcaatgcaggaagtagaaatcaatcaggctctgcttgttgttcactggtcattatttcctgggtcaaatctgcttgacattcaatttaatacagtctttcatcaagtcaaaaggccttagagagaaactttcactggccacccacattttcagcagggctgttgcctggtccgattcacttttgttttccaagtctttaccatcattgcatattacgcctacttctattgaaacagctactgcttttgatgatttccacagtggtgaacatatattgttcatccctgtaatgctagaagctggtccagtgcttggcatgtagtaggtgctcaataaatatgagatctgtgaaaaacaaattttcaccttacaaaggcattctcaaaatgaatttgacacatcctgctctctctacaaagttacaagctaagatagatcacagcaaagcagagatattgcagacacagattgaaaaccaagtgaaataatgatttagattgccttaaatcaaagtgactaaatgcatttttagaaagtacatgttgaaagttatcttgactagtcttccatttagccaggaagttttctggaagaagtataagtttagggattttttgtgaggtgagagggagaaatcataaataagtatgtgttctagaaagtggggtaagaccacagaggagtcctaaaggtattaatagaggtcaggaattggactttagaaaaacagaagaggcaaggaattgagaacagaggaaaatcagattacttggagtgttctaatgaatggctttcaaagaagataaagaccaccatatatagaaagctactttgaagatataaaagggtttgttagtaacatgactgggcatatactagagtagaaattccaaaataagagctgccacaacgcagccaaagtgagaagatatttctctggtcacctgtgcttggtgccagccaccatcctctactgttcttcattgtccctagagctggaggcttagaaaggcctagacacacactgtaatcgtatgtctctttcagtttgctggagagtgactcacaaaagggtgtttcccgtgctgacacaaaagtatgcaatatttctttgtctttcaaactggtaattcataaagactgtatactattccgtattggacaatgttgaggcttaaatatcctaagccccttataagaaggatgctgcaaacatgagaataaggggtgtcttctgaaaatgagtgaactaagccacttaggaagttgctggcctcatctcgaaacccaccaaataacagcagtacagctagaaatagagttcaaaagtcaaaagtgcctggctgccctaaaattttctcattgcatgacttggttcaaggggcttcattatattttgtatttagatttcacacgtttatattccacagtgcagtgtctctttaaaaatgtaactgttgagtctaaaaatcaggaagtagtaaagtggcttccagatacatatagaaggtttttgtttgggtggtgtgtgggaaggggttggttttgtttttaattttgtgcaatttcagtccagtcaacacctagagcactcctttaaaaaaaaaaaaaaaaaaaaaaaaaagggaaaaaggctttttttttttttttttgattcagtgtgcacagaatttattgcagacatctgggagtttaaccagagacatccaagaggccagtagaagtggagcagcaatagagagtaatagttgacttttatcctcatttttaagagggaaatggtctattggttttagaggtgaaacgctagaaaggaaactgctcaatcctctcatttcaaagatgagcaaacttgggactttcccaagtcatctagccactttgcatgttctataacccaaatttactttaaattgtggaaagaaaatggaaataaactaccttgaaggcatttgagctccaactgactaattattctaggtcgttaaatacagttagagttgttagattttctggtttccaatgggggtaattccatcacagagattccttttctatcaaattgttggtgcttcattttcttagctctgcctggtggtctctattacctccatataagaaggcttttcttttccaccaaatgaatgaattttctcatcaattccagtcatgcctcatacatctccctctctaggactttctccacactcgtccctccagttcaggttcctctgtgcgctctctgcctatcccagattctaccacttcttcagaggacctggctcaatatcctgctcttttagatctgctattcagagatctggtcctaactgcagagacttttccatactttgaattcatagcctttcttatgaatagctgtaaaggtgaatttgatgcttgcatatagcatagtgaatttagggcaaaggctatgcttattattttttgattcttgcagaatagcacgaatagacacaacttattgaatactaaccatatgtcccatatcttgctgaaaaattttaaatacatgttctcaattcaacaaccatgtaaagtcattattatcctcaatttatggaagcaaaatctagcatccagagagaaggtgttattttcctagatcaaccaactaaaagtgatggggtcagtatttaaaatgcaagtatgtctgaatccagagcccctgtggccagcttctatgcaaaattgccttccttctcagagttacttgcacataaaaatcactaaatatttgtgaattagacagatgaatgaatgaatgatttggaacctgttcctttcaccaatttgacttgcaaaagggaaaataataagaaattctgaatcttgttgcctctggacagatgtggtcagttagcacaagcaaagcagaaatgttctcacaagttaacagtaaaaatcactggacacctacatggaggtaaaatgactcacagggaatgaagcaagcctggaataaaatttggcccaaatccaacaagcatttggaacctcatagcatgcatttggaatactaccttcatcccttattttttcttcacctttattgtcttagtcattttaagtatattttaacttttttatattgaatgcatttttaaaatgcagtatattctttgtggaagtattaatcaggttaatatgaaataaaataagattgatgctcatatttacaaagtaagttcagaaacgtttactgacagggtagaagtaggtagctcacaacctcacatttaattttagccaagcatagaactataactgtgaagctgtatttcagggaagatctaaaatgtatggatttccaggaggtgtttaaataatacaggttgtcagtattaaaatcagaagtgtttaaaggccaatggaaaacatatgagattttcatagaattaaaaaaaaaaactcactaaacagtacacatagctcctggtttgaaaatgattttatctttaaataccccataaggtttgcaaactttaaaaaacagagatgagggttgactaaaagacatggttttcttgaagtttcttggtaaagtaatatcaagataataaggaaaccctccttccccatttttgtttttgggttttttttttttttttttttgagcacaccagatggcatttctctctgttgccatcactgacacacaattatgttttctaatagagagggaggctgggagccactgatctaccccagtcatgtcacatgaatatctccactttcataaagaaagtctttgtccaggatttctccagtggtggtaaaggagcagtaatgttgaggcaactctcagttcatgggaacaaacttaggtcaatggatgagccatggtcaggaggtcagttgggagaagagaaagagtacttattatcaaatcgtcattgtgccctctgctccatcagcgagcatcattgtctaagacaagttctcaaggacctctgaagaatctgagttgagccctttctaggaatgctgaaaaggatggagatctgattcattttaacggcaggcatgtgtgtgaccaaataaatcagatccctgaagagtctttttccagatgcatatgtagcatttgtacttcatctgagcccattttggagagtgaaggcccttcaaaagtaaaataatctgtgtggattgaggatttggtacccaagaacccagacttcaattcccagttacatccatcaactgtgccttcagttactgatttcatctctaagctagaaaaataaaaactgtcccaacttcgtttttcagaaaatacagtagcaagtttaacaaacttatttcccaactcgtgttgtaagacaagctaccatacattttcagtcagaagctataatttattcagagattaaaagaattcatttgcatttcttcatttgcttagtctatgagattatgaggaatttttctctgtttcaggacattgacccctacctaataagataaaaaagtgtgtgttttggggaggacttgggggaatatgtacaatacctaagatggaatttctagagtctttaaaatctttaagtccataatctataatatctacaaaattttcttaaaaaattatttaagaaatttcttatctacattttttactgaaaaactacttctgcaaaaaatttgttttaagaaatttctcttttatctaaatttgttttataaaaatcttaactataaccctgcccccattcatgttaatatttgatcttgatctttttgtgaagcatccagtctagtctagcaggtgagggccttccctaccttggtttagatgtgcatgaatgctaagttctcccttcgaacagtcacggtccttttctcatcagagatagccaggggcagcagcaaagggtgaatgagatccatcatgaaatgtccagtgtcaatgtgctctcccaatttacttactgaccttcagcttgcagccacactcctgaccctcatgagatggagcctaagggggaaatggcactgaggaccaattcctgtgtcctgttggtctgtggtctcaattaagtgctaattaattaccactggcatctttggcatcgcttgtcaaattgcatttaggagtatattttcactgtttaaacatcagtagtccaaaacccacgctaaaaatcccatgttctcataaatccccctttgttccctcgtaaaaaattgtgttttaaaaattcaacaaatacatctatagccactgcaggtagctttcaaatacaagaaacaggaattggtattgtcgattttgattaattgtacttcattaataaacatcctgttattctgtctccacctgcagttgctgatgttgcctggaatcaattaactcatataatttgatttattttacaaagacattttgggatgtgctgcgctgatgataaaggtcctattttagcagttcttgattgcaagttagattgtacctgaatggatttctgtttctacatggatatgtatacatgagtgtgtgatttgcaagtgagtaggaagaaaatactccttgaagaagtcttgaattaaagaattcattttaaacatggtggggggtattcctcctgaatattctgactttatctgaagactcctaagaaatacagatcctgaaatgtcgtgtcctctctcttaatcaagaccttttatttagcagattagcaaatattccttcaaattaaaaaacgaaatagtagtactaagcaccaaagttaaaacacccactagaactatgattttagagacagatattcgattcagcttcatgtataatttactttgctttgttttaaacgtaatttctttttctctcctaaatatttataagccatggtttctggatcaatctatttgataccattatttactatgtgaaaacctatcttaggcttccataggtatctaagaaatgctaagtttagtgcaagtgacaaaagcccaactcaaacagtttagacaaaaaagagaatttgctggatcacataactgaaaattccacaatcagacgtgactttgggcgtgactagattcaattgccaaagggtattgcatagaatttgtttctttccatttctaaactctgcttgcctctgggttagctttgacttaaaaatctttctccctggtagcaagatggcaacaccagaattgtatcgtatcagcttagcgtactcaggggcaagtaagcttctctctcactgtgtgaaaagaaaattctcaaaaaattattcttcttgtcctggattgagccccttattatttgttcgttcctgatccattctctatggcagaggactgcatggctctcattagtcaggcttgagacacaggcccactcaaccacacagactagaagtgagggagaagcagttttccccaaagatggtcttagcaagaagaagaagaatgactagaagtcaaaaaaaaatccacttatccacagtagtaaagtataactacaatattttttgtccaacaaaactatcctgtctctgcaacaatatttcaatcaatagacataaatgaaggctaactcacattaaggagcgctggtgcctataattagaaaaggttgcctatccctcattctcatttgctactactaaattgacaaggcttatgaagaatatcaaagtactatccatccatctgtgcatttcttcatccatgtaacactcatgagcacatgtgatgagacaggcactaaactgggcactgggactacaagaataagtaagccaggtccttaacctatatgtgtcaggcgcagtggctcacgtctgtaatcctagcactttgggaggccgaggtgggtatcaccggaggtcaggagtggatcacctgaggtcaggagttcgagaccagcctgaccaacatggtgaaaccttgtctctactaaatacaaaaaattagccgggcatggtggtgcatgctataacctcagctactcaggaggctgaggcaggagattcatttgaacccaggaggtggaggttgcagtgagcccagattgtaccactgcactccagcctgggcaacaagagcgaaactctgtcaaaaaaaaaaaaaagcaaaaaaacaaacaacacacctatatgtggagacagtagagtacagtgataggagataaggctttggaattaaatagagtagggttccaatcccagctcttttacttacacaaagtgtagagtgtatagttatagacaaagtgtagaatgtagacaaatttctcatttcttctaagcttcagttttcatatctacaaattattataagaattaagtgggtaatatatattaggtgtccagcatagagccaagcacataagttttcaaaaattaacagttactactctgtatatcaaatgagataatgcaagcaaattgctttacacaatgcctggcacacagtaagccctcaggaaatgatagctggaagctattgtcatatgaaatagaatgaaggactagatctaaaagaaagcaacatttcaaaacccaaccaacatctatcatgataaatttggaaaaggccttgagagttcacccagatctatccctaccctcagagaaaacactttagtaattttagacataatagaatatttttctctccaaagaaagtgtttgcaaagcaactctcttccttttgtgctcatatttcatcagtttacataatatttaattaaattacataattacaataataagtacaactggcataaacttgtttgggactctctcctgggactttcctctagtgggaacagatgagcgcagttgagagtcattaactagccgggaacattgaatatgttgtgggcattggtcaatatgttttacggaggagatagagagctgattaagtgggagtcagccaagagagtttctactgcattgcagcagtctcctgcattctcttcatttacatgaatgctcctggttcttaaaactttgtctcacatttgacctatttatgcattttctaaacatccttcagtagctgatatgcagaaagctttattactagaattgtaaacatgccttatagaattgttttgttattctatagtcataaccatgtattgggcagagaaagcaatgtaaactgaaaatgtagaacatgaggatgaatgctgggcactgccctttgtacatttcttctgccagtcataaacaataggttttaaattcattcctaagaagaaaatgatagaaacatgtctcgcacgtgaaaatgatactatcaattgagtagaaccaaaaagattcgaacatgcttatttaatgtcctctggctttctgactggccaaatgcatgaacataaggaaccattcttcccatccctaatggtaatctcatgaaaacttttgaaacctatttattttatttatttatttatttatttatttatttatttatttattttttgagatggagttttcactcttgttgcccaggctggagtgcaatggcacgatctcggctcactgcaagctccgcctcctgggttcaagtgattctcctgcctcagccttctgagtagctggaattacaggcatgcgccaccacacccggctaaatttttgtatttttaatagagccggggtttcaccatgccggtcaggttggtctcaaactcctgacctcaggtgatctgcccatctcagcctcccaaagttgaaacctgttcgtttactgcattgcaatcctcagaatcagagcaccacaaacctgagaagcatcggcagcatatatatattttttaacttgggctttggtgggggattcatgatgccattttcagttttaaataatattcactagcagatgaaatctattgaagttcttatttataaggtacttctgctgagacaagccttagaaacagctcaatctgtgcctcaggaagttaaatttttttttatcagagtagcaaataagctatcatatagaactggtcaaatccagaaggaatatgcctttcactagtagtctgtggagtcatttagcgttcttacgaataaaggcacatttcaatcctcaactgtggatttgaacatttggatttttcccaagtaatcactggccatcccagcagataccaatattgtataggttggttgactggttaaagcagacttgagccagatcaattcctttgacttgaacaacttccgggcctctcttcgaacatcatggagactaactgatcatcattatttatgtgagataggttctctgtagtcacgataatgtcaagcatttttggtgttaataacaatttaaagtttaataattacttttggtgagaaaaagatttgtgagcaaaagcatcatttttacttgtttctatttcttttcttaatccatgaattgactgagctctaaaatccgcaaatcacatgctttgctttgtaaagaacttacattcaccagcaattacacagactgatatgtccttaacgccaggttaaatgtccttaacgccaacaaaagacactctggttggtcccattccttggttcaagcctccgcccatgattcaaacagccgtaacgaaaacaaggtcaggtgtcctcaattgggagaaaaaggaatattctggtgaatgatcatggatcattttgaatgaagatcactggaaagagaggctagaaccaggttatcaaaggaataatgtgtcctattatggagctgagattttaccttatggacaatagaaccagctgctggtttttaagcagagaagactgacccagtgatgaggctaagagagcccatctgcatgcacactccatcttggaaggctctgtgacctgtgcttaggggcaaacagtgatcgcaggtgaagtatacttggaagaccagaaaaagacagcagccttagaagaagatgatagcaaaaacaacaagagggaatcaagctccctagcaatcctgctggggttcaaagctagattctggtcctcatgggaaatgaaaagtaaaaccgagaatcaatatcacaagcagaaaggccatttgggaaaactggccacatacagctcagtcctgctgcatcctgaaatcacaatcctgtgagctggcaaggtccataggctcttataagaaacttgagtgcagctgaagcaggcaagaaatagcgcccagagtccttgggaattttgcatcatcattccacttaaaattaaaatttgctcaaagctccaactcttctaaaattagaaccccagtatctttcaggttatcagaaagggttgatattttcttgaggtatttctggtctgatttcctgctacccttgaacccacaactcactcatgccttcccattggccaatgttctcttatcttgacaattccttttcattgttttccaaggctcactctaggccatagcattcagctgacttttactgaagattgacagaggatagagagatcacatcacacccagcctagctgataatttaaaatgcaaactatgtaaacttaaataataggtgcccctgttactaaaatgcaccttgatcattctccccacacccccaactaaggaattttcatagattgtcatttccatttggtctccaacttcccaccgtgtcattctgccccaacactctactttcataatctctctttttgcacacagctctcataagtccatttttgtgttttatgcagagaatttggttctctttttttctagctgtgtttgagagattatgtttccacaaccaaaatggtccatcaaaatgttttgctaagcaaaacagaaaaaaaaaatgattttctccactaggaggaattttgctgtcagatattaaaatagcattttccctcatatacatgaatctacaagatgagcgtaattatatctcttattagcttaggcaaggattgatagatctaaaccaatctgcagagaatctactgggctatatgtatatgtcctgaccgttgtggctaccactgtctgtctgcatattaggaacaacagatacatcagaatctacctcttgactttctgtgacaggtagaaatgtagtgtctccagcaaggcaattcccttgagccattacacatgcaaaatatttcctcaattgaaaaatgctactggaaattttcacagagaactctaggaaagaaattcctgaaattgcagtgtaaaaactcataaaagagctctgcaataagaagcaatattctcaccaggctgttgatactgtttgagaaatttacatcaaaacagcgtcagcggtggtgctaacaagcgcagtgtcaacgagatccgccaggtctgtcagttgatgtagtcccaggtacagcaggggcagtttgctgtcttattgtagaataaatgtgggccccaaaactgtcagtagcacagagctatttagtgccttaaaagacaatgaaattctctcaggaaatgagaaacacaggatctactcagcttccagtttgagggccatatttatgtgtttcagcatggatttacactgccttttgttttgcaaatgctaataccatcccatccatttttttccagaaatattgaagctgtggttaattgaaaaaaaaagaaaaagaaaggcgaggatttagcagctatattcaatgtactgtattgctataaaactacttcacatcctgtcactcatctccctcctccattcttgtcccacccaaaatcactgaaccaaacaatgacaaaaatataaaaggaccaaagcaactcacccgcattgcccagtagtggtcccttggcaaacacggtgaaaacatcactttggcagatgacagacacttgggccttggctagggcattagtgaacaatgttattaaggactaattagatggcttttgttgaaatatttccaaagaaatgagcaaaataaagctgacctaaagaaaatattttaaaacctcccactgagcatgctcagagaaagcattttgacttcttttatttttaaaatgctcaaccattttcttcaaaaacttggcttgatcttcctgattcagtgataactgaagtcatgccaactttgatgtttttagcttcagctgttttagagctatatgtgatccccccaaaaaggttggaatgaattttttttctgagtgaagaaggaagcatatgttttaaccctcatgtgccttttttgaaaaggatgaattaacatcctataatattttatctttgagcttaaaataaaagagtttagtttgaaagtcaaagagacatttttcagaaattgaaatggagacttgggccttcaagaattaagactatgaattgtatctgctttaccgaatacatttggagacttgcatgtctgctgctattgttttaaaatggcagcagagaccaggcagcctggagacttgagcaagatggaccacacacaaaccaaatttcaggacatcaaaaggacataaaactaatatgcagaaatgccggagcatcttgaatacattttttttccaaccagatatatgacatgaagaatgagaaataaaaatgaactcagaaagctttaatccacctgatgatcttattttcccttctaagttatagaaaaaggaagggaagaaaaaacaataagcagctagaaactgattggtaccaaatataattgatcccattaaagaaggagctacatagaggagacagttatcagttatcaggaagatttctgagagccaggtctatattcttttttattattgaccatgcccatgatttgtcagatttcccctgggaccaactggtctttggatctccttaggacacaccagaggcaataaaaaaaggaaatcacactaattatagcagatctgatcacaagctaggaaggtagacaacaattctagtcatgcacagagctatgtcaaatggctccatggttggtgcaaacctgaaatgagaagtggcttctgacttagggtgagacatttcccacgtgactgcagatggaaacacaggatatccgtgcttccagatcagacataggtcatttttgtggaagaccgtgcaacgccaagtctagaagtctaataatatcaagttaaatttcttcaagtcagaactcctactacattctggtacgtacccaaaacactggaaaaccaacaaaaggaaagaatcggtaaagaaatgacaaatgtctccctcttatgtcagaagaaatttgggcagaaaaattgaaaccagaatgaaagaaaggtttaaaaggaaattgagtctgtgtttacaaaacgattccaatctgaggtgaactgtccaactcaaccagttgctttggagaaacatgattaaagtgatgactgaggtgttttgcgtgctagcctcagtttcctttattcccctcacagtccagtgacagccaatcagaaaagaacctggcccggaggcttgtcagtgataataattgaaaacatctgtccatgcagcaagtgtgggaagcccatgcagctccctgacagagcgagttctcacacagcaaagccataaccacgactgctcatattctccttcacagacttttctcactgccagctgtctttattctcctgccaggaaagcaaggggcctggggctccaacccaggctggggttaagtgagctgggaccaggggaagaaaggggacaggctggctcccagctctgggtctagagacaagggatatctgattgggaactaaagagagcggcgactgaggaaaaagaatagcaaacagagaaaccaaacaaactgaagaggacagataggcagcgggataagaagcgttcagattctaaactcaggtgagccgggtttaaaccttggcacagcattttcactatgtcactgggcaacctccctgagcctcaggtttttcgtctctaaaatgggaataatagtacctgtctcacaatgttttcatgaaaaataagataatgcacttcagtagaacaaggcaaggactgaatacacattagctcctttagaagggggcttcccagacagtcattaaggtgtagaggtagaagacctctactgaggggcatgctacttcggtcatgtgtagggaaggccctactgatggtgttctattgacttggacagtctccatgtggttcccgcagatgttctttccctgcctgtggcctgtgttaagctgctttatcaacctgtgcctcttagtttcttgcgatctctgtactgactcctgtggcctctctctgccatgaaagccatgttcggggacagcactaggttgtacctggtctgtcttcccttgctcctcgtgtgccaatgcctcgttccccgtttcagcagtttgccagatctttcagcttggtataaaacatatcaaggggatatctggttagaagaatgccagcaaaacattatttcagccaactgaggagaaacttccagattgtaggttagagagtaatcaaaacacggaaagttggagtaaggggaagaaagaaaataaagtccttagtagcaaggtttggatgttctctctgccttccagaagaaaaaaaaaacattattaagaatataatgaaccaatagatttacaaaggaaatataaacaaaatgccataaaggacaatattttaaaatttcaaattatccagatcatttcattgtttaagataccctgtgtacataaattaatcacctttggaaactgcattaacagtcacatcacaattgtatttatagctaactcacaattatttgatgtatgatgttcacttggaagctggaaagaataaatccagcttgcaaagaagcagaacttacttttagggtggggcttaggtcctgagaaaatctagctcaacacatgggtggcaaggaataatacaaaaggagagacttggggaggccaactttgtatcattagttaagaacagttctgcattgtatatgtatccaacataaacacttggctaaggatgttattctactgacagtgtttggttttccttatggtcatcagctggatgactaccgctacttggctgagaagcacttcatccataaagaaaagcaccataagtaataatgagtgcgagtttgtgttagttgcagagcaagaattcagattcaacaagggatttttttaatccaattgaaatgaatcaaactgtttaacctaattgagcttctataaatcaggagtgttgtcatattagtaatccccctagataaggcactgcaaagaggcgccgcacaagagtgcgaatgtataaacacaaaatacagggaatctactgaagctcctttattcagcatccttgtacatctcccctctctttataatcactattgcaataaaattatcacttaaccaccaacattagtacatctttttaatcattgagagactattatagttttcctatgattctgtcttcaatatccacctacaaccatggaaaggcctgatcttttcatgactataaaatcaacaaaatatagggagggagaaaatgtacatccgttgggaactgggatttaaaaatacgtactatgaatattgtaaagttattgttttaaaaatgaagcagatctatatgtgctcacctgaagggatcaccaagacatatcccatttacatagatttctctaaaatccgcttcaaatatttatctttgtaaattacttctaatatattcctaaagtcactgtttgtctactttgatacctctattcctttaaattttcccttctttctatactcacttaagggcaacgtggctcaaaacccccaggagcttgcctctcaagttcgcagattccttctcatccaggaataccttttgttgcttccatagatgtatctggttaccttttgaaattacttttctgctgaatggcacattcctggcatacatgccaccattccccattcctgaacccatgttgacataactgagtgatcatatcacccttttacactgtgacttcaccttcagggtcctttctcacagagcaggcagccaccatcagccaggtgaagcaaatctgtgtgccatcccttctgccagagcaggtctctttgtccaatgccaccattcttttataagtgtaagaaaacaaaaactcagactatagacacaccctcatgcttccaagagatggagactcatgtctgtttccttaaaaatcttgtttctgcctttctatttcactcatcactttgataaataaatgtaaaggtacatataaacatcctataatatataaatgtatatttaaaatattcatatatatgcaagagattactacaaactttttacattttagggttcacttattttgcaattgatggctgtgcttgcaatgtgtttctgagcttgtcaactttccttgcaaagtatttcaagttacaggaaggaaaaggtgtttaaaattgttaataggatttgcagcacaaggaaattagaaattcttctgcccaactgtctgatattcaaaatgaggaaactgaagctgagcaaggctaagtgagtgcccagagtactacaggtagtaagaagcgaagccagaagagaaaaatcaggctttctgtttccttgttcaagttgatctttcgttccagtaattaaaactggtgtgcagtaatgaggcaaaagcagcttcgtcaaatcagcttttttctccaacttcctatggtattgtgggtcagttgacctcacgaatttccacacaattctatatgtcagtgaagtagattatttagacattctcttctgtatatattatttggattatgtagaaattacccgtaagaaaccaagacttttcaacacgaacctcatgacttccacattctatttttgataccttaacctaaagtaatttcacactctcataaaacctttgaaaatggagcatccacagatgatattttgcacttaccaaattcctttttcaaaaaaaaaccctctaaatgttacattatattgttgtatttgcaaattatatcctccagtcatcctctgtaattttttttcaaagaaagtaaaacacagaagataggaagaacatagggagaaatgacacagaaaaagcctcaacatctaacaaacatgaatgtctgttgacagcgttgttctgactgcagacagaaaaatattggggagtacctcacttctgttcagacagtcccttttgggtgagaaaaagcttaatctgtcagccaaacataaaacaaaaactatttgtaataagaagttactgaatgccctaacttttttaccacaaatgaaataggaggaaagctgaaggtaacatatcacctaaatgcaaagagtttgcaatctaattgagagagtaaaacatatgtgaatgaaataacttagcgataaaaataaaacatatcaacaacaatgtaatacaatctgaatgcttaaatgccaagaaagcaaataagcaagtgatcagaatatgattctaaaagtcttcctagtagagacatgcttaaatatgtttttgagtagcatgattggcataaatgtggcaataaaaatagtagtaatataagtgcaaaacaactcaaatgtgtgtggccataaggatacatgagcaggtaaattgacctctaagccctgaatggatgctatctgctttatcatcttttaactttttttttgttaatagatttttcaaaccagatttaggtttaaaaaactgatcagaatcaccactggggcctgtcagggggtggggagaaaggggaggaagagcattaggacaaatacctaatgcatgcagggcttaaaacctagatgatgggttgataggtgcagcaaaccaccatggcatatgtatacctatgtaacaaacctgcacgctcagcacgtgtattcatgtatcccagaacttaaaaaaaaagaaaaaaaaagatcggagacttcccatatacttcctctccacccaccacatacacacaatttctcctatcattaaaatcttgtgttggtgtggtatatttgttgtaacttatgagccaatattgagacattaattaaagtccatagtttacattaggcttcactctttacactgtacattctatggattttgaccaatgtgtaatgacatgtaaccaccattatagtgtcagagaatagttttttactaccctaaaaatctgctgtgttccaccttttcattcctccctccctccccaaaacctctgcaaccactgttctttttctgtctccaaagttttgccttttccaggatgtcaggtgcttggaatcatatagtatacagcgattttagattggcctctttcacctggcgatatgcatttaagattcttcttgttcttttatggtttgatagcttatttctttttattgctaaactatattccgttgtatggatataccacagctgtttatccattcattatccattcatttatcagaggacatctagaatctttaacttaaaaacaaaaatttttaaacttaagtttttaaccaacatatttctcaggtagaaaatatggttctcagaacacatatactttttaccttgagacttccttgtctgaggcaatacgttgtgattttttggaacacaatactaaactatcatttgtgttcttaaacttgaatcaaagtccacttcaccttcttgcttctgttcttaggcaacgtgagagcaattaattttagaatatagaacaaaaagatgagaattacaaaattaagttgtgaattttcaaatgaatgtggttactatcaaacatctactagaggtcatgtctttctttttctctgcaactacaacactatgttgtcttcacagtgaatcagaatataattccaaatttgaaattatgcctttttctctcttctttggttacactgttaattatgtccaaaaagcaattttatgatcttttcaaaagtgacatcctaagctgttgttgattctctaagtggaaacaaatgtcacctggcccacctatgtctttgtttttgatgtcaaataacattgataactaaatcactctaatatagggggaaagaaaagctgccctgccatttgaagggaatttgcaatgaaattttacttggccccacgattatgtatacctactggttttaagacagcacacaggaggctttgccaagaaaattttaaagttcaagcagaaaaaataatcacaatatctttcagtcatttgctgcgtgtatttgtttccttaaaatgcacagctaaatgctctctacacacagatatcacttggtaggcggagtatatcttattactgggttattttccagtacatttggcatagttaaggtaaagtgtattaactttctctcaaaataaagatgaaaacagagttgtagcggccgtgaatgcttcagccattgtcaggaagttaaaaactgacaggaggcccaaataatcaactcagcctgctgcatataccatagttttcccctgggatatctggtctaatccaacaatgtatctgactggcatgaatgtagaattactttcaataaagattttatttcaagcttggatgatttcccccaaaacatcttgtcactaaggcaaagtatatcatagaatatctgattttttttttccccctacaagtcagcttttgagagggggaaaaaaatacacattacaactcaagtactcaactcaggtcaattcactgtaaaaaatcacattttaacatatctacactgattaaagatttgctgtgttaaagaagtcagggtgctgtcaaagagagcttaccctaaagtctggaaatgtaaaaaataagtaccacacttgctccactccagtctgcattctgcctgcagtggcctccaatcgaagggcaggcaggacagatgagtccaccagctaacacccggctccgagaatatttgtctttttgcaagtaaggaacatttcaaggtcacatcttccaataagtatgaaattgtttccaggctataagagaaatatgaatggcctggtcatgatcacacgaaaacgatcttcatttctctatgcatccttctctctctctttattccattctcttccttcatgatgccacattaagtcagcatgttcaagataggggaacagtaggtaacagttcattactctattttgaattcccttaaacgtttcatttagtacttgcgtacattatttcagccttggtgtcacattgtttaatttatgcttggttcatataatcttaaaaatagcttgtgttacctacagagtttcaccccttactaaaagcacacaaatcatatgatttagtgctaatgggataggagtaattattttaacatttaataatcataacacattatatttatatgttttaaattcaaaatcccttttatctctattattatattttatgattaacatacaatgttacaataagtatgtacacgaaagagcactcagcatggataatagtagataaaactctagagaagcatggaaagggctagagttgagtccctggttctttgactttattagcactgtgtaacctttggacagatcattaaccaagaagtccctaaccctggctgcacaccaggctcatctgtgaagctttttagcaactctgagtcccgggtctcaaccctgaactaccaaatcagaatctctgtgcaattcctttcctttattaaaagcctgagccagagtggaaaaccagtgagttctaatctccctttccatgtttataaaacaattgacagaaagaaatgtaatcacatataataaaaattaatgtttctggctgggcgtggtggctcacacctatgatcccagcactttggaaggccgaggtaggcagatcacctgaggtcaggagttcgagaccagcctggccaacatggtgaaaccccatctctattaaaaatccaaagaattagtggggcatgatggcgcatgcctataatcccagccactcaggaggctaaggcaggagaactgcttgaaccagggaggcagaggttgcagtgagccgggacagtgccattgcactccggcacaggcagcaaaaacgtaaatcagtctcaagaaaaaaaaaatgtttctctagcttgcaaagggttttcacatacatttttaaatttaatcttcaaaacaacctatgagatcagttttgccattaacttcactttctaaatgaagaatctgaggctcagagaaatggtagggcccatctaagatcacagtcagtacctatagaactagcacttaagattttgagcttccagatcaagagcaatggttctttccctccagttagaagagaatcacatgcagagcgtttaaaatgtacccaggcctaactgcaagccgtttgcaacagattttatgtggatgggtcccagaggttaatatggttttgaatgttccacagatgatattaatatgcagtctggatagagaatttctgccctagaatgatcagaacaagtttggaaaatataaagtactatacagatatagcgtgatgattttatctcagttttgctgataattaagcatgaattcaaagggggagggaaatgatgcgtgaacacaaggctgttcagatctaggctccacattagatgtcaggtcttccctttcatgagccagctctatttctattggaacttctctgactccccagagctcatggttgctgtcacaggttagatttaacatggcgccagttacctattaacaccaacagaagtaaagatggagcagcatggggtagaaagagaagtcaaactatgacattgggccggacaaagcctggctacccacagaaggtctggggcatccagggcccatcacagttgtctccgggaggatgaagatggcttggccttgatacactcactgtgatcagtcattggccgtgggctgtctccaagagtcccctggggtgaggtggctctcttcagctgaggcaaaccctgcaggggctgacagctgaagctgcctgcggacttgacacttggaaactgggcaacaagtctttcctcaaagagagacctgggtagcacatcaagggtccagcacagtccaccctttgtggtgctcggagtgtgttcttcatgttcatttgagaagcagctcccccaggactctcagggagagaggagatctttgaaggggaatctttagaaggatgaactacaagctctgcagctacagctggacctgagcccagctcattgtctccatcctccactctctattcgagactcccctcatcctcaacaatggcgtctgctggtcgtggtggctgccctaatgtaatgtcccagaccctcatccatgggagatccaagctcctacataccatgtcttctcagacaagaatttctgccctgttaatgccccatcacaactgggcaacagagaacttggaagccctatgtggatcatctgggtgccactctgtccccctggtgtaacagcaaccttgcctccgccctttgatcacagttaattatacctgcctagatggtgactctttgccttgactgctggtgcctggacccaagaagctccacctggcaagaaagcaacagtagcttagaagacagtgatttgatatatcattcaaatacaatgatatacagagaatagcatccttcctgactgcccatttattttgttccagaggatgctatgttctagcgaccatctcataattctctgagtcgggcccccttggctgcccctcaaccctgccacttgttattaaaattgcatctacctggcttctagtaattaagccccaccagctggcctctattaccagtgtctcagcatccccattacaatcagtgagcctagttctgtaatggactctcctatagtcaaccctcatttacagagtaaaggcccctataatcacatacaacttttctgtagaatatcaacgatgcttagcaacagctcttcaattcattgaccttggagttactatccacaacctcccactattatttctaaatgcctcatactttacaccagctagtctcctccacagatctaatgtcctaattcaccaccagggtgagttttcacaattgggctgccaccttgtgccaggacccgcctgcattccacctgccaccatcgatggactcctcattgccagtcaggctgcgagtgacccagctccaaatctccatcttattgctggctttctgggaccactcatagaactaataatcatgggttcagttctccagaaggagcccctgaaacagagtttggcatccagggcattgttaaaggttaacccctgtggaaggaaggaggtgggcaacaggattgggcagaggaataagctgaactgaagtgcagacccaagaaagcttcagccagacccacaggaagctctggggcacatagagcctgtcaaagtcgtcccacagtgggcagaaatagtccaggctttatactgactgactgagtaggggccagagcagtggctcacacctgtaatcccagcacttcaggaggctgaggcaggaagatcacctgaggccaggagttcgagaccagcctgggaaacatagtgagaccccatctctacaaaacaaaaaaattttttttaattagccgggcatggtggcacacacctgtagtcctagctactcagcaggtcgaggcgggaagatcgcttgacccaaggagttagaggttacaatgagctatgattgtgccactgcactctagcctgggcgacagaataagctcgtctcttaaatacatacataacataaaatatatgttgacagatcagtcagtgtccttgagcaaggaggcttattgcaattgaggcaaaccgtgaagaagatagctggcagccatcagctatccctgcagctatgcaggtagtccttccttgaaaggagatctaagtggcccatctctgcaagcaaagcagccaccataattatcaaattgacaaatgtacgaatggccccttaacagactaagagccttctgttataaagcttaatataatgcttgatagtggtccctaaaagatgaggcatttcatgtagaaattcttagaacaggtgatcacagttctacgtaccggacgatagaatcatgagttagcccagcatccgtatttacagggacatatgcagaaactggcacaatccattccttcaacgtagtacagatgataaatttatatgtgtaaatgcaaaataaattattttctatctttgagcaaagtattacatacattttgaaagggtttatattcctgcagatgcatcgagcattttaccaaaaataaaattatatggtcaaattttagatggccaaaaaaatggcatcattatctttagcttcaatccaaccatagcataaaacagataaaaattactctctattctaaattcctctcaccagttttgttcaaattaggtacatgtttggaaactcattgtcagataatatatgcgaaggaaagacacactgaacaattacaggcccttaagttctcaaacagttgcgctttttatttttgccttcatcttcttgtcctctcatacattacaccaactagtctcctccacagatctaatgttctaattcaccatcagggtgaaatttaggtgtgcaggaaatgtaattattgtgccaacattaaaattaatttatttttcaggccctattcttctaaatgacttgaatttggtcagttaagactgtcttccagattttttctggtgatgttgttagttctggagggctatgtaaagccgaagcatttggtggaggggcagaaaggatatccattaatacagcgtttcaacaaatacttgttgagtacttaataccatgagccaaatactaatcttagtctatggatacagcactaagcaaaaacagataaagtccttgtgcttacggcatttatattctgctggagaaagataataaagcagattagcagcagagaaagtatctagtttttcccacctctgcaggctggtcttcattcccttttcatttgcagtcatcatccccaacttccaatcccaggtctggatctcagtcactcttcacagagtactctgtgagctatctttggccaccctgcctagatatacaaagcagcaatttctacttaactgctcctgatatactaggtgtaggcagctctggaatcctgccatactactaggtcttccccaaagagaagaatacagatctgtctgattctcaggatcctcaagccttctaacagcctgcactcccagggaacgggattagcaaggaccagggcctgggccacttacgtgggacctcatcaaagtctcacctttcctagaccctccctccccaagtccagaaaatctttctctagcctggcagcaaagcagcctggctctttatctaccttccaatctactgatcaggccatccatattttggctgcagctctgaggcctttggcacttaggcttttgaaactcaaaaacacagtcctttgcaactcaactgccttgccttgcaaaaattaaaaggacttctgcttttctgcatcacccctgaactgagggcacagtgttgctgactgaacattggggaaagacccaatgtacaaggaagggtagagaagaaggctcagtcattatctactatctcatcttatccccagatgatactttgactttcccagaatgctcactctttcatcattaatccggcagcccaaaccacacttcaaagattgttcaaccttccatccaatacaggaatctcaaacatcctgcctgaatacttctcttgatggggaactcatagccttttttggtataaaatctttaatatctttaataggtgctcccaatgctttgccagcatatatgggggggggggatctataccaaatatcaatagtggtaatatctaagtagtagaattatgagggattcttattgtatctttgtctgcattttctaaattttctgcagtacatgtaaatgcattactgttttgaagcagtcttttctatttttacaacactaattcttcatacaaaggtaaaatccatctctgggccaattccagtaactggattacaagaggaaagtttattctttctttcacatcatggctttttgcattgagtcatgacttccctaaatattctttcccccctgctaaccaaacaccttcagttcctgcgctcttccatttagaagccactctctgggcacattcaccttggtgctcactagttttactgtgtccctcttaaagtcactgcagaaagtgtctaaaactggccaggtgtggtggctcacacctgtaatcccagcactttggagggccaggcagattacctgaggtagggagtttgagatcagcctgaccaacatggtgaaaccctgtctaaaaatacaaaaactagctgggtgtggtagcgggtgcctgtaatcctagctacttgggaggctgaggcaggagaattacttgaaactgggaggcagaggttgcagcgagctgagatcttgccactgcactccagcctgggtaacagagtgagactccatctcaaaaaaaaaaactctaaaacttatttttcctcagaaagtaaaattaagcgcatacaaactgaatgatgatacccaaattgcaactgattctcctttgactatttttcagtcatttaaacaaggagacaattttcaagaaaactgctaaagattttatgtaggcgccctcaatgaaaagtaaagttgctcttctcttcacctatataaaaaggaaaaacaaaagagaagttgaggaatactttgcatactgaaaatattccttttatgtttatctaacgtcacaaggcaaatatttaagtactatatactccactaataacttataattaggtgcattattctgcttggcttaattaatgctgatccatgcacaacactcaaagttctgtctaaaatattactagcacatactagtttttaaatagctatattggactaattcaggtagaaaataatgacagtcttataatttttttattgcttaaagtactcccaacataatatatttgctagcctttctcccctaaatgcagagcgatgccttcccaggatgttgatattatcagtggttattggtgtatcagcagagctcagggaataaagattaagaattcttttactgctgagacagttaaatgcaaatggctaaaaccattttaaaagcatgaggaaaaacacctaaaaaaaaaaataactgaaataatcattgtgctaatagggcatttccatttacaatgagatatgaatgctttcagaagtttttaaatctgtgtgaatatggaaaaaaggtaatacatgttaatttggtttttcttccatctgaacacccttcttatctgtgcagatatatccttggatgtgaattaggtgattaaaaaatcaaaatatgtcacccaagacttcttgttgactctgactcacttttttcccaagtcttcctcaggtctcaggcctctccattaagaagtctcttgatgtcaaattcaaaattcttggatcttagctacttgcagaaaatacatttatatcacagagtaataaagatctgcatcttaatctaggctctgccacttactgcctgtgtggcttggatcaaattttcagtctttctcagggtcattttgttcatctgaaaaagttcacctgaaaattttctcttacgtctaaacaaaagaaaaaaaaaatgggaagagaaatatcccaatatacagtaaagttacagtgatttaaacagcagagtactgaatcaaaatacacacagaggctgggcacagtggctcacgcctgtaatcccggcactgtgggaggctgagatgggcagatcactttagatcaggagtttgagaccagcctggccaatatagggaaaccccgtctctactaaaaatacaaaaaattagccaggcatggtaacgcgtgactgtaatcccagctacttgggaggctgaggcatgagagtcgcttcaacttggcaggtggagatttcattgagccgagacaatgcgactacattccagcctgggtgacagagtgagactctgtctcaaaaagaaaatatatatatatatacacatacatacatacatagagattatcagcacagtaccgtataccagggtgtgtggctgactgcaggcaatctgcacaaaaaaggcagtaccacaaatcaatggagagtggtggtttattcaacaaatgtcatagggaaaatcagctggtttccagaaaaaaagtaaattcagagtaccatcaaatttcacacaacaaaaatatttacaatgaattagatgatatgcttttaaaatctaaaatcatttttaaaaacaagactttgataatagttatctgatctctttaaatggttggattttataataataaaaacaaagataaaatccaaaagaaatagtactagatatgactacataagaacttaagtaaataaaattaagaaacacaagaattgggagaatgtatgtgccacaaaagtaatgaaaagttactcttaagacataaagaaacttagaaatctacatatgcaaggatttcactgtagcattgtctgtaatagcaaagaattagaagaagcaacctaaaaaccaaccagcagagaaatggttagataaattaaggtatttccatactatgaaatataacaacttttttaaaagaatgaggtatttttatatgtactgacttggaaacatgcccgtgatatatagttaaggggggaaaagcaaattatagcacattatgtattttttatttcatcttttctaaaaaggaaaaaaattatttatatacaagtgtgtgtgtatatatatataaatatatataaaataggtagatggatagatgagtagaaaaacatccagaaggaacacccatctgttaattatagttatgaagaaatttgactaggaaacaggggaggtttttactttttacttttcaatagttctgattagtactttttttttcccaaaagaccatgtattagttttgctgtacaaaataaaatgggttaaacaaacaaacataaaagtatacactctaaataggaaagagggcaggagatattcacaggagaggaaacacacgactgcttgtttgctttattaacttcttccccatttcctaaattcaaagaatcctaagttcaaagaatgacagactatttttcatgtatggcagttatttttaaaaagaataataccaaattataatactgctaacaggactaataggccctcccacatgttatgttttaaggaaaaaagagccataacttgataatctggtgctggttctcaagatgtggttcccaaccagaccagcagtactgttaccacttgggaacttgacaggaatgctgtttatcaagcctctccccagacttgctgaatcagaaatctggaggtggagcccagcaacctgccttttaataccttccaaattatcttcatgaagggtaaagtttgagaaccacggatcgaattgttacatttctattattttacactaaggcagaggtcttcatctgcagctttattgccatttggggctagataattctttgtcatcagagctgcctgtgcattacaaaatgtttagcaggatcctttgcctctacccattagacaccagtagcaatttcccaccccacctgctcatgacaatcaaaactgtctccagatattgccaaatctctcataggtggaggggtggggcttgggacagggtacaatattgctcctaaatggggaaccactgcctaaaaaaatactccaaaatgtggaggaagagtacatgggaaggttttatttatttatctcacttataccacgaaagcatatggcacaattcattctcttccatataaggtaatgatgaagtgatatatattacatatataagtcataggaattattcctgttagaagtgaaaaatgccagatacagaattatataaagtgcattttctcaaagttgtatgtagatacattatacaaacatttctatcatctctaaatgccaacagtgtcattctcctgctcgaacccaaagaaatgatttccatcacccttagaaataagtcccagatttttaccatgacccctaagtccctccgcagcatttcctacctctttccctttgctccctggcctccagccagactatgctctgcattcctcaccaccagggtattgtacctaccattccccgcccagaacacttgttcccctgatatgtgcacctcgacaggactctgctcaaatctcccttccttagagagggcttccctgagcactccgtctaatacacgtagcacttcttaccactctctgctcattagtattacctgggggctattcaaaaatgaaggcagcctggccttgcccaatattcaataaaagagaatctctgggaatggattccaagccatcagggtttttttaaagttccctagggtcagtggaagaaccattacttctctttttcttagcttttcttgaagtacttcagggcctgaagtcacattgtatattgcttagtgtatggtttgttgtctgttttccccactagattttaagcttcatctgagcagggattttgtctgttttactcattgcactatccctaatatccagaatagtgtcaaacacatagtaagtacgcaatagatttttatgaactaataaatggttacatcgagttcccagtgtttattatactcttctaaacttttcaaattttctctaatagaatgcgtttatcatcaaaaaaagaaattaaagctgattttaaaatctgcctttaaaatttgtgatatatttgaagcacagtgattagcacatagaaggtattaatagtaacaaacagtaactactgtaaatgtttctttttggtattatctactatgtcagggttttggttctgatattccattttatctgtggttgttatcaccttacagaacatatattctaataagaaataaattataaattgaagcctgtgggccattcatttttttactttttagttctcacatcttattaaatattctaaatattgctttagagatactttagaatatcactgtaatgcccaatcaataaaaatatgaaacaagtgaattgaaaatgtttcaatcttctgcattgaaattcatgcagaggttcaataaatgcaaataatctggccatgttagctatcaaaattcaactgccatataacgctcctttgctataatgtactaagaattatatacacctaactttaaagctaattttttgcttttattcaaaagcaaaaatgtcagaatatagcaataattcctatttaggatgatagttgttttggaaaataagaatgacatgatgtttagatataaaattgaagacttttcaatttgtttaagctaatggatatgtaaactggcatataaaaaatggctgaattatctttgagtgaccacctcgaaacacactaatgttaaatgcaaaaacacttgtgaatgctcccctgcttttccaatacttgagaatgtttctggcatacaactataactttaaagaagaaggtggaatttctgctaagtcctcaatcttataaaaaggccagtgtagatagcagtacagtttgtgcaaattgagggtaggcaagcatatggttagcatagatcccccccgaaatagttatagcacataggaaacataagttgagcatattgaaaatttattctatttttaacagcctctctttagttaagtggtcaaagtcacaattaacatttcacatgcagtggctgagctatattttgcaagccaggtgtgacctgatggcaggaatacatttaccaccacactctccttactccgtaaaactatcctaaagttatgtgtgttggaaaatcatggcattccacagatagagaagggaacatttctaatacaccttcataactggagagttgtcctccaggcaattatgtgactttcaacacactttgcaagtcactatagtaacagcaaagcacaaacttaaaagaaagttcacatccataaatctgtttggagctgaactattattaaaggctttggtcttcttaattcagcattaatttttggttgtatattaaagttttctttcagttcgagtcatttggctgtgattttatgtgactaagaaatttctttgaattagcaattcagctcattttgggaaaaacttacccagcataaggcttttttgagaggatttcttttccgggggtccaacatctgtagcactggattataaattatttctaaaataaacttaagttgatggatcattgttcttcccatttgggcctgacaaaaggtagcactcacatttcctttttttaatgctgtaaactgtgtatcacttctcagctcctgttagaaaactgaattcttactcattctaagattttataaacttgaattttacttagtggtataagaaatgcttttactaggaatacatacaaagtgctatttcatgaacaaattcataaaatcatatttttgtcaggctatttaaaactaagcagtataaataaatagcctttttcaagaattgcagtttggggcctttttttctgttagttaagcattcagaggcactaaactttgagctcttcatgttgcttagaatcaggtatctttgctatgatttcttgggagtaaattaatgatgagtcaacatacatcaagaggaattcccaaatattgacataaggtctaaatattttggggcctccttgcccactatcatgctaatgtctcaaccacgtgttttccttacctttctcattcagattagttcttttgccttttggcctttgttttgtcataaaaggggagtttctttcatttctttgctaaaaacaggttaaatggtagctcaaactttacaacacagttaaggaatttaagggcctaatgaaacctaagccctaccagaggggtggaactagccggaatgaccagaatctgacttctgagttagctgctacagagctgtgaagccagggtggcataggaggataaaattcctaacattttcagacttgtatatggtaggtccttagcaaaacacatagaacagcatttcttcatatacactcttcagtgttactcaaaaaagagaacctatgtacaagattcaagtaatttagggaggacacaagttaaagattggcaaggattttttttttctgcaggacttttcagagcctttattatgcttttatgcattgtgaatatccaagaagaaaaagtggcactcaattttctccaaaacttttactttggaatgccatttttcgtgaagcatatcagagaaatggtgttttacagaacccactttattgaaagatattgccaaatccatggtaaaaatgtatatggtttctggatcagatccacccctccaacaatacaactcaactaaagctcaagctacttgaagtacacctgactgtttttgagagttttccatctaagatactaaattgagttatattattccatgaaagccttttatttcttccagcagcctatatttcttttctacatatgttttactagttgaaaccttcagaaataatctctagctggtccccacagtaggagtgaaattatggtttctattgatgtgaggttaaaaaaaaataggtaataattagatgtaaaaagagagacatataataatataattttgcaggatagtattctaactgtatatttgaaattgtggttgatttcctctgtaatcctaaatcaaccacttaactatttaggagtccagcatggtagggaatacgtaagcttccatttgaatcatgacatttataacagcattaatacattttcccagacattcccagtttgggggccttctttgctggaaatgtctatccccacataatttaaactttaatatgagaatgtattagtcaacatgaattatatagttcagtatttgatgacttctaccccaaattgatctttaccttcaccttttctaacctaaagacagtgatttcttcacacatgaactactgtttggttgatatttggaaaataaattgcatatatatatcttaataaattgcatatatataaataataaattgcatatatatgcaaattgcatatatataaattgcatatatatgcaaattgcatatgtatatgtatgtgtatgtatatgtgtatgtatatgtatgtatatgtatatgtatgtatatgtatatgtatgtatataaatatatttatatacatataaattttatgtatatatttatatagattacatatatacacatacatacatattttgaaatagtaaataagccagatagcctgtgttctatataatactatatctaactttctttcttaatgactcttaattttttttaaagttactacaagtaacttgattttcctaactcaggaaaaaaatttcaagctgctgaaaaaatttaacctgcaataatgcaaatataacaggaatacaaaactatgtgttattttttaaatttattttaaaaatttattttttaaatgagattatttaaaacgtgcataagttttattaaaagcaaatggaaaacgtgcagggaaatggacataaaggatagaggtttgaggcagaatgaatattttatattgacacatgcataaaagcacaaaatgaacatttttccacaggaaatttaggtaatttgcattcgcagaaattcattacaggagtcccccacggtggcccagtggctgagaagccttctcccaagggagactcagacatgcaggcacatggctttccccaaggaggtactcagacacgcagctctagcctccaactcttccttctataactgtatcttcaatcgtctacttttacataatctctttcccctttcaaacttccttggttcactcccccacatttggccctgctctggtttccaagaccaggtcttttgctgagcagggaaaataaaaagaatgctgcagaaatagtaaatagtccagccccgtttcagttttcctgctctcccttcaatgcctgagtcccctttgagagctgagttatccctccacccacccaagctcctccaaagctatagaccccttccagcttccactcccatagcctcagactatccctccactaatgagctctttcatctcccttgatttttagcctcacctttgtgggtctcagttttggctcccagataccttaatctcactgtctctgcaccaactaaaactatagccataattaaataggtaactctatcttcaatcctgtcaatgtttacatcatccttttgccctttcagatttcctggactccaagtcctaatgttctactaccctgttggccaagatgccccattcacctttgtaccttcaatacagtcttgcttttgcttctaccttctccatggcccatgacctctgagccctgttctctgctagataaatcttatcaatttaggcatttgctaccaatgggtaaagttattaaaagaacttttacctaataagtactcaattgattatttatcttatctatctccatatttgcctctaaaatatgtgtgtgtgtgtgtgtgtgtgtgtgtgtgtgtgtgtggtaaaattaatgaaggagttcccatcataaaaaggtattaatttaaaaccaaattgggaaaaacctgcattgcctgtattgtgagtcttactaatggcttttataataggcatatctgggagaggctcaggagagatcttaaactgaggtagatgggcatgttaaagagaagcaaaggtccattccacttgccctctacagacaggaggatgcttaattcactcaataggattttggcaaatgaaataacaaagtggcatagcttcttatgttccaaaagaaactttaaatttgaagtctcagataactcacactctaaaaatatgaggatcccttccagaaatgtagccatgccaacagtgctcacaggtacaaatgctatctgcttaaagcagaagaaaagggaaaatgggaagcagaatatcctgaatattcagtctaaatttgagtgattttggccacaagaaatctactatcaccaggctgtccattacaattctaagagtaaaaaacgaaaattcagaccttcttacgatggatcgtatagtcaggtggaaggtggcagagtgaaaagccggcccagttactagggccaggagtcattacagacactgacagtgatgcttccacaggtactggacccagactgcctgggcagtctgggtcagtgtcagcttgtgtgacactggctgtcacaccactctatgcctcagtcttctcatttgttgaacaagcttaatagaagctacttcatgggcttgttatgatgatgaaatgagacaataaaattgcttagaacagtagttgattattattaatattggtcaggtcaaatatgctttgctggccacagtatgtgccatgagcttgcttggtggtgggcaagtaccaggcagtacacacatggcttaggccctgctcaaactctttcaagagatggacggcatggcctcttggtcacaaaagtggttcttcagagaatcaggtttgtgaagggaaaaaaaaaatgcagcagtcccccttatctgtggtttcactttccacggtttcagttatccaaagtcaaccatagtctgaaagtatgaaatggaaaattccagaaatatgcaattaataagtggcacaccattctgagtagcatgatgagttctcccaaccaggacgtaactcctccctttgtccagagtctccaagctgtctcctctggtgccattattcagagagtagccttcctagttatcagatcaatgttgtggcatcacagtgcttgtgtttgaggattccttattttacttcacaatggcccccaacgtgcaagagtaggtgatgctggcaattcacacatgccaaagagaagccataacgtgcttccattcagtggaaaggtggaaggtctcaacttaataaggaaagaataaaaactgtatgctgaggttgctatgatttatgttaagaatgaatcttccatctgtgaaattgtcaagtaggaaaaataaatttgtgctagttttgctgttgtgcctcagactgcaaaagttatggccgcagtgcatgatgagtgctgagttaagatggaaaaggcattacatctgtggatggaagagaaacatgttccaatagatggcaatctggttcggtactatccaaggtctcaggcatccactggcggcgggatggggtttctggagaatatcccccgaagataagcagggactactataataccagtctttctgccacctgtaattcagagatatgtaggcccacttaggccaaacaaagagaggcctctaaagtccaaccacctcaacaatgttccacacggagctctgaagccagagaccccactgtcctgtaaaaaagtgttcctttgctttgctttattttctacactcttatttcccttgggtttggatgtctggtagaatgaagagtttgatatttcttagcactctttctttccatatgctttccttatttccttatcactaaaaccccactcttctgaattttaatataaaatcaagtaggcttcagctgtcagaatagcattacttttttaattatcagtttctaggatggggctttattttctttttaggagtcctgtgttggaacaggcaagtcattaccattaataaaaccaaatcctagtgtttcattggtattccagctctccatagggtcctcacacaagcaaatacatatttgattccaatggggctcttttcctgtgcaaatgctacaggattctgcattttattgtggcattaagctaaattggctgtccaaatgaatggagacacttagaattttaccatataccaaactgtctcagagcttatctcctctacaaaacatattccagttagcatttgccaggaatactttactcaacactaatcaggaaaaacttaatttttttcaggctactaattgtgcagacattgttctggttatttcatttgggttcttatatatatatttttttgcatgcctctcacctgtttcctcaattgtctctaagcattttaaaggctgaatcttattaatttcacagtcatttttgctgtttaatatactcattcatttcacaaatatttgttgagtacccacaatgctcagctattatgggggtaaaaagttggacaaggcaatgtatcctttccccaaaactcataggttctacttccatacagtaaagtatgtagggtagaagattaaataatgttataatgcagttacttttcctgaatgagaaaccttttttaatcactccaaagtagccataacttcacttcaaactccagtgaaattatttttttttctctctctccacaggatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaat

SEQ ID NO: 38454 - DNA, 60710 bp, Homo sapiens
agatccagcaggtgtgcggaagggacgaggtacgtgagcactgctgcacgaacggggactccagagcggtgggctccggggtccccttcccggcggtttccgggccggggcggggcggggcgctcccctagccgcgcagtgcgcgaaaccggcgtgcgctaggaccgcggcgcgccgccctccgccgttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggctgtgagtacccgcggggggcggcgcggggaccggggcgggacctccgaacggccactgttggggaccccggcccgccgccgcgctgtgtgaccttgggccagtggcgggccctctctgcgcctcagtctcctcctctttcaaatgggtccccgctggccacctcgcgggctgcggcgaggagctccgcggcgatgctcagtgccgcagccgctcagcttcggactggcccgggaactccctggccgggggactgcggaccggggagggagcggggcccaggcttcccaagcgcagggcaggtgcctcaggccgggcgggcaagtccctcaggcacccccgctggcgcgcgcgccccacacctgagagtcgtttgcattcgtgagcgcgagagcggaaagttttgaagtcggcggacctgggtgggaacaggtctccgacgctccccggccgggtgaccttagtcgggagagccggcgcccggcgcctgctttcgtcctcgcatctgtaaaatgggttcaggcagcctcatccccgcgggtggctgggagacttagcgaggcagcggccgcagagcactttgcccggagcccagcgtcctcccctgagttcgctgagtctcccgggaccagcaaaggctgcgcgccccgcatcggcccggaggcggggagccctgggaggcctggccgagctgcccgcagggaaatggcggagaaagcgcttctctgcccgagttcagccgggctggggacttggccctgggtcctgaactcggcatggccagttctgcctctggctgtggaccagggtgtggactggagaccgcgggggccaggtgtgtgggcaaaccggctttggcgagcgacagaccggctgtgaaccctgccagctgcacttcctggctgtgtgaccttgggctagtcactttacctctctgattctcagctttccttctctgttgtaagagttctcctagtacctggtagacgctcaggaaatgggagctgcagatattttgggaaagagctagctcctggcacctgcttcaagtgcagagaaccagcgtccagtattgatcaccaagagagggtggcccagctgtttgtgtgtcagctgaaaagcaacccctcttgacccccaatctaaatacccctttccaggagaactggatgaaaattgcagaaaaccattaataactggtgtgtgtatgcacgcacttatacgtctatatctgtatctctgtgtgtgtagagatatagaaatatccaactaaagaagtaaaaggtgtggctcagcatatataatatggtacccttttttctgttttttaaaaaaggatcctttgagctggagccgcaaagtaaaaagaaatagaaaatgtaaaaagaggggaaaataagagtatacatttgtaattgctatatttgcagactggaagaatccaccagaaagtacgaatggatgcttggtgggggttgcggggggagtggaagggatgaagggagagtgagctttttctccgtaaacgtttttatatgttcattttgaactatgttggatattttacttactcaaaaagttttatgcacttcaatccgaagactaatatgagagagaaaggagggattcctctagctcttacttgcttgggtctcctctgcttttattatttctcatgtgccctctcctcgcctcccactgctttgaatctggatgggtgtcgatgggcattctctgtggctgggatccccgttggaagggtgggctctccggcagcccacggggcactcgggaattccacctggttgtgggtttgacagggaggaggggctgcagagcatgctgggagtcttgtcagtttcctgggtccagcctcccactgggatgacagatgctgtgttcctgctctgtaaccttcctagatgtagctgcagcggcttcccttcttgctgcccagagctcagacttcataacccaagggagatggagagggtcggagaggaggttctgaggttagactagagtaggcaggtggaactttaggtaggtggaaagttgcccccagtcctccgaaagggactgcgtaattcggtcacttttgcccacttagcaaatatttatagaccaggggctggggatttagagatgactcggagaggctgctgttcctggagggggacacacagtaaacaaaacgcccgacaggtgttaaactgtgaacgaggcatagcagggtggcatgagaatggagctttagggtggatccggaggtcctccctgaggaggtgataatggaacagaaatccaagtaagaatgagccaggggtgtgcaaatcagtggaaagggcatctcgggccgaggggacgtcgaatgcagaggccctgtggcagggacaagccagcaacagtaaataagaatgcatgagatgaggacacagctgtcgtcagggctcaggctgtggcaggagcctggcttcaggggccttgccaggtaccttgggcaagtcacttatgctctctgagcctcagttttatctactataaaatgggcatagtcatagtacctcccttgaagttgttgggaaggattgagttaatatacatgaagtagttagaccaaacacatgtacatggtttgttattgaccatgctttaaacactcttgtatgtcctggtcgctccgagccatagctgagagttgagtcttggtcccacctctctgagctacatgaccttgggcaagtcatcttacttctctgagcctcagtacccccacctggatcctgaagtcattgtgtggatttgataaggttacgtgcgagacgatcggcttggcatgggaacgtcagctcccagagacccagtgggtcaggcagggcccttcctccaaggccattcccttgggaatcttccctgagaaaaagggagaaaagcctcagggtaaggtggccagaggacagactgagcccacagggctgctgactcccccgcctccctgaggaccaagatgacccctgactttctggggaggaatcagcttggtccctttctgagaacaccatccagaaaggaccagaaggtcaggctgaggctggtgataatgaacataattccccaagcacctgctgagcatcaggctccacgctggtgctctctgcataacactctttatagtaatgatcccccaggaaggcagtgttagggccattttacaggtgaggaaactgaggcttagagaggtaaaccagcttgcctgcagtcccacagctgctaagtggaggagttggagatcatgggatccccaagcctactttctttttttacagttttttttaatttttagtttttgaggcagggtcttgctctctcacccaggctggagtgcaaggggcatgatcaagctcactgcaacctcgaactcctgggctccagcgatcctcccacctcagccttcccagtagctatgactgcaggtgtgcgccaccacaccagctaattttaaatttttctgtagagacaggggtcttgccatgttgatcagactagtctcaaattcctggcctcaaagtgatcctcccacttcagcctcttgaaagcgctggagttacaggcatgagccaccatgcctggccccaagactgctttcttactgccagcatgctttcactgtgtgtagctgccacttgaatttctaggaaccaagaagggataggaaaagactcccgtattttttctcaccttcaggcctttgcacaaaagctgttcctctgcctggagcactgttttcatttgatgtgtacaatcaggtgtttacgtacgggagcctttctctgtctccacccagggtaaggtctaggccgggcgtggtggctcacgcctataatcccagcactttgggaggccaaggcaggtagatcatgaggtcaggagttcaagaccagcctggccaagatagtgaaaccctgtctctactaaaactacaaaaattagctgtgcgcggtggcagacgcctgtaatcccagctactcgggaggctgaggtcggagaatcgcttgaacctgggtggcggaggttgcggtgagctgagagcatgccactgtactccagcctgggcgacagagtgaactccatctcacaaaaaacaaaaacaagaaaaaacaaactcaaacctttcctcttaaccttgtctctctctctttttttttttttttgagatgaattttcactcttgttgcccaagctggagtgcagtggcgcgatctcagctcactgaaacctctgcctcctgggttcaagcaattctcctgcctcagcctcgtgagtagctgggattacaggtgcccgccaccatgctcggctaatttttgtatttttagtagagacagggtttcaccatgtcggccaggctggtctgaaactcctgaccttaagtgatccgcctgcctctgcctcccaaagtgctgggattacaggtgtgagccaccgcgcacagcgttaaccctgtctctttatgaaacgaatgctcattattgttcaggggttggcttacctgctgctcccatccagaaagccatctctccatccgacctttaagggttaaacacccatcctcagcgctcctggagcccgcaatagcaggcatcacaccatgttatacttgtcaactctgtcacctgccaccccttcgaaacttggagctccctagagcagaaagaacgtgtcttgttcacctttgtatgcacttggtggttcagtgagagcataagaggctcacgttaaaggggcacagtccctggggactttaaaactcaaggtgtattgttcaggaacaggcagccactggaaaacccagtgccaccctcaccagctgtcctcggctgccaaccctcccagcatctccccagccccaccaaaaatatgcctgagcagcagcttgccacacagggcatcatcaggtctgcgtgcccaccttccttctccctgcctgttagagtctcattgattgatttaaaccggaaacgagtattcccaggaatcttttctgagccaagaaggctcacatctagattgttaagattcatatgaaaagcccgagcgaaggcgtcccgggggtgtgattgagctcaccttccccacgcacccgtggtgacagcagccaagtggtgtctggtgtgtggaccgaggtacaaagtgggacctgacggagagaagggcttcttgggaattattcacctgagtcagttgtccttcaccaccttgagctggccccacttcctgtcccccccatccgtgtctgctcctggagttggaaaggaaataataagacagaggattctgggaaaggtggagggtctgttttttccttcaggctccaaaacagctcttcaggcatgtctatgttgatgccaagaagctgccagaaggaaaaggaaaaaaaaaaaaaaaatctccagacctagagttcagacctcatgatggtaagagctaatgtttctcgggcgcgtggcatctgccacacgttcagctgagccaggcagcgtatccgcagtagctgatggaatcctcccaggaacacggttggtttcccattttacagatgcagacattgaggctcaagagaggaggtgcctgcccaaggccacaggcatcataatgagaagtagagtcgcaggctggtgcggtggctcatgcttgtaatcccagcactttgggaggccaaggcagggggttcgcctgagcccaggagttggtgccactgcactccagcttgggtgacagtgcgagactgtctccaaagaaaaaaagagagtcggattccattcctggtctaatctcatttggagaaggagctagagatggcagggaggactggcgtagccaagcgtggctggtgggggtggcgctggtttctccactgcgttctcgcccctgggtaatacttcttggttctaaagtctttaagtggcctcagacggtggcctcggctcattcaccaattgccatattctgctaccagggtggaccagatgcggtccctgccctccagaagctcaggggttccagggggacaggggagcaccccaacaactgtagcatagcgggaggaagggtctgatgggccagggtggaccagccagctccacactgttctgtcgtccgccaaagcttggtaagctgaacagccaaccagccagtcccccgtgccttttctcttcctctgggctaggttgtggcttttcccctggcatcttcagggagtccatgaaccccatgaaataggatgtggaattgtctgagtgcctctggggagggccctctgcccttgttagggtctctgaacagtgaagtgttttccattgtatggaaatcatgcctcagtaagaaaatgattcaaacaattacttttattgattgtttaaaattaatttgtttttgagatggccctgctctgttgcccaggctggagcatagtggtgcaatcacagttcactgcagcctctaactccaaggctcaagtgatcctcccacctcaggctccctcctcagacagtggctcctcagcagaggaggaatgaatgtgtccgtgaaaccagggggaaggaccagtcctgtatgctgagctctggggcggggggagaccctggcctggagtcatccacaaagtggtccagatcatgggacccccccagcctctggaaccctttctgccttgactggatgggggcttccaggcctcccctgccctcctctctgggggctcacaggggaaacttgcaggagaatgcccgctgtggaagcttcccacagggctggggatcaaccaaaggcacctgcctgctctagcccatgctggtatttttcattctgttcacctgggccccatcatctcaccatctgtcgcagccacagagcgggaccctggaggatggcgttccatgtgcactgagctcggtgctggagccgtcctgtgccacttcgctcagatgtctcatccaggctgtgtccttctttgagccaccagttccgctccttaaaaaacgcagccagctgtgaatgaggtgacagctgctctttcttgagcacttgtcaatcatctgatctgccgaaaagccctttgagggtgggactattgctgccagtttatagatgggcaaactgaggtttggacagaggaaatgactgcccaagatcacttagttgctgggtagggaatccagactcaaaaccaggccttctagtgggatttgccaagtgcagtgccgggagaaaccgcctctcccgcatgccgagaaccccacatgctctggactgagactctgagagtcggcacatctgtgtgatctgggggaggccatgctgttaccccacaacctcgtcagtagagttccacacattgtttaccaagtcggcaaggggagaactgaaccttgaggcagataggattggttctgggtgatgtggaaagttctggaatctaggtgggttgcccccagggagaacaagctcagtagtgggcagtgggaggggagtggggaccacggctgggaggaagaggcaggagggtgccgccccctctgtttcctagggtctcactgggtggctcaggtctgtttcaaaagaatttgtgttttctctgtgcaagccactggcagtcctctccaagacgtcctcgctccgcagattggtggtaattagatccccgctgcatctttctttcttgcctcccctactgccatcctggcaggatatttttttgtgagttaatggtctccagaatgtatcgtggaaatttaatcaactctcagacatgccatacggcccagtaagacaaacagaataacctgggtgttgataagatgctcttccctttgcaaagcactttaggatctgttatctcgagctgagggaatgaggtgttttcagctcagaagggctcacagttctgggaagaaaactcagggcctcttttgttcttttgtccatgctggtgtgactgtacagggtgagggcctgggcacccctggtcctgccagccttcctgttgcctgctccagcttaattattaatttataaaaccagaaggtcgagtgggtgatttccgctggtggtggtggccacggagcactaggacaaaaaggctctttgtcgtcccagcagtgtgacctttgcagaccggcactctgtcaggagcaagccttccgttcttggcactgctccctggcaggttagtggaggtctcagggcccaggtgcctccaggaggagggcaggtggccaggccggagacagcagtcctcaaaggggggctgtagaggccaaaggtgggctgcagaggccagcttgccccaggtgctgaggttggaagagggttccctaagctcctcctgagcacctgtgccagaatcccaatgatcagagaaccctgagcaaatacccagcactttgcaggcctcacccacctggtagttctaagggggttcttgcccttgcctgcatccccccaaggacctcagccagagtcccactatggcacacaggtggcttctcaccacctgtccttttccagcagatagatgtgggtttatatcatggtattgcctcttactgtctaggcaaagcactttgcctccctgagcctcagtttcttcatctgtaaaatgacagcaaaaatagaacctgtttcactgaatgttgcgaggattaagttagaatttgggcaaagctcttgacccatcctcagtgcttgagagttactggcagttactaatcatttcaactgggaacacttcaggagctggctatgtatctccttttaaaaggcatgctataactttttttagtaattcatttcattttttatatgtctgctatcttggacatgcctaaacttaatcaccatctctgcccttgtgctcataattggggaccttaatgtactttaatttgtatcactccatagtacttaagaacctacatattcattattattctatgcagacactattaattcttgcaaccactcttccttatggatatagttttcttatttaatgcatgtttctgtagatttttcagtgaggctctgtgagttgtaaactttggaaatattgttattttgcaggcatgcatgaatgaacatttggctgtgtgtaaaatataaggttgctggattttttttttttcagcgattcgtttttggtcttgttgctgttgagaaatcagctgttagtctaatcgacatttctttgtagaaacctattttcccttttccctgttttaaaatttttgtcattggtgttttgtacatgctatgtctgggtgtggatttatttttatttatcctgggaatggtttatgttgtttgattctaaagaaagatcatatcttccattatgaaaatattatctctcccctttctctttatcttcttcattagtaattcctattagacaaatgttggttcatctcattctgtctgcatgcctcttaatctttctttcatattttctttttatttcagctgggtcatttccttagatccatcttccagttcactaattctctcttcagctattacaaccttgctgccttaacctattaaatttcaaaaaattgcaatgacttataaaaaaagtttataagtgctatatagttttcaaattcacctctttttcatagggtatggttcttccattgtttgtaataatttaaagcctactatatagtctcttctgttttgccttcttggagtgctattccttttgttaattgtgtctgctgttctcccttatggtggttcatttgcttgtatggtttggttttttgattataagctcatctttgggctttttcccaactccccttggcccttccccctaccaccccacaggattcctgtgtgccctgggttttagaagagccttacacagtgcatttgcatttcttgtgctaggtgtctcaagcttttcaccagtctgaaaacacttttcacattaactccttggtttgggtctcctgccccacagagacttggatttttcaccagtgtgtggctcagtcttggagtttggattcattgcagaagcctgctctttcccctgccgtctccctagcagagatggctgtcttattattctctgggccagtggggaacgttttttctgacccacctgatgtgcagaggcagccttttgtatttcagctttttagaggggtctcagctccagttcatgcagacccaaggcctcttctgtcactcagtggacttgaagtccccacccttagctgttggagcctgaaaccattctaacacctgggccacctcagcagcatctgtcactaaccctgctggttcctggtctcttccttgcccctggcacttgggtattgccctttccttccatttagctggacattacatttgtttcttgttttatccagtgtttgtaatggaaggtagaatctgtattatatccaagtagcaggacctgaaattcctgatctaagtgtcctactgaagtaagccttgtacattttttttttttttttgagacagagtctcactctgtcgcccaggctggggtgcagtggcacaatctcggctcactgccacctccgcctcccaggttcaagtgattcttgtgcctcagcctcctgagtagctgggattacaggcatgcgccgccacgcccagctaatttttgtatttttagtagagacggggttttgccatgttggccaggctggtctcaaactcctggcctccagtgatgcacccgcctcagtctcccaaagcgctgggattacaggcatgagccactgtgcccggccaaccttgtactttagataagcctgtttatgcttgatttggcctcaggataaatctggaactgaagatagttctggaaggctgtgaaaacctgtttcttagatgctctgaaagacacccactcgcccactctcaaaatctttcctgattcactgttgcttttttcccccttcatcatctttagtctttttattaaaatggagaaatttttctctaattacataaatgatatgtatttattgttccatccctcctcagtttgggcatacagcctagccaatggctatgcaaatagaatctaaagtcatggacctcggtctaaatcccagttctgctgctcctagctgtgtgaccttcagggagtgacttagcctctctgagactcagtttctttatctataaaatgggtgtgattaccaccctaaaagggaggcatggccctaaagggaggcaccctaaaagcgaggactaactaagataattccaggcatttggctgagtcctagcctctgggtaaatgttaacacatggtggttattatattattatttatttattgagacagagtctcgctctgtcacccaagctggagtgcagtggtgcgatcttggctcactgcaacctccacctcccaggttcaagcgattctcctgcctcagcctcccaagtagctgggatgacagacgtgcaccagcacgcccagctaaagcacatggtggttattattactgctataaggcgcatggtaaagaacagagcatagctgtaggaagggaacatagatgagcgaaacagactgtgatttttaaagtcacgagcacccactctgacagctttctcagttgccttattgctcatgagagaagagtagattctaaagtcaattcactctgtcccagcttccccttcagtcctgagaattggaggattcattcagggtaggaaaaaacccgcagagatcctaacaggacccttggtatccgaggttgaaataaacactgctgacgtgggcctgtggcagctcttaccaggaattccttggctttcacacttacaaagtgggttgaagttggcatgaaaaagggtattaaggtgctgcataaatgccagcaattaatcttcaagctgctgctgctgctgctctgaaggacagaattgggtttgagagcttccttctcaaggccaagtgcacccaaatgcatctttggttaattttaacatcccagcagctaagagtgatctatggtgtatacgagttcagcacatggcatccaaggaaaaggcaggtgaaggagaggagccagcatccagcatcatgaagtgccctgcgtgtgccaggcatgagagggtagtcccctgtggagtggcccctgcaaggctaaggaggctgtccctccctgcctccctcccaaggcccagggttagtcattgttttggctgtagccgcaggaggcatgcaagttgctgcgtccctggtgagcttgaatccagctgaacagccatgatggtatcacaggattacttagggaacaataataacagtcccagcaaccccagcgtctcctgcatctcctacgtctcctaccagatcctgtgctaagggtgtgcatgatctctttaaaaattgatgcaaaattcatgtaatataaaatttaccattttaggttgggcgctgtggctcacacctgtaatctcagcactttgggaggctgaggtggaaggatcacttgaggccaggagttcgagaccagcctgggcaacatagcaagaccctgtctctacaaaagaaaaattaaaaaaattagctgggtgctgtggtgtgcacctgtagtcccagctactcgggaggctgaggcagggaggatcacttgagtccaggagtttgaggctgctgtgagctgtgatcgtgccactgcactccatccacctgggtgacagagcgagagaccctgtctcaaaaaaaagttaacattgtaaccattttaaagtatacagttcaggccaggagcagtggctcatgcttgtaatcccagcactttgggaggccgaggtgggcagatcacttgaggtcagcagtttgagaccagcctggccaacatggtgaaaccccatccctattaaaaaaaaaaaaattaaagtgtataattcattggcattaagtacattcacaatgatttgaaaacatcaccgtatctatttctagagcattttcatcgccctccaaaaaacctcatacccattagcagtcactccccatttcctcctctcccagcccctggcgaccactaatctgtgttctgcctgtgtggatctgcctgtctggggcatttcatgtaaatagcatcctgcagtaggctggccttgtatatctagtgttatcccttcttggagtatgacagggctgcctccttttgtattgctttataacatctcatcacctggatatacccattttgtttttgcactcaccagttgttggacattgagtagttgccatgttggtggttgtgattgtgaatagcttgtggtggtttttcatgacatgaacaacctcacaagggaggacatcccgttgtcacctctgtatcacggaggaggaagcagcctcatgagttcagggtgacagctgagtgggatgcatagcagagactcacagcagcctcccccggcagcactgtcaggagctcacctttccatccagcctggctcacctctgtattccgggatttccccagtgtttgggttgagtcctggccaatctttcaagaggtggcaagcaggagagagctggggtcttggaagtcactgagccccccagtgatgccccttggtgtcctggggctggcatccaggctggcacagctggtggggccagtgggaggcagggtggcttggggagtccctggggcacgggagaaggctctcagctgtgcttgcttcttccagtggggccttgccctgagcccttccaccttctgccttcccgaccctcaccctgggcggctgcacctgctgtctctcagtctcatccacacccacgctgtctattgccgggcacttcagatctcgttccctggcttggtgtcctctgtagactcagggcaagtccaaatgtcctggactgatagatgaggccttcacgcccccaccaccccagctgcttcattccctgcctgttttctacccacactgaagagcccgaggctccctgagccctgtgtgttctgcctctgccaaggctatgccttctgccagccctgtccaccccacccccagaaccccattgggcatcacctcctgctcccatccccgtggcctagaacctccgctgcaaccctggtgccccttggccagctgaagcagcgtttactgtcctggatcctggcgaggggatgtgcatttctagcagagtggggctgcgctttttgcatctgctttcctggcctctagcaagcacctagcaaaccagaggtgctcagagggccatgcaagcacaggtggggccttgggggtgcccctcagggcccacacactcctgggggccagcaggggttgtgggaagaggaggcagtggtgtgcatgcccctcatctgggtcctgggactacaggctcacagagtcctggtgccccaaaatggatgggagcgcatgctgacattctctttcctcctgagtcaggggagggaggctggactccagggtggatttcaggcctgctcctctgctcctgggcccctcccatcctccctgttctggaccattgtccttgaccccctaccctgtgtggctctcctcccactggtgatgccttgctcagcacagcagggctgcaagcaggtccccacagcctgatgggggaggccagggccaggcaggcaatgcgcttaccccagcattcagaaccctttgcagtcgattgccaatattttttaacccagcggatttctgcctcctcttaatgaaaggggaaaatctggcctcccatggcagcaactggctggagggaacggtggcagccccttcgacagggtgggactccagttcatgcctgcacgggccccttctctcacttcatgcctttctgaccctggagacactgaaattctcaaccccaccttgacagcatctgaggaaggaattggcttctattgccccttcatccccaaggttaaacagtttttacattgacacctaattcacagctgatgacatttaccatttaaaagtgtacagttcagtggcttttagtatattcacaaagttatacaaacatcaccactgtctaattcttttttttttttttttttgagatggagtcttgctctgccacccaggctggagttcagtggtgctatctcagctcactgcaacctccgcctcctgggttcaaacgattctcctgcgtcagcctccccagaagctgggactacaggtgcgtgtcaacacatttggctaatttttgtattttcagtagagatggggtctcatgttagcctagctggtcttgaatttctgacctcaaatgatctacccgcctcagcctcccaaagtgctgggattacaggtgtgagccacagtgcctggccaccactacctaattgtagaacaacttatcacccccaaaaggatacccactggcagtcacttctcattccctcaacaccctccagcccctggcaaccatcaatctacttcatttctcactagatttgcctgttcagggcacttcgtgtaaatgggatcatacaccgtgtggccttgtatgtctggcttctttcacatcgtgtgattatttcaaggtttatccatgctgtagcatttaccaatgcttcatttctttttttgctgaataatgttctgtcatctggatgtgccacattttgttcacccattcctttgttgatggacgtttggattgtttccacctcttggcacttatgaacagtgctgctttgaacattggttacaggtttctggtgtggacgaacattttcttttatctcgggtataaatggaattgttggctgggcgcagtggctcacgcctgtaattccagcactttgcgaggccaaggtgggtggatcacctcagatcaggagttcaaggccagcacagctaaaacggtgaaaccccatctctactaaaaatatagaaattagccaagcgtggtggcacatgccacccagtgcggggaggctgaggcaggagaatcacttgaactcaggaggcagagattgcagtgagctaaggttgtgccactgtactccagcctgggtgacacagcaagactctgtttcaaaaaaaaaaaaaattgttttggagtagaattgctggattacatggtaattctgtgtttaattgattgaggaactaccaaactgttttccacggtggttgtaccatttaaatcctcgctagtaatgtatgagagtttcagtttctctatagcctcatcaacatctattatttcttttatttatcattatagtcatcatggttaaaaaaattttaacccaaatacaattatacaagtaatctccgtaaattgcagaaaagttaagggacagataaccaaatttagggtcaaagggaggaggagaaaaatgttctgtaattctaccatctgaaaacaactgactactattattttgttgtatacccttttctattttttcttgtgcacatgtgtatatcaatatgaactttcacgtgtaaatgagatcttagtctgttggattttccgtgcaacaacatgccatatgacattttccgatgtcccacaatattcaaaaaatatttataaaggctgtgtagtattctgacttcaggatgtaccaggactcatctgtctcattttctgtggctcagtatttcccccaatttctttttttttttttttagacaaagtctcactcttgtccccccggctggagtgtgatggcactcttggctcactgcaacctctgcctcccaggttcaagcgattcttctgcctcagccctctgaatagctgggattacaggcacctgccaccatgcccggctaatttttgtatttttagtagagatggggttttaccacattggccaggctggtctagaactcctgacctcaggtgatccacccgcctcggcttcccaaaatgttgggattacaggcttgagccactgcgcccagccaatttcttttctttttgttttgagacagcccctcgctctgctgctcatgctggagtgcaatcttggctcactgcaacctcaacttcccaggcttaagtgatcctcccacctcagcctcactagtccacacccagctaattttttgatttttttttttttttgtatagatgggatcttcctgtcttgcccaggctagtcttgaactcttgggctcaagtgatcctcccacttctgcttcccagagtgctgggattacagccacaagccaccacacctggcccatttcccccaacttcttttctttttttttctttttgagacagagtttttgctcttgttgcccaggctggagtgcagtggcacgatctcggctcgctgcaacctccacctcccaggttcaagtgattctcctgcctcagcctcctgagtagttgggattacaggcatgcaccaccacacccagctaatttttgtatttttagtagagatggggtttcaccatgttggccaggctggtctcaaactcctgacctcaggtgatccaccagcctcggcctcccaaagtgctgggattaaaggagtgagccaccacacccagccccccagtttcttactgttctaaacaggcaaccttgattaccctcatctgttcatctttatacgcctgtcttaattcctcaggatttgttcctagggatcaagttctgattcaaagggtatataccaacgctgcccaacacaaataataatgtgaggtgtaatcatggtaaattttctagtagctgtaatgtaattacattatgtaatataattctaaattttctcgtggccacattaagacaagtaaagaaattaatggtgagatgaattttaatagtgtattttatttagcccattatatttaaaaatgatcatttttaccatatgatcaatatcaaaagttattgcagttgtctgtgttcttttttgtacttagtcttggcaggctggtgtgtggtttccacttcagcccatctcagtctgggcttaccaccttcaagggcttagcagccacttggacaggccaggtgtgttccttcacgttgaagtttatgatacaaagtgacagttcacctccatctccaaaagattaggccagttaaactcccaccagccccatggactggtgtgcatttccctcaggttgaaatctaaaaccagaaataatgaggtccagctgccaggaaccaaagcccattctgcccatcatccgcatggcaactgtgacctcagggccctggagaagggctcagaggtgaggagcaaggaaactggaaaagctaccaacccaggagcccttgaggaaaaggcaggtccttccgtgggctttggggccctgatgcaggcagacatgcatcaggtgcttatgcgaggggccctgttgggggcccagggtcagcccgggtgtgggggcagggaaggggttgggggggcgcagttaggaggaagcagctcaccagacatgttgggttagaccagctccacctgccagggcctggggtgttctgaaagtcagttcctgaggcttcggaaatcatcctttctctcagttactgtgccagaggagtcttccctgagctgtgagctgagcccttggctctagggatttgggtgtcaaaaagagggccccagaggtgggaggttgtcttcctaatcctttgctttcaatcaggcaggacagagggagtatgtgtatgtgaatttgcacgtgtgtgcatgttctttttttttccatcacccaggctggagtgcagtggtgcgatctgggctcactgcaacctctgcctcccgggttcaagtgattctcctgcctcagcctcccaagtagctgggattacaggtgcgccccaccacgcctggctgatttttgcatttttagtagagatggggtttcaccatgttggccgggcaggtctcgaactcctggcctcaagtgatccacctacctcagcctcccgaagtgctggattacaggtgtgagccaccgcacccagccttgcgtgcactttggatactgttaactggaaactcttcattagataaccttgatctaggatgatttatatacctcttcctagctgtgggaccttgggcacatcccagagttctcatctctagaatgggcgtagaatcatacctacctaacagaactaaggagagggttgtaccagcccaggcttatccaagtagttgaacacagaggccaggaaacggtaaatgctcagttaatgtctgcccttgttgttatgattatgcatgtaatttattttttaaatagctttattgagatataattcacacaccatgagattcacccccatttaaattgaaccccatagttttagtataatcacagggttatgcaaccatcaaaacaatataattttggaacatttttatctctctctaaaagaaactccagtgcccattgacagtgtctccctgttctccctctccagcccctcccctccctggcctcaggcagccactggtgtactttctgttcctaaggatttgtccatctgagcatttcatgcaaatggaatcatccagtgtgtgtcctctccagtggcctctttcacacaccaggatgctttcaaggtaacgctttttttttttttgagatggagtctcgctttgtcacccagtctggagtgcagtggcacgatcttggctcactgcaacctccgcctcccgggttcaagtgattctcctgcctcagcctcccaagtagctgggattacaggtgcctgccaccactctcggctagtttttttatttttagtagagatggggttttggcatgttggccaggctggtttcaaactcctgacctcaagtgatccacccgcctcagccccccaaagtgctggtattacaggcatgagccaccacgcccagccataactcatctttaatagtggttgtttaggtgcacctgtttagctgtaatttctaatcttatttatcttcagatcagtgtgttttgggggttaagtgatcatacaaaaggagacagacaaataaaaaaaagaaaacaaaacacagaactacatgttttctgccagacagaccaagttcaaattgtgggtctgcctctatcaaggtcagtgaccttgagcaagttacatcccttctgagcctcagtttattcttctataaaacgggaatagcatgtccctcatagggtcatggaaggaactaaagaagatgatgtgtgcctgggacacagtactcagccagtgaatgacttattaatagcagtatttatgagatccctcagccatccagatgggatcatgttgtaggctgaaaaacttcattacaagactaatacatatacattgtacattagagaaaaatgggaaaatatagatgaaccaaaagcaaaacagtctttaatccaggtattgagatgagaaataattattattattttggggaaaataactctaggatttttaaattacttaaacacatttgtatatttttatgtcttttccacaacacagagttgtgctctcttggtagcaagctgtttttaggcagtatatgtggaatgtatttctatgcaaatacacaactgtcactgttaaaggcagtatacctaaaaacaattttttttcctccatcttgcactctaaaggtatactttaaacaaaaattggctaaacataccaaaaagtgtttgaccaatctgttttttgctttttttttgaggcagagtctcgttctcttgccaaggctggagtgcagtggtgcgattttggctcactgcaacctccgcctcccgggctcaagcgattctcctgcttcagtctcccaagtagctgggattacaggtacctaccaccatgcctggctcatctttgtatttttagtagagatggggtttcgtcatgttggccaggtctcagactcctgacctcaagtgatctctgcccacctcagcctcccaaagtgctgggattccaggcgtgagccaccgtgcccggccccaatctgcttttgatggtcacttagggcaagtcgaattttaagctattttaaataatgcaaagttgaacacatttatgtattcatgtttttgtacgtgttgcatctattattttttaggatacattcctgccaagtggaattacaattttaaaaaatttttattcatttttcttttctcttcccagatctcctttagtcagggaggaataacacattttttttttagtaaatgttttgtcgtgatatagtgcatatccagaacagtgcatcactcaagcatacagacagctctttgaggtttccgagaacacgactatgtaaagtgtacggagatctagaaatggaacattcctagtacccagaactcccctttgcactccattcaagttactcctcctcatctcatcctccaaaagtcagttacaatattagcgtcatctatgatgcctcccttaagagcagccactatcttgacctctaacattgtagttgagttttgcctgtttttgaactttatgcaaatagaatcataaagtatgtacactttcctgtctggctgcttttgtctgtgattatctatattgttcattttcactgccatgtgctattccattgcttgactatattacacattagcactctactctgccattgttgggcatgtgggtagtttccagtttaggacgattccaatggcaccgccatgacatctttgtacgcatgcttgggtgaacagaagtatgcgttatttgtgtatatacctaggagtgcaattgctaggccatgaagtagccagtgtccttgctgacatacctatgatctaaatggccatatttccctgcagaaaggtagaaattgcactttgatgattcacctaaccgttccaagtgtcagtggctacatctgtaacaagaggatacagccccctcctagagtgttgaaaggaagagatgagctgatcattggagccatgcccacaggaagtagagagccctcagtctgggttgacagccttaacgagctgctggagatgcttgagaatactgagctgttgattcttgaagagcctgaggccaaaaaacaatgagcaggaagtgaggtgaccagttggccccagaaattagctgcctctgtaacaggagcaaaacagtgcttaggggtagggaatgctgggaggactgaggtgggaggtcacagctccgcagtccagcccgtgttttggaaaggtttgtgtgaactgtatatagtccccaggaaccagacctaaagtccttgagtgccaaagtactctgggcagacaggcgatattacttcttggtgaaggctggctttggggtcagtcgcacagacttggagttcagtcccagctctgcctctgtgtgttgtgggatcttacgtgctctctgagctgcagttttcaaattataaaactgagataacggccgggcgtgatggttcacacctgtaatcccagcactttgggaggctgcggtgggcggatcactcaaggtcaggagttcaagaccagcctggccagcgtggcgaaaccccgtctctgctaaacgtataaaaattagctgggcgtggtggcgcgtgcctgtaatcccagctacttgggaggctggggcgcgagaatcgctggaacacggaggcagaggtggcaatgagctgagattgcaccactgcattctagcctgggcgacagagtgtgactctgtctcaaaacaaacaaaatacctgagataatatccactcacttattgagttgttttgataatgaagtgagaaatgcagatcattgtttaatattgtgcattttttagagacagggtcttaccccatcaccagattggagtccttccatttctttgctccaccagattctccatacatttctcagtgtaggtttcccagatcatgtccaacaccagcctgaacccttatttcctctcgctactcatctgactctgagtctgtgactataaaaagcccctttctcggctaggataaaactcatcttctggagtggaagaggaagagtcagacaaccagatgcagttttctctaggctgggcgtggtggctcatgcctgcagtctcagcaccttgggaggccgaggcgggcagactgcttgagtccaggagtttgagaccagcctaggcaacatggtgaaaccctgtatttctaaaaaaaaaaaatatatatatatatacatacatatatatatatatatgtatatatacatatatatatatatatacacacacacatatatatatatatatatatatatatatatatatatatacacacatatatatatatatatatatatacacacacacacgaaaattagccgggcatggtgacacttgcctgtagttgcagctacccaggaggccaaggtgggaggatctctggagcccaggaggtggaggctgcagtgagctgagatgccgaggtcgtgccagtgtactccagcctgagtgatggaagtgaaaccctgccacagaaaacaaagtttctctgtagtgggctgggtaaggtcagaggctgggagaatggcctgcttcatgactgccctgtctcaggagctattagtaatagttgtattattattactaaggcagttggaactgatgactgcagagctgtttctgggaagaacgggaaatcctttctctgctgcttcacccggcactcgcttttgccatggtgggagatgctttgagaaggggtgtggcagccagtggggatggggcaaaagaatatctgcagcctccctctgacagtcagtgatttttttttctgtcttgtttttctctctttcccccacttctcagtctcatcggatcagatcgagcagctccatcggagatttaagcagctgagtggagatcagcctaccattcggtaagattggcagcgggtttgggtgctgggtggggccatgcccttgcaaatttcttgtcctgtttcttttcttgagtgctgagtagcgggggtagttgttttctttttattttttatttattttggagatggagtctcgctccgtcgcccaggctggagtgcagtggtgctgtctcggctcactgcaagctctgcctcctgggttcacaccattcttctgcctcagcctcccgagtagctgggactactggtgccctccaccatgctcggctaatgttttgtatttttagtagagacggggtttcaccgtgttagccaggatggtttcgatctcctgaccttgtgatccacccgtctcagcctcccaaagtgctgggattataggcgtgagccaactgtagttgttttaatgcttctggtctcttctaagacaagatgttcccaaacagtaagaaagaaccacttctgtttctatgaggatcacacaattataaattataactatcgtggaagcgaggaagggctcttcagccaccccatgcctcaccctgacttcctcggatggaatgtgcttggaatctcagacacatatggaggtcctgttaaatcccagggtccttccaactgccgggcacacaaagatgtatcagttgtggtgcagcccgacttaggggctcaggctgccatcaggacctctgtcttttgactctccttctttagggttagttctggcctcaggcaagatgggggtggccgcctcaaatttctgttaaggaaaatcaaccttctgcattgtgttttgttaatcttttagatacctttaggttgctttttaatgaagaggaatgccttaaactgtattccggttgaattatttgttatttgggtatttttaatttttttgagacacggtctcactccgttgcccaggctggagtgcagtgttgtgatcatagctcactgcagcctcaacctcttgggcccaagcgatcctcctgcctcagcctcccaagcagctgggaccacaggcatgtgccatcacacccaggtaattttttatttacttttattttcgtagaagcagggtcttgctatgttgctcgggctggtcttgaactcctgggctcaggtgatcctcctgccttagcttcccaaagtgctgggactacagccatgcaccaccacaccagctaattttttaaagtttttgtagagatgggggtctcactatgttgcccaggctggtctcaaactcctggcctcaagcagtcccctcatttctacctcccaaagtgctggcactacaggtgtgtaccgctgcaccagacctgttaattgttttgtattttttttttttgagacgtggtcttgctatgttacccagggtgatcttgaactcctgagctcaagcagtccccccgcctcagcctcctgagtggctgggattacaagcgagtgctgcttgagttacttacagctgggttagtgagaggtccttgccagtgacttgatcgtcacacagagttcatggggaagcttcaagttgaacaaatttctaccataaacttctaacagatgtagtttcctaaaataagcattcagagtctcaaggttacagcttgttggaactttgaaacaaaccttctaatactccagggaaacttccttcttggtaaacagacttaaatttcccctaggttttatggaaactgacatataaatgtccactttctcttgtttgtctaaacacaggcatattgttaatccagtatatttcattcttaatttcaagagctcagattctgacggtctcatgattcttgtggcctctggtctcagtttgattgcatccaaggccgacttaaagacaattaagatttatacctttaattctagacatcttgcccaccaagcccagtggaggagagagaacctgagcccagcggaagagtcacctggcttctcattggctctgatggggtcacgggcctgagtctgagccaatcgccatggccaaagaccagacatgcaaatgttttcccctagagctataagggcatggggcctggggtcagtttcctccaaggacagggatggagggcgggtggtttcaaccagggcaaggtgaaacctccttggtccataggctgaggagtgtgtagcatgacacaagtcagccaggcactgagatctagcggggaggtggcatatatggacactggatgctggaaaacagtgtcaagggcgtgctttgcttgttccttcagaagttaatgagcagcctgggcaacatagcaagaccctttctctacaaaatatttaaaaattagccaggtctggtgatgcacacatgtagctctggctacttgggaagctgaggcaggaggatcacttgaacccaggggttcaagactgcagtgggctatgagtgcaccactgtactccaggctgggcaacagagcaagaccctgtctcttaaaaagttcatgagcatctgctctgcgccaggtgcttggtacctacgctggtagctgcagccgctatggagctcacagtggaggatgtgggaaggcagagcccctttgtcctcaagacagttttccagcaagtggagcccccagccctgtaacaaactgccttggacttattgttatgcatctgatgttagatccatccaactttgggtggtgaactttaggttcatattctacatgcatagagatgcagaggcaaaaacccaggcttcggagtccaactgtattagaatccttcatgccattggctttgtggcttcgggctggttacttcctttctctgagctggtctcctcatctggaaagtgagcatggtcacttgggatttgatttgagcattaaaaatgagcagtcggccgggcactgtgactcacgactataatctcagcactttgggaggccaaggctggaggatcgcttgagcccaacctgggcaacacagtgagaccccatctctagggggaaaaaaaagcaggtgcaagcagggcagtttagctctaagctgggttcacaggcatttggcaaatggggctattcttccaccccatcctgagggtctaatctgagtgtggtgggggcccaggtgctgtgtgaggaggaggatatgaggctgttggaggcccctcccacttttaggttctaggcgctgagccctgatgcattgcctagcaccccatcataagcttacaatgggacgtactaaaatggcattccctacaacagtttttttccaacttgactgtgctcgaatcacctgggaatcttgctgccatgcaggttttgcttctgcagttctagggtggggcctgagactctgcatttctaacaagtgcctccgttgcccagcactgtggacagcacacagtaggtcctccatggttgagtgggtggagcgtcctcctcctgcaggagctgagctggcgcggcctctctgtgctgatggcgccggactcctacctcccaggcctcacctgcccaggctcagcttagaaatgtgagccgttggtcctgccctgccaccccaaaccctgtttgcccctctcctgcacacccatccccaggacctcatatgtagcacccttgcacaagccctcagtgtgcctgcctggcagggtcattcaaaggagctagtgagcagcctctgctcaacagccctcttgatggctacccagtgccatcaacgtcatctttgtgttctttatgtgggactcacacaggtgtgtagatgctggcttctgctttgctgaggcctcagtgtggaccacatttccaagacacgtctcctgccccgtgaaggcccacagcctccttctgggggtgccccatcccaacattcacagcacagaattataactgcccccacatcccctcaccccagcagactgtggcttcttggagggcaggaactgattgcctttttccttggccaaagtgctgagtccagggcctgtaacacagtaggtgctgtgagagtgctcaaatgaacaagtgaagggatgagtgaataaatgaatgaatgaaagaacaaaggaatgaggagtgaatgtaatgactagcagaattctttccagcgcaggaagcgtggcctacgtgaggcctgttgtccttaatagtacttccttgttaggttgatgtaatccaggtgaaagaattcagcaggggtcttggcacgtagaaacagctcacaaatgtaagctcttattatttgaacgtgttttatgtgctacacagcaggattgtgttactttaatctttttttttattttttgacagagtctcgctgtgttgctcaggctgatgtgcagtggtgcgatcttggctcactgcagccttgacctcccaggctcaagtgctcctcctgcttcagcctcctgagtagctgggactacaggtgtgtgccaccacacctggctcattttttgtatttttgtagagatgaggtcttaccatgtcgcccaggctgacttcagtcctacagaaccccataggaagtagaggtagggacgctcactctccccattttacagatgggaaagtaaggctagagagagaggccatgtacctggccctgggtcacacagctcataagtggaggagctggggtttgaacccagcgccaagatcctgctgtaggaagccaggggcattgtcttgatttgcaagtgatctctaaggacctcagtcttcctgccctgctactgggggtgggggaggtgcgtttataattcccgtcaccactgccttggtctcagagcttcagagtcggcttcgaggttcgtgtcagctgcacatagtgacagccccagcccagcctgcaggaaggaggtgactgaccacagcttcttatgcaaacaggcctacaggaagggcctccttccagcctcccagaactgctttgcctaatcctaatccaccctccagggcctagagaagggagatgaggtagcttttcaaggttcccctggccttttcctgcccatcttcccctgagcagccctggcttgggaactgatccccagtgctgtcccctctctgccaggggttttctaagtgaccccaggcccggtcttcaacctctcagatcctggcacatcttggaagctgtccaacaggccctgggctgtgctgggttttcagagcatggacaaaattccttttctttctggggacattcccccacatgaaaatggcgttgattggggttccctagtgaaggcccctggcaccccactacaatctgcgatgggggagagggtgccacctcctttgccccttcccgctcagacagcgaaggacccacgtgcttatgaggatcccacaggaggctcgtgaagaccttgaatgcaaaagtccccttaaaaatgatcattcagaaccacaggctttagatacagatgaataagatttgtaagttgcacttagaagtttaaagaagaactggatttctaaatgtgcggcttgacaaattgaatatagctttacaaactctcatgaggcaattgatggaccaaaattgattttgtttttaagccaccgtttcttatctgtgttgggcctggtcccatctctttccagaagtcatctgaggacatctaggggagggttcgtcttgcggcattgaaagccccacttcaaggccttacttttgcgtgggttctttacacagcccggtacctgatttttagacattcatattgttggccgggcgcagtggctcactctgtaatcccagcactttgagaggctgaggctggcggatcacttgaggtcaggagttccagaccagcctggccaacatggtgaaacctcgtctctactgaaaatacaaaaatcagttgggcgtggtggtgtgtgcttgtaatcccagctactcgggaggctgagcaggagaatcgcttgaacatgggagggagaggtcgcaatgagctgagatcatgacactgcactgcagcctgggtgacagagcgagattctgtctcaaaaaaaatttcattttgttatgttccctttttaaaagagggaacccccaaatcgtatatgcttcaggatcctcaagacctgaattcatccagaccacaaagcactgaatttctgtggcctctcggcaaaatgcctgaatagaaaagaaaaaaaaaaaaggaatttctatctaattctaacacgttcattagccacctaccattcggggggctcttcccctgtacactcagaaattttccatctagcagaggcgacctccacaggtaaacctgttaaaaggtcagaattttaaataatgaagaaaatacagaaatagcttcttgcactttttctttctctttttgggccccttaactggtaaatgttttaaacaacaatttttaatttcctgatagcacgctggcaggcttataaatgccagaaatagacgctatggaatacttcagatgtagtggtgcaggccattaggaggcatgattagataaagccacattacaaaaaatatttttaggttcatcgagccattgactgtggagtaattccggaggtaaatgcaaccacagacgtacacagggaagagaaaaaaaagggactccatgctccatgtcaaatgccaccaacgtgcagccccatgttctgatagcccagacagtggggcgtcagcaaaatgtcctaactccaggtcctgtttttcttccttcagcagtgttccttttgtttttctctttgagacagagtctcgctctgtcagccaggctggagtgctgtggcgcgatcttggctcactgcaacctccccgtcccaggttcaagcaattgtccttcctcagcctcccaggtagctgggattatggcacccacctccacacctggctaatttttgtatttttagtagaggcaaggtttcaccatgttggccaggctggtcttaaactcctgacctcaggtgatccacccgcctcggcctcccaaagtgctgggattacaggtgtgagccaccacacccaggccctcagcagtgttcttaccactgctctgtcattttttgaagttaccacaagattggcccagtgcagtagctcacacgtgtaatctgagcactttgggaggccgaggtggaaggattgcttgaatccaggagtttgggacgagcctgggcaacacagtgagactctgtctctacaaaaaaaatttaaaaatgagccgggcatggtggcatgcacctgtggtcctagctactcaggaggctgaggtgggaagattgtttgagcctgggaggttgaggctgcagtaacttgtcttgccactgcactccagcctaggtgatgaagcaagactgtctcaaaaagaaaaaaaagcacggggttgtgagcagaaatgggagcccagctgccagcagcagagtgctaacatgtgccagacgctgggctcaacgctcacatggtctcaggaaccctctgaggttgacattattatccccattttacagattaagcaactgaggctgaagaggttaaaattacacagtaggtcctcagttcaaaagcaaagctggctaatgcaagagatgtagcctcaaaccactgcagtgatgttgctcttcatccagaattaaatccccttttaacccagtcactttgctttgtttttaacctgtctatgatatgaccactttttgaggggatgggagcaagatctcgttctgttgtccagactggggtgcagtggtgcagtcatggtttactgcagcctccgactcccgggctcaagcgatcatcctgcctcagcctcctgagctgtagctggggccacagatgtgtatcaccacatccagctaattaaaaaaaaatttttttgtagagatgcgagtcttgctaggttgcccaggctggtctcggactcctggctcaagcaatactcctgcctcagtcttccaaagtgctaggattacaggcatgagacaccatgcctggcctcgacagctttttttagaaatactatactcataaggaagttgctgaggccctacctagctcagcaggctgtttcaccatcagaatttaatatattccaagaggcagcgagtcctccctttaaaagcctcagctaggatgatgcacgttcacttaaagaggaaaacctgctacggtagctgtaaagatgcccagaaaagacagcgggcgtgaggcagctggactcgcacatctgcttaggtgagagtgttaaggcagacgtgaggagagccaccaagggggtagtttggtgtgaaaaggtgcggaggcgttcccgaggcaaaaagcagctttctaaacagtcttagttttattagcaggtactcgcatataaaacttttatagagattcttttcccaggatggttgatactgacatggtccttgcttacaagcctgcaaatgtccagggccttccgtgatgggttttagagctgaggatcctacagggttgagaaggggaggctccccttcccctgctggggcacttctgttctgatgcttatgtgtgtgaggggtagtcagagagaaagctagcacatcagccagttcatgctataacatgagcaatatactaaggttggctgggcatggtggctcatgcctgaaatcccagcactttgggaggctgaggcgggcggatcacgaggtcaggagatcgagaccatcctggctaacacagtgaatttctactaaaaatacaaaaaactagccaggcgtggtggtgggtgcctgtggttccagttactcgggaggctgaggcaggagaatggcgtgaacccgggaggcggagcttgcagtgagccaagatagcgccactgcactccagcctgggcaacacagtgagactccgtctcaaaaaaaaaaaaaaaattagccattcatggtggcgggtgcctgtagtcccagctactcagaaggctgaggcaagaacatctgttgaacccaggaggtgaaggctgcagtgagccaaaatcgcaccactgtactccagcctgggcgatagagtgaagccctgccccaaaaaaaaaaaaaaaaaaaaaaaagctaaaggaaggaaacagggcagacagccatcccctggaaccctagggaggagagggtccttggggtaggtggtcatggaaggtgccactgaggaggccacatctgggctgagaccaggagagaaggagccggtgtgtgaagagaagagggaggggagctctaggcagaaggcccagcacatgaggagaattggagagttgggtgcagatcacagagggtttgcctttgccctagtgatgacttgggtttccttttgtccttgaaataaaatgcacagatgtggcctgaaacaccagctgtatgttagctcctacttttttgttgttgttttgctctgttgcccaagctgaagtgtggtggttcgatctcagctcactgcagcctcaaccacccaggctcaagcgatcctcctgcctcagcctcccagaacttacaggcatgtaccaccatacccggctaatttttgtattttttgtagagatggggtcttgccatgttgccaaggctggtcttgaactcctgggctcaaggagtcctctcacctcagcctcccaaagtgctgaaattataggtgtgagccactgtgcccggccagctcctacatctgtatgtcctcccaggacctctcccctgagctcctgactcatgtagcaactgcccatccacttaatatccaataagacatgccgcttaacatgcccctttcaaagcaagcacctcctcatccctcccagaggtcccccgttcctctgtggtgaacggcagcctcacagttccctgcagtggtcacctttgattcctccctttgtctcagccctgcttccagttcatcagcaaacactgccatttctacctcccaaggagcccaggatttgctacttctctccccttcttcctctgctcccccagcccctgccctcatccagctgccatggtctctggcctgggctaccccaacagcctcctccctggttcccctgtgtctgtcttcactgtccatccaccatccaggctcacggtaccatgtgggagggtcctatgagactgtctcttctctgctgaagatgttctgtctcacccattgggagtcagagcctccgctgaggcctctcagtgtccttctggcccctgcacggttgggcccctgccacacccatctccaattatttttgcccaagttacatgaacattctttgttccccaccccagggctctagctcatgctgttccttcttcttagaatgcttttcccctagagcagggtttttgagcctgggctctggggctggatgattcttcactgggggttgtcctgggcactgtggggtgctgagcagcatccctggcctccacccactagatgctggtagcaccctccccaccagctggacacatgggagtggagaacctcccctccttcaggtctctgctcaaatgtcacttttttccctgtggcctttctgtggtcaacctcatttaaacttgtaccggtctcctgtggtcccctccctttctctgctgaatttctctgcaaagtactcatcactccctgagatactctatttcccatcttttttgtgctctcctagattccccgtaagggatcgtgtctgtctttacctctgcagctggcacctagaacagtgcctggctccttgaaggggctcgaatgcttgtcgctgagttgctttcactgtaagaagtcaattccaggtgttggggaaagtgggggactgacatggggcagggacagggatgagaaggtgtttgcctgggggagtggtcttggcgacgttgtccagcttttcaaagaggcatttgccaggagcaaaaaggaccaggcctttcttgccagaatcttctgtgcaaaaatgtggataggagaattgcctagcacatttgcacaattccaggtgctttgaaacattgagagattaagaggccagcagttctcacgcattcatgtgtacgtgaatgccctggggactgcgttaaaatgcaggttctgtaatgccagcactttgggaggccaaggcgggaggatcacttgagcccaggcgttcaggactagcttgggaaatatagtgagaccctgtctttaccaaaaataaattgggtgtggtggtacacacctgtagtcccagctgctcaggaggctgaggagggaggatcacttgagcccaggagttcaaggctgcagtgagccatgaatgcactactgtattaatgcaggttttgattcagtaggtctggagtagggagagatggtgcatctctaataagctccaggtgatgcagatgctgctggcccagaaaccacactttgagtatcttggctactgggaagacatgtgctgagtgacatgcagtctctgccttgaagagtctccatggggcctcagcttccccactgtgggggacaccacatgctgaacagtgagtgcaggaaggggaatcagaggggcactgggcaggcagtgcaggaaggggaactcagagggacattgggcaggcagcccggcaaagtggcctccctcagtgcagggagccctggagcggtggaagttccggcctgagaatctggggcctggctgcaccctcaccttggaggtcggttagccttgtggtggttggtgggggttggggagctccatgctcagtacccctagagagaactttgcaactgagctgggctccgaaagccaccggaaaccaacccacaccacgaggcttgaggaagagcccagcacagtcctcggtggttttttgagcctggtccttcccttcttgttggcctgacgcttgtcctgccctcttcctgggtcccagatggggcctcttgggctgagggctgggggctgggtgagagcagatgcctcgctctttctctctttaacgtaaaaatgcgcaactggaaggaaggaagtggtgagagtgaggaagcgcaagatggttcgagccagcctggaggcagagctggagtcccgcgccaactctagctgtgtgactggggcttagtctctttgcctctctgggccttgtgttctggtctgtaaaataggatcatcattgttgccactcatgattatgtgggggtgattaagtgttgcagtgcttagcacagcttgatgtcacgcgagcccttcatgactccagggggacattctgaagccccgagggctcaagctctcccgcaggaggcctggaaggtgtgtggccctggagccctcctgggcaatccccgctacccctgatggtcactggggcaacaccactggccatgagaatcagctctggctgagggcagtgacctgccgtcagccctgggctctgaggtgaggcagagcctgttcccatggctgcagcctgggctgcgacacctttagaaaagccggttcatccagcccggcggggacctagggaggaaggaaaacaaaactgacacgagtattgatggagcatgaaactgatgaaatgaaaaggttagcctgtcctaagcgctggactcaaggccggtgctctccttgttgaaaagggacattggcaggttttagggaaagtccctgaaggccaggcaccaaccaccatgccactgcctgggtccgccagtatcattcttaacaatgagaagtggcttcatctctctgcctcagtttcctcatctttaaaatgggcacaggccgggtgcagtggctcacacctgtaatcccagcactttgggaggctgaggagggcagatcacctgaggtcacgagttcgagaccagcctggccaacatggtgaaaccccatctctactaaaaatacaaaaattagctgggcatggtggcaggtacctgtaatcccagctactcgggtggctgaggtacaagaatcacttgaacccaggaggtggaggttgcagtgagcagagatcacgccactgtgctccagcctgggcggcagagtgagactccgtctcaaaaaaaaaaaattaagaaaataaaatgggcataagtacctactttatagggttgttgtgaaccctatgtaataatgtaaagctcttagaatagttccttccattttgagggtacgtaggttagctgctgttacattattattattactactattaatactgctgcagcgattactgttactgctgctgccgttattactgttattattttaaaattaagagctcatcctgtgtcaggcagcctactcagcatcttatgtggatttatctcatttgatcatctcattagccccatcatgttacctggatattcctatgatccccattttacatatgagaaatcacggcttgaagacatgctgtgattactcaagaccatgtgcctggtaaggggcagagcctgggccagcacccctctccccaccttgtgtttgaccctgaaccatcccctttgatatgggaaggattaggtctgcacccatctcacagatgaggaaactgaggctccaagagtcaggcaccagtggtgagggggaggtgagagtcaggtgtggatgtagcaggtgcctatggagagagagagagagagcagaggcagcgggcttcagagccatttacacacccactgggggttgtgaagccagcacctggggacactgtgtccccagctcaattcctagcaggtcaagcatgtcttgttgctgctggttggggacaggcctcttgtgttgagttaatttcttctccaggcacatgggtcaggctcttctaggtggtttctcccccacctctcctccctctctcctgggacattggggtctgctctccttccagggtctggacacctgggccctggggaaggcacctggggaagggcagtgcctcaggatgggccagacaaagagggaagccctgcgtgcagccatcttcattattcgcttcattattcgctcagcaaaccatttattgaccaccttgccaagcccagcagtgcaaggcactgaggacggggtgctgtggacatcacagggtccccatcctgcaaggtgccatctgtggtgcactcccagttcaccagacaccgtgctgagcatgttgcagactttatctcctctaaactgtacggcaaccctgtgaggttcctgtttgcaaaggagtagacagaggctgggtgaggcaacgccgtttgacccaggtagcagagtagggtagagcccaagtgtgattccagaggctgtgcccttcaccctctgtcagtatcagtgtgccctcctcacagacgagaaaacagactcaggaaggattagcaacagccagtgaaagccagagagggtttggctagcagcatagcagccagcggcttctctgttctcccagattccctctggagctccacgtggtccctttctcagggatctgggccttggaaaatggattctattcggatggccagggagagtcgggcagcagggtatctggtaagagcatggctgtacgctacctggcttccaagctgactcttccatgcccccactgggtgagctggggcaggttgccgaacctgtctgtgctgagcctgaagcgtcgtggataataggagcccttgtggggtctctgggaagcgaggtggctccggccaagttgcttgcacggttgtgagctgtagctgtcattgtcatccgatcgtgatttcgtagatcatctccctggtaaccctgactcattcagggctctggtctctctattctgtcccctcctgtggtcgcctcccactaatgaggaaaaagggcaaggcatcgagctgtctccgagcagtgagggtgtgacctgcatacagaaaagcatgtgtcacacacagagggactttgacagacggaacatgcaacagaatgttcccggctcccaaaaggcccccatattccctctcaatcacccccaactctggggcggttcaccaccctgactgcagaggttcgtgttgtcactttctgttctttacataaatggagtcatagtgcagtagcacagcagttcttttttgtttttttaaagacttattagaaaattttaacagctttatggagctgtaatgcacatattataaaattcgcccattgaaaatgtacagtccactttagagcacctcagaaagaagctctgcacccgttagccatcaccccgtccccagcccctggaaaccacatctctccactttgtctccctgcatttgtcttttctggatgtttcctataaatggcatcgtacaccatttgtgtctggcttcttccactgagcatcatgtcttccaggtatatccgtgctgtggcatggatgagaatctcgttcctggacaggtgcaatggctcacacctgtaatcccagcactttgggaggctgaggtgggtggattacctgaggtcaggagtttgagaccagcctggccaactggtgaaaccgcacctctactaaaaatacagaagttagctgggcgtggtagcacatgtctgtaatcccagctactcgggaggctgaggcaggagaatcacttgaacccgggaggcggagattgcagccgagatccactatggagcaggcccatggagattgagccgagattgtgccaccgcgctccagcctgggcaacagagtgaaactctgtctcaaaaaaacaaaacaaaaaaccttgttcctttttatggccaaaaaataatcttatttttttttccatggccaaataacatcccatctctctgggccagctgtcccgagtctacctccttcttttgaactgggtttctgggaatctaaaacatgagtctgccctgacacagctactgagtttggccagaggccatgagtgagcccagctgaaaggcctgggtgggagggacaggaggccatgccggggacacagagggacccgggaatcggccaggtcctgctgtgcctctccatgcctccatccccacccctccaatgcgtaaggcagggcagcacaggggccacaaggcgttcacagaatcttccaacccaaacggcgtagagtcccttgcatctgttttgcctcctcctctccagcatctgtctgtcctagtgttgaatcccactcccaatgactgtcccgtcatcacttcccacccggacgtcctcattttcagtgggctgataccctctgccttccctacctgggcctgacacctttttccctaggatcaccagcctgtgtgctgggtccttcccaagacactgcccgtggaggcccatggagcagaaggaaaaggtgagcaggaagcagattgagagaacccaggatggccttctgtgaaaggcaggggaggagggcaggcaggtgagggagtggctgacgcccctgcctgcaaacctgcagcctctaggactcagcattacctgtgccagctacagggtgtcctcctgtgaaattcaccctcccctctccccagccaagctttttttgcctttttttttttttttttaagagattggagtctcactgtatcacccaggctgcagtgtagtggcaccatcatagctcactgtaaccttgaactcctgggcttaaacaatcctcttgcctcagcctcctgcattggttgctagctgggactacaggcgcatgccatcacacctggctggctttttttttttttttttttaacagctttactgaaatgtaatttacataatacaacttagccattaaaatgtgcaattcagtgacatttgttgtatgtacagagttctgcatccagcactgcagtcaatattagaacatattcatcactcccaaaagaaagctgtaccctcagctggcacaccacattcccctctccccaaccccctgacaaccaccaatctgctttctaccgcggtgtatttacctattccagataattcatgtaaatggaattatgtaatatgtggtcatttgtaattggcttctttcacttagcataatgggttttttttgtttgtattttgagacggagtctcaaaactcaaaagttttttgagactacagtctaccaggctgtagtgcaatggtgagatcttggctcactgcaacctccacctcccggattcaagcaactcttgtgtctgaggttcccaagtagctgggattacagatgtgcgccaccacacccgggtaatttttgtatttttagtagagatggggtttcaccatgttggccaggctggtcttgaactcctgacctcaagtgatccgcctgcctcggcctcccacagtgctgggattacaggtgtgagctacggcgcccgggctcacttagcatcatgttttttagattcatttgtgttgtagcatctatcagtacttggttcctttttatggctaaaaaatactccattgtggttgcagtgagccaggattgcaccactgcactccagcctgggcggcagagcgagactccatctcaaaaaacaaacaaacaaaaaaactccattgcatgggccacattttatttctccaattatgagttgacagatgtttgggttgtttctgctttacgggtgagcaatgctgctgtgaaattcacacacaggtttttatttctcttgggcatatccctaggagtggagttgctgggttgtcaatactccatgtttaacctttgaggacctgccagactgttttccagagctccaagccagcaccccactgctctaaatactgacctagggatttgaggatgggcttcaggcagtctctgaatccccagaatggacacaaatcccacgtctctgcatttgtttggggatgaatgtacagtccacctctttgattctcaaaaatatctcaaggccgggccagtggctcacacctgtaactccagcactttgggaggctgaggcaggaggatcacttgagcccaggagttcaagaccagccagggcaacatgtcaacaccttgtctctacaaaaaatttaaaaaattagctaagcatggcggcgtgcatctgtcatcccagctacttgggaggctgaggcaaggcattgcttgagcccagtaggtcaaggctgcagcgagctatgatcgcaccactgcactccagcctgggtgacagtgagactctatctcaaaaaagaaaagtatcttgagcctccaaatcctccctgcccttgcccagtctaaaggttagaggaaggggcagataagtgaagcgtattccagttctgtctcctaactctgaactattcttgtgggggcctgttagggatccaaaatacagcttgatacaggatgaaaatgccagctgacgtctgctatctttccttattctcttcccggtatctctccttcttggaaaccagcaaggagaacttcaacaatgtcccggacctggagctcaaccccatccgatccaaaattgttcgtgccttcttcgacaacaggtgggcgttttcccctgaaccagcccagtggcaggcacccttgtcttgtgtaacatctcgggatacttgtttcctagaatgaccctttgagctgatgcccagaagagggggccaagctgggtaggggttatgagcataggtttggggttggaccattctggattcatagctgggcgactgggctgctcactcaagctctctaggcctctgtgttcattgtctctggctatgtaacaaattaccccaaaacttagtagtttaacacaatagccaagcatggtggtgcacacctatagtctcagctgctggggaggctgcggtgggaggatacttgaggccagaagttcgaggctgcagtgagccatgatcacaccgcttgcactccagcctgggcaacagagtgagaccctgtttctaaaaaataagactttttaaaaaagaaaatttaaggctgggcacagtggctcacgcctgtaatcccagcactttgggaggccaaggtgggtggatcacctgaggtcaggagttcaagaccagcctggccaacatggtgaaaccctgtttctactaaaaataaaagaattagcagggcacagtgggtcatacctgtaatcccagcacttttgggaggctgaaatgggcagatcacttgaggtcaggagttcaagaccagcctggccaacctggtgaaaccctgtctctgctaaaaatacaaaaattagctgggtgtggtggtacacatctgtaatcccagctactcagaaggctgaggcaggagaatctcttgaacccgggaggcggacgttgcagtgagccgagattatgccaccgcactccagcctgggcgagagtcagtaagactccatctcagaagaaaaaaaaaaaaaaaaaaaggaaaaggaaaactagaaagcatttattatctcaccatttctttgggtcaggaaaggaacctgggtgcaaattagctgggggtctcaaagcctcatgagcttcagccaaggcattagctggggctgaggtcttgcctcatggctcaaccaggtaggctctgtttccggattcagccttgtggctggtggcatctcctgggcccctccagagagctgcccacagcatggcggcttgcttcctccagaggcagccctgaatgaaccgatgggacatatcccactatctttttgtaactgaatctcggaagtgacaccctattcctcctgctgtgtctcttcgttagaagtgagtcactaggtcacccccttcttgaggggacagcacagggatgtgactaccaggaggcagggattttgggggccatctgggaggatgcctcagtttcaccatctctaaaatggagataatcggtcaggtgcggcggctcacaactgtaatcccagcactttgggaggccgaggccggcagatcacttgaggtcaggagcttgagaccagccaggtcaacatggtgaaacccccatctctactaaaaatacaaaagttagccagatgtggtggcgtacacctgtaatcccaactactcgggaggctgaggcaggataatcccttgaactcgggaggtggaggttgcagtaagtcgagattgcaccactgtactccagtctgggcaacggaatgagattctgtctcaaaataaaataaagtggagataatcatagcacttgcctagcagggttgctgtgaggggcactgaggggatgtgtggtgaagcttacaaagaggtgtgcactttggccagtgtcccagagctgaggcacaggccagagctcgagcctcagtgtccagtattgtttaaggtgaaagacctgggtgaccgggatggagcctggaggtgtctgggactctaggggggatgaaggggtgggtataccctccccatgctgctggggcctgtggcagacacagtgaggcccgccagcctgtttgccccacggtccccatgtctgcaaagatggctgggaaacggaggatggccagaaagaggaaggatgggaacaggcgtggtgtggtgatgagaccgtgggggcttccctgatgggtcttgagctgtgcagggatgaaccactcaccctggttctgccagggatgtgggaccctggacaaggtgctgagcctcccagggtcccactggaaactggggtgctgctcacggggagaggggtccttcagctgcccctggagttgcaggggccttcctctgtggcccatggggcaaggcctggcgagagagtgaccaagagttaaaccagaaaagcagggagagaaggttccaggcgatgggaactgtgtgtgcaaaggccctgtggcacagggagcttggggagctgagaggcagacccagctggaccagagagaggccagtgtggtgtggggagggcaggctgcatcggacagcatctgtggaccagcagcagcaggggtcttcaggagccaagatgggggacgctgacggactttaaggtgagggtgtgagggggtgggtgagccaggtttgcactttgcagagggtgctgtgactgctggttggttgtaggggtgggaatgggaggtggaggccagggaggagtgaatcatggtcccgggcttgggtcaggggtgccccgaggatctggggagcagggggcagctctgagccacctgggaggttatagatgaggaagggttggatccgggagttggggtgagagacctggtaccgcaggaatcttcacagccagttgtcatgtgtgccaaagaggaggggcctgtggagcttaagtgactgtgaagtgtgtgaagttgcacagtcagtggcaaagacagagtggaatccggtgccctcacctccttttaaatcctggttctcagagaaaggactcaggtgggcagtgcgtcttaggccagtccccagatgagccagagcaggcatcagggtgggaggcgtgcggcccctgacagggcacctagagttggaggcactgacaggaagatggtacaggggaccagagcccagggggtgcctgtgggtgcgtgcgtgtgtgtatgtgtatgtgtgtgtgcgcgtgcgcgcgcacgcgagagagggagcatgtgtgcacgtttagggggtgtgtgtaggcacgaggcttgtttccagaaggcttgggtgcaactttggccagttgtaaagttggaagagggaacttctagggtggatgagatgagaggtggatttcacaagggcatatgttcgtccaaacacaagatctgtgcattttagtgtatgctcttattccttaaaaaaaaacttgacccaaggtcacttggctgtcagttgtcacttgtaggaactgggattccaactcgggtctgtctgcctcacgatcctggacagacccaggagttgtgttttcggctcttggggtggaatgcacacacctgccaggctgttttccatgaacagccgagctccaggagacagggtgtggggaaagggctggggcagatgcctctctgttttcagaagacaagagggtgcactgggtatgccgctgccagacttagggacaggcagacggaggcagtagcctcctcctcctttggagggtctgatttaggccagagctgtgggaggactggcacaggcgtggtgctccctgaaggagggggcagggacctcagtcattggggaatgtcgggtgtccagaagttggacgttgaaacaagtgaccacatctcagggggactccaggcgcgacgggcctgtggggaccctgaggagggagctaggcaggaaggggcggtgaggtctgggctggtgtgggtggctgagaccaccctgcaggcctgggagaccaggtgggattggggattaccaggagaactggggaggccccaggagggtgctgagcaggggaacaacaggctctgatttgcattttgcaaagctcattccggctgcacttggagtgcgtgagaaggtgggggctgggccaggcagctgcagaggccaggagagaaaaggaaggttcccagggcactgactagaggtgtgagcctgggggtgggttgggtgtgggggggcatccaggagactccgggtctggagctgagggcagctgtcattgtccctgcctgacagagctgtcgttgaaagatggtcagggatctcctgggctgagctagaagtggagggcggtggccaggtatggggtggtgagagcctcccctataggtccctggacctcggcctctggctgcttcttagagaaacctggtgtggagaaaggaaggtgccagtgactaaggctggcccagaagtcactgagggaggggatgattttaaaaagggtttcctctggcctgcacccagaacaacttcgtgggctacagctgggagcctgtaactattggaaaagggcttcacatcacatcctgtaaatgctgagaagaagctggaggaggatttcagaggagatgctggaaacaggattttcctttcaagaaataccagcctcagcctttgttcctaagactctttgggaacaggtcttggggaaggggtattttgagcagaggccatccccacctccagggcgccccattccttacagaagaattggaaagttaagggggcatctttgcaaaaagagtgaaaatggcctgccctcatgctgggttgcagatttagatgtagcccctgttttctgtccactgatcttcatcctggtgctcattttagaaatgggagttagagggctgggtgtggtggcacgcacctgtaatcccagctactccaggaggctaaggcagtaggattgcgtatggccagggttcaagaccagtctgggcaatatagcgagatctcatctcttaaaaaataaataaataaataaacttttatttaaaaaatggagtggagagcaagtggggctggttccaggtgctctgtctgggtttctttggcactggctgtcattgcctttggagaccagaatgttggtctcttcagacctgcgggagcactcggaggggaagggaccctccttccttgagttgggtcctgaggctgaagcagtgccggtcacaaggttcccagagaaggacacacacctgccttccccaggggtctatcacattttcacccatgctaatcttaatccctcttgctgcagcctaaaccacttgggaaggacgtgtgagccagtcgctgtgggaagggctttcagagcagcccgataagtccgggggctatttttatgctctgtaaatttggtctctgccgcccacagtgagaactttgaggttattaaagcctgtggcaggagcggtggggagcttcatacgataaaagagagaagagagacctgtgaaaacacataaagatggggcttcctgagcccagggaaggacagatctcatcccgcagatgggcagtttcttgatccgccttccctaatccagacttgggaccccacctctccctggaaaatctcctggaagagaaaaataaaaaagtgggagttcccaggacacttagaggctgtcgtatgggtgttagtgtatttgctgggtgctgaaaaggagtagtagatgaacctctaaagagagaattgcaaacatattcctttacatggaggtgcagtcgtgccctgggtgggacccaagtaacatatccaagcactaaccactaactgttagccaccccgggccagctaggcactgccccttccgaagggccacagtgagaggctgtggcagaaacttgagcttgccagccatatgacagcctgccccagcagcctcgggcgctcatggtcacagtccagtagagataagggtttgacgacagtgggtcaggagcttgggtttggagtcatctccaggctgttttgtttctttcgtttgagacagggtcttacttagccacccaggctggagtgcagtggcgtgatcttggctcactgcagcctcggcctcctgggctcaagtgatcctcccacctcagccccctaagtagctgggactacaggtgcacaccaccgcacccatctaattttttgtagagacagggtttctccctgttgcccagggtggtcttgaactccagagcccaagcaattggcctgcctcagtctcccaaagtgcaggggttacaggcgtaagccattgcgcctggcctccgagctattaacaactgccaagacctgagctggaccacacatttctgagtccctcatctgggtgtcaggcagtgtgccgggcatggggcatgaactccctgtgtccccatcccccagaacaccagccctttcttgcctcctccaaaaagcacatttgtacggccagtctcaaacctgccctaacttaccacaaaactttcaatccttggcaaactttgtatttgggtataaacagattacttagagatgcttgcagccaatcaccatcctaaaattttgaactagtgagagcgagcagaggttggcaaaccttttctgtaaaaagacaaggagtaaatattttaggctttgcgggccacgcagtctctgttgcagctactcagctctgcagacaagcataaatgaatgggcatggctgtgtgccaataaaattttatttatggacactgacatttgaatttcatgtaattttcacttgtcatgaaatactattcgacttttttttttttggcaagcattttttcaactatttaaaaatgtgaaaaccggccaggcacatggctgtcatatatagtcccagcactttgggagaccaaggcaggaggatggcttgagctcaggagtttgaggctgcaccactgaactccagcctgggcaatggagtgagaccctgactctgacaaaattaagataaaattgtgaaaagtcttcttcctcttcttcctttttttttttttttttttttcttgagacagggtctccctctgtcacccaggctggagtgcagtggtgtgatctcagcttactgcaacctccacctcctgagttcaagcgattctctcgcctcagcctcccgagtagctgggactacaggtgcacaccaccatgcccagctaatttttgcatttttattagaggcgtggtgtcatcatgttggccaggctggtctcgaactcctgacctcaggtgatctgcccacctcggcctcccagagtgctaggattagaggcattagccaccgcacccagcccgaaaagtcttcttagttcaggggctgtatgaaaatagatgacaggccaaattgggcctatgggctgtttgccaacccctgagctaaaggaaaggatcaggagatgtactcagtgagttactggattgcttggtttcttcataagtgctggcctgtgtgcaccatcacacacccacgcatccctctgtcaccgcctgaatcaacggtcacgcagttgtctctctctcttccacctccctgatgatgagctccgtgagggcagggcaagggctgagctttcagcttccggagcctgcagccccgccacgaagcaggttcttggggcacagacgcaaggcgagagcagccatcgtgggtccagtgtgcaccctgagagcggagttctcgggagctaatggtagcaagaggacaagatccagttcttcatttatttccaacaccctccttgttgctcccgtaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatgtgcgtgccactgagtccccttgctcacacctggcctggggtgcagcctcccctaagacctcagaacgcaaggcgcctctgcagcaggaggctgggtgtgcattggcttgggggcttggagggcttggggccaccagccctcgtccctgtgaggctggcattgctgtctcccgttcccggcaccttcatcctaaacattcctcagcagcttgtggcttcctgggactagaagggggttgtgcggtggatgtgaaacaaggcccttgatgcaaagacctgggttccagtgtggcccgtctcaccagccatgtgaccttgaaccttgacccagaacgtgggtatgccgatcatgcgtggttctgagggctgggtaagatcacacagtcagcctttggcacacaggaagcgctccctaaagtcagtttcctcctctccctcctccatgggctgtgctattgctgggttcctgagaccagccccactatgttctggctcccgagtgggttcagttgtggtcccagctggccagccgcacaggtcccaggcagtgccccgagtcacatctccttttcctgtggcctttcccatgactcctgacatccctctgtgtcccgccccaggtcagcctcctcatcaagaaaatgtaaacatgggacttcgctatatttagcactggaatgtgtatgcggggctggtgggaacagcccgggtggcgggggtggatccctggtgtgagcctggcttcctgtctgctccaaggggcgtggaacaggacggactcaggtccaaatccctggtttcctgtcccttagtggtgtggccgtgggcaaacgccttaacttccgtgagctttgacagtctgtctgggaggcagggctcaggcatccctggcctcttggggttgggtgagagggagacagaggtttgtgaagcgctttgcacacctgggcatctggtcagtgttcagtaaatgccagctgggctcagtggtgcactcctgtaatcccagcactttaggaggctgagtggggaggataacttgaagccacgagttcagggctcagcctgggcagcagagaaagacacttgcctctacaaaataaaaaaatgagcacggcatagtggtgctgcgtgcctgtggtccctggtactcgggagactggggtgggagggtagtttgagcccaggatatggaggctgcaatgagctacagttgcaccactacattcagcctgtgcgacagagtgagaccccatctctgaaaaaaataataacaataataaaaaataaatgccggctgagcacggtggctcacacctgtaatcccagcactttgggaggctgaggtgggtggatcatttgaggttgggagtttgagaccagcctggccaactggtgaaaccctgtctctactaaaaacacaaaaattacttgggcatggcggcgtgcacctgtaatcccagctactcaggaggctgaagcaggagaatctctcgaacccaggaggcagaggttgcagagagcccagatcgtgccactacactacagcctgggtgacagagcgagactaaatcttgaaaaaataaatacattaaaaaaaaaaatgccaacacagaagacttgggagagctccagctcccaaggccgtgctgggaacaacatggagaggccccctcccggccatcgcctccctgatgccaggcctggggctgcccatgttagatcagtcgggcccagatcagaagcactgtggaccgtgacctgctatgggtgagatgatggtgccctccagggctgtgggaacaatattttgaactcgacaccgtttgacttgtgttaacgggtaacgcttactgtcgtgatattcatgctcacggggcagttgccaggccctaacgccacagcgctagctcccagccctcctaaggccacgaggtagacactgttgttattcccatttcacagatgaggaaactgaggctcagagaagttaggtcacgggcccaaggtcacccagtaggaagtagtcagtctggtcccacagctcatgccctgacccctctggctttggcattgaggtttggttattggtgtcttttgcttagtttagtgtacatttcagggggtggcaggggccaggccccgcctgacggagtcccctctctcccctgccaccctagttctgttccacatgtacgactcggacagcgacggccgcatcactctggaagaatatcgaaatgtaaagtatgctcctctggcccgcccggggctcctggtgccttccccctctgccccccacgaccctgatggaggcccaaggtcaccgtttgtttccgccccacctggcaggtggtcgaggagctgctgtcgggaaaccctcacatcgagaaggagtccgctcgctccatcgccgacggggccatgatggaggcggccagcgtgtgcatggggcagatggtgagcgcccctgcagccctcccgagacgcgcagtgcctttcccgcttatggtctgcgtttctggaaggcctcatggggcaggggccaggtgtattctgccacctgctctacctgtggcctgtggggctcaggaacctctcccagcccttcctgtcccccaggagactgaaggtccaagtccccagagagctgcataaggcagggaagcagagttcgagatctcaggctttggggtccaggagcccccacctgcatagccccctgatcccccaccccggcctcagtcagtgctcacagcagcacttgaccctggggccaggcctaggtagcacatggcacaggctggccttaattggtttatttcttaacaaatgactcagaggcaacttctggcctcgaaggcaggggtcagcagggagccctattgggggctgacaagagccgatggcatggagtccggtggaggagccgaggtgggggctggtgtgtaaatgacacagaagagagggaagtggcctttccatgttcatcatttattacatcttgcctcattttgactggtgggaaaactgagactcagagagcatagagaatcctctagaccttatgatctttcctgtgcagggtggattttctcttgtaaggacaggtgcagccccaccagcccccagccctaaggctctaagcctctggggaccactcaggcaggcaggtgaccacctgggtgtcgtgtgttccctgaggggtttggatggccccactgatgcagtcagccctttgcccctgtgtgtctaaagtggctgcgtctctagacaccctgacggctttgtgtttgcccagcctggagtggaggggcgttcatgctggatcctgctctctgtgccccaagcctgtccttgagggacatgaggccaccggcctgggcctgcccccaggggcaggggctgtggtcggttggtttcctgacgtgtattttatctgtttgcctctggagcccagggggaagcttctggcttgggtgaaacctccgcactcagcagactaaccaccacgggagagggcttgtgacctcggtggggagagcagggatcccccgccgggttgtcgggccaaattcccatttgatttaattacactctccttgttcaaattactccctgtcccactccagtttcaattggcgacagttttcttaatttgctgtagtgaaattgctggcagctgccagctgctgatctgcataaaacccccgcagcctgggaagcagaggcatctcggggcggaggccgggctccggggcgtacccgctgcctacgggcccccatgaggtgggggtagccctggaaccaggaagacggctgcaaggcagagggctcatctccacctctttcttcactcatgggtcctccgggtgctcctaaaataccttctggtgtaaacctcggccagataaacccagaccgagctgtgcatgcggcctgagctgggggcaaggggcagctgcgtcggttcaatccctcccagcctctgaggacacttcccgttctgaccgtgccatccgccaaagacaaacaatccctggtccccactttaatggacttccaaaggcagttattgactgaggcggatctgtctctctctcttttttttctttttttcccgagaccaagtcttactctgccgcccaggctggagtgcagtagcaccatctcggctcactgcaacctccacctcctgagttcaagtgattctcctgcctcagcctcccgagtagctggaattacaggcgtgtgccactacgcccggctaatttttgtatttttagcagagacggggtttcaccatgctggccagctggtctcgaactcctgacctcaagtgatccacccaccttggtctcccaaagtgctgggattccaggcatgagccgtcgcgccggcctgtggatcttttgagagtgctttctcaggaggtcacacccatggatgcttgatggggggactgcttcactgggcattcagccggggctgcttcccccaactccccgccctccttccttgcaccgatcaccccctttccagccccagactctggccatgggggccttttctataattagctccccttggccagcctgggaacctagggaggcccggcagggagggcagccactgtgcccgtgagtgggaagacagggaggaaggagccattagggacagggctggcccaggctagccgagaactgctgggtttcattttttttttaatttattatttattttttaagagacagggtctcgttctgtcgccccaactggagtgcagtggtacagtggtgtgatcatagctcactacggcttccatctcctgcgctcaagccatcctcctacctcagcctctggagcagctgggactacaggtgtacaccaccacacccagctaatttttaaaagttttttaaaaaagagatgttttgctaaaaagagatgtcattatgttgaccagtctggtctcgaactcctggcctccaacagtcctcctgccttggcctcccaaagtgctgggatgacagatgtgaaccactgtgcctggccaaaatttttttaagtataaagaggaaactaaagagcctgcaaagtcctgccagtagaaacagccctcaaggacttggaggcagctagatgctcccagctggacaggcagctccctctgtgtccctcatctgtaatacaggagagagactagaacccaactcagggccggttgtgagattggcatctatcattaaatgctaacaatagcatttggtcacacctgtaatcccagcactttgggagccccaggcggttggattgcttgaggtcaggagttcgagaccagcctggctaacatggtgaaacccctgtctctgctaaaaaatttaaaaaattagccacgcatggtggtacatgcctgtaataatcccagctacttgggagtctgaggcaagagaatcacttgaacctgggaggcagaggtcacagtgagccaagatcgcgccactgcactcctccagcctgggcaacagagcgagactctgtctcaaaaacaaaacaaaacaaatgaaaacaaaacaataccacttggaaggcacttgggacatacatgcctggtgcataacatgcttagagtgtgcctcctgtgttcttaaacacacgttgtacagaatttcagacagtcacagagagagctttgagcctctcctgctcccccaccagcccaggtcctcttccctaaagggactccctctcggtggtttttttcctacatataccaatgtatacatgcatgtcttttatttttgatgtatgcaaaacataatcgaaccgatgtggcttcccattttctccgtatgaccccacacacccacagggcagatggtgggggtctggttatcagtctgaggaaaggtttgcgtgcacagacctgcagacatctttctgcttgttgggttttgttttttgttctttatctgctgggtacacatctcagagccttttccagagtgagacatacagatcaaccccttcttaacccatttttgcctgaggttgcagctttttcaatttttgcaatcagaccttggcgatgaccttgaccagtaggatataagtaactcccacagcttagcgttccagtaatggaacactaggcataaatggttaatggttgcgtgggaatcaatagcgtggatgaccgagatttatgtccctcgccttctattgacgggcacctgggatgtcagcgggttttcgctgtcacaaagcgagctgcagggtgaggtttttggaggcttgtcggtgggatcctggagtatcggtgaaaggggcaggagcacctggtgtcatccccagagcagggaggacgcagaggcgatggagactggcatcgccaaacccactcagcagggagaggctccttgtggccaccctctggccctgccctccccagtggccctgagttatcacggtgactcacgaggcatgaggcgtgggcctcacaggctggccctgtgtttccctgacctctcccctgaggtctgtgagcttagattagcctggaatcttcttatcagcacagcgcaggcatgaggaggccagacctaggcgggtacaggaggcatcttggtggtccagctgctggggggctggtggtgaggtgggctgagtggggaaggagagccccatgccctcatgtcacccacacctcggattctccctggggggctgggggaggggagggaggctgctctgagccacacgttgccagggccctggtgagcgacgctcggctcccatcccaccctcaagcccatgaatgaggatattggaggttcagggtgaccggctccatgctggaggcagacgatccagaacgttctcctcttcttgtgattcctcccaaacagcctcaacaacttacatttgggtattggtggggaggggaggccagtggaccgtccccctgcggaagctgtgtggggacctgcgccactcactgtccaccctgtgcttccgtccccaggagcctgatcaggtgtacgaggggatcaccttcgaggacttcctgaaggtgggtggcctgggcgtgggagcctcgggggacccttgaagacctcgtgtggcccactggtcaggaggggacatggctctttacctgcagtagcaagggacaggcttcctgggtgaccaacatctcagtaggaaggggtcaacctgggcatggcctttaaagcaatttaaactggtttttcttatttttatggaaaaggtaatattcacacgtagtcaaaacaatgtaagcagtacaaaagggtatatagtgtaaaccaaattctctcccacctgcggtcccactgccgcttctcagaagtaacccccgttgtaggctgggcgcggtggctcatgcctgtaatcccagcacgttgggaggctgaggcgggcagatcacctgacgtcaggagttcgagaccagcttgaccaacatggtgaaaccccatctctactaaaaatacaaaacttagccaagcgtggtggcaggcgcctgtaatcccagctactcgggaggcagaggcgggaggatcgcttgaatccaggaggtagaggttgcagtaagctgagattgcgccactgtactccatcctgggtgatagagtgagaccccatctcaaaaaaaaaaaggccctgttgtagttggaacagggattctgggaactttctgtgtctttagaaatagtgtttctcggaagctcagtttggagctgactgcacacgttgcgcccgggccttcctcgctgtgtcctaaaatgacactttcgtaaagcggccgcccactctgccctcctccctgatggctcctccagcctctgctagtggatggtggttaggccagtgctggccttgcaaatcaagacctgctcctggccgttttgataatcagatgccctgtggcagggagaggacccctgtccccatccccctccccccatccccctccccgcagttcggccctgggcatcacaacagtgttcccaagtgcttttggggtacttgaggaagacaaggaagtcaggggagcaagagaccaagagaggagagaggattagggaaggaaggatcacggcttctggccaaggagcctagagcaggactgggggactgggccctcagggtcacagccccatggagccgaggccaagcctggcagccaacggttagaaccggcaggagagaggagaggcaggcagcagggcctggctgtgatgaaaggctgaaaggagactgcggaggtcggcaggccccgtggactgccgtgcagatggcccaccccggggctggcagggcgggcagactgggaaaaggcagaatttgcacttgtgcttcagactcactctggcctatgctggggacccggtcaccagagaaggtgacgcccgccagagcaagacaacagaatgaagagctagaaggtggaggagggagggagggttggggaggaagtatcgctgcttcaggctgagtagaatgaatttctttgcctccgaaaccaacttccttcccctaaaggctggcctctgccaggcccctagtgctccccaagcctgtccctgtacccctgagggatcttttgggaccagctggcccttcccattccctgattccttccaatgccctcagcgaccatgttgccacctggcacttagcagaaaccaccgtgagtgtccatgcgtgttaccctgggaatgcctcgtgcatccagcaaggatggggccgctcgactgggaccagagctgtctttgcacaccccatgacacccagaacaggctcaggaaagcaggaagtacctgggggctgcggccggaaatgtcccaaggcctccctgtcgcctgggtgcccacggggctctgactttcccccgttaccagcctcgtggctgtccccggagatgctgagagtgacagcttgagagtttgattcttacataagcgggaagcagtgagaagtcacccgcccaccacgtccctccgttcctgttggcacccccccatcctaccatctgtggcccccgtgggccctgacttgctaaggcgctggcgggcatagccttgggagcactggggtacatacatggccttgtagcacgaaggcccactccaaggttctggccaggctggactgtaacagcagtaccagcaccaggaatggggccaccatgtgatctttgggtagaaatgacctttttgggcttgagtttgtctttctagaatgcacgtgatcccttatcccagggaggttgtaaagaccacactgtggagatccttaaattgatgacgatggcctagcgaagccttgtgaccgcacagcccctaacagtttacaaaacgcgtccatgatgaggacgggtccattagagcccccaacgttctgtgaagtgggcggcacaggttggggaaggggacttaatggggttatgtaatttgcatgaaaatcacagaacctgaagtggtgggtgagattcaaatgccttggagctaagagcttggattcagtacttaataataacttgctgtgacaatctcagaaagaatccaaatgtcagagccaaattaaccagcaaaaaagacagatggaagtttttcgtcctcgcttagctcatagtcttgaaacacagccctctggttttcacctgcctggaacatcacagttggtggcaggagacggtaggtgggaagggccgaggaccggggggcctggtcaggtgtgaggtggcggcgggaacgtgcccttaacgctgctccgtcccttccagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaattaa

SEQ ID NO: 38455 - DNA, 3708 bp, Homo sapiens
ggcggagccgcctgggctgcagtcccacccgggagccggcagggagcggagctgcggagccgcctggtctcccgcgtccatcggtccattcctgcgtcgttctgtccttccgaacgcacacttcaggagcagccgcgaggtagaagcccataggagacccagatgcccgccaccccaatcagtatcctgcacgatgagggttggggggagcagcctggaaagggtcccaacctccggcggtcccagccgaggagccagctgagcggccctgccctggccccaagcattccacctcgcagcccccacctcctggtccggctgattgatgactccagctgtcccagtgggagcgggacgggtggctccagttcacgggtgtggccactccatccatggcctgcagacccatggggctgcggcctgcaacccagcgccacctgaccgcgctgagatgaccaagaatccatctttccacggacaggagtgagcactgcacgcaggatccgcccagtgcttgggccaagcaccctgtggcatccaagctcccctggacgttacccttggtgaaccaagtgcgggtcttggggtccctggtgggaggttgcacccagggaaagggaaggggagtgcagcgtggactggggttatggtccctgtaacgtaggaaccaccggtgctcacagtcccagaaactgccacttagggatgggagtgtggtcactggcgaggagtttttggtggaagatggggcagccgggcagagcccaggccgtggtcactggaagccctagtgtaaaaggcagagctagaagatggttgctgagaccgagggtgtggtcaggaggtggcagtggaggagggggatgtggtggggaggtctctacgcaggggatctccgcatagtacctgggagtcttataatgttagtgtgtggatgtggactggggccttcagtgcaggctgagggtgtggccagagggctgagggtgtgtggacaaaggggtgctgagggtcagggcgccttgataaagggctgcgggtattggagggggtgagtggctgaggctatggtcaggggtctcaggaagggatgcaggtttgtggccaggggcctcagccccagggctgcgggtgtggggatggagaaggctgctgtgtaggctcagggtgtggccaggggtctgcagcggagggctgtgggtgtggggggcactttagtgctggactgtgggtattactggggttggcgcaggcttgttagtatatatgtgggggctggtggccgagggctgtggctgtgggtgtgaagatggaggatggagggctgaaggtatggccaggggtacaaggcccagggggtggcaggccagggctgagtgcacagggtcgctgggaatgtgggctggtgtggccaagttcagggcgtggccaggggaggtctgaggtgtagacatgatgaagtgtgtttcagccacagccccacttgccagcacgactcttggggttcgtaactctacagcccccacgctactagcccccaacctcctgctcccccaaaactccacagtgggaggttacagcaccagtcggtggcaaggggccaggaagccacggttatgccctaggcgcagggagtgctggcgtgccccacccgtgggccccagcttcccagcccagcccagcccctcagcactgggagcttctccctgagctgccctgacaccatcctgcccttagcaacattctccaagcagcaccaccctcccttagcaaccgtctccaggcttcacaaactgtggccaggccagccccaagctcccctcatgtttttgtttaacagcaaatagtaacaaggccttgctggaccagctgcacccctgcccagggcatgcacccgtgcccagactggctcttgctgggtcctcatgacccttacagagatgctgtcctcactgaatgcctgcccgaccagcagcctggcctggccccaagccagcttggcatggagcttccagggagggggcctgctctgccaccctcacttccacccaagcaaggccttgtgccagggccagacaaagccagggccccagctgctgccctaacagtctttctggacagtgccactctgttccctgtgggcatcattatttcatctgctgaaccctgctgagagccagggctggcattagtgacaagaccgtgcctcccggggctcttccttggggctctgtggcccagggcgacagtgacgggcccctctccccaggcagctccagcaccaactctgtagcagaacctgcccaggtcttgcaggtttgaggtagaggctgggatgttctgggcttgggggaggggaagggcagattggctgggagatgacccaggtgggtctctatagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaagtgagccctaagcagcccctgcttctcatgttcccaggaggtggggaactggggggctggaaccagggaggacatcaagaaggggtcagggaaacaccatgatcacgaaggtcgttcttccagggcaaaccttatatctattgccctccagagttgctgacccctgcgacttccccaaacgtgggaaagaaacgcaattgcataatttgtggtggcagcaaatgtgtttgagctttcccctgggggagaaaaaagaaaggggaaccctcatggtgcccacatgcctgtcagggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactgtaagtgccctgctggtctcgggtggccacggaatggggtgtggggaatcgtggctgtgggtgggaagggctgggctccctcatcaggtgcccctggggaaactctgtccaaacagaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtacc

SEQ ID NO: 38456 - DNA, 30659 bp, Homo sapiens
ctcgtggaggctgaggtgagtcctggaggtgcgtggttggggcggagagcattatctgcggctccgattttgcagattctggctgaggcgttcgtgatgtcagcagcagccgagacgggcgtgttaaaggccggttgctagggctgggggaactcaggtaactacgggcgtccccacagcagtacttggaagcccctcagctactcggcgcggttgcgggtgctgagcagagctgcctgaccgtgcgtgtgcacgggctggcctgaggatgatatgaccgtgtgttcggtgtgtggaaccctccgtcaccctcccctgaccgaagactcgtttaggaatgtgtggcaggtctgttgccacggtccaggccttcagtgcatcttggaaacatcgttttgggggctgtaggttaggaagcggagatcatggggtctcggaagaaggtttggtcgtgaactgtcagaaaggaggcgaaagctgtgcacgtggaacaaagtgaacagtgcaagttgtatgggaggtagtttaaatatcgaggcgatgaaaaaaggctgctagaattgggcttactcgaaaggaagtgggcctcagaagataatattagttaaaagaagtagaggagaacatggatgttattctaagtaaaacgaataatatgaagaatacaaggtcgcgggacgaggaaggaaactagccagcctgacaggaaggtttattcgagaaatacgggggttagataggatgagtttttggaaactggcaaacgatttagccttttcaaggctttaggatagggaaagctcatttgaaaagattagtcggtagtattatgacgtttaaatgaaaagagtgaaaaacatggaggcggaggtgctaggtggaaaatcagtgcagtaatccagtgataaagagctggaactgaaagtgctggagagaaagggatcctgtttcagagtaacagtcaggtggaattgactaaagagaaagaggcaaagagaagcagtttagcatagtggttaaaagcagaaattttggagttagactggctggattgggatctggctttggcaattagctgctaaatgactttgagttagcaatttgccatctctgggtctgagttccttgtctgtaaaatagagataggaagagtgacttcccttgtggtgttattgtggagaatttgtttatttatttttagagacagagtctcactgtcacccaggctggagtgcagtggcgtgatcatagctcactgcaacctcgaacttctggactcaagtgatctttctgcctcagcctccccgagtgcgtcaccatgcctggttaattttttaaaaaatgttttgtagagataggttcttgctgtgttgcctatgttggtctgaaactcttgactcctaggccttggcctcccaaagtgctggcattacaggcatgagccaccataccaggtccttatggataatttttttatgctcatatttacaatgtgctagaggcttttctaagtgctttgcatatgttagctcggtttcattaattgctgtatgtaattaaacaattgcataatgttatcagttactatagcgtaagcactctctaaatcttggctgctataataatatttttttattaataattcaaaggttattaaatggttttgagcctgaagagctgggaaaattgtgtcttagtgtcagaagaaaagagaggggtaccagaagtaaggtaggcttggttatagacatgttaaatgtgaaactataaggtattcaagtggagatgttcagtaaatattggaaactctataattagtattcatgtaggtggaaaggactggaaatagacagatgggagtccctggacctaggcatgctatatgaattctccaaggaaaacactgtagaaggaggtggtagatggccaaagacagacaaacataaggaacaactacagagtctggaggaataagaggaattgggaaagaattaatcaaatggcctaggctaagagcattatcaccatgttaatattatctttccttgattttaaattggctttatgttggttcctgtgagagaagcaatgaggccagtaagtgattattaccagaaaatattatcagagagttgagattgaattttttttgtgttagactaaaacagcatttgataattagaaagaccctgtagagttaagccaaccaaccaaagaaacaaaaaacaatagcaaaaagaaacagctcctcataaaagactgtaacttctttatttttgtgtgttttaagttgcatgggtgttttttggggatactttttactcttccatgtaaagaacagatgggactgatttgttatctccttcattcacctcttgtcccttttataaataaccagtggattatggattttcagtgaatttaataaaagtgcagaaattatggcatctttccaaaaatagtgtgccaagttgctcaaccattttctatgccaagggtaagtggctgctctgattttgaaatgaaggacagactttcatgtactagtagttctcaaagtgtggtccaagaactgcaatagcagcatcacttggaaacttgttagaaatgaaaaattctaggccctacctcagacttatgaaatcagaaacaggtgctgggagaagagatgagatggtgttttctagcaatgttttcataagccctccaggtgatttggatgtatactagagttagagaaccactgtacaagaaggtaagtaccatgaggttagggattttgccttgttaatagtgtatttccagtgtctagaatggtgcctgtctaattggtaggttttcaatagatattcattgaaaaatatgttcagtctcagactgccaatctctgtgtaaaagctttgatgctggtttaatgggcagaagtaaatcagtttagctgcattgagcctataatgtcagatatgcatgaggtgggcatgacaacgtgactaatttggaacttgaggaatgagggattatattgagtcaacactgaataaaaaatgatgtccaggtattttaggtcaatgattcatttagagtaaataaagattaagaagtcacaagttacatgcttttaatgacatgatcaacagttggtgttgttctggcgcagtggctaacacctgtaatcccagcactttgggaggccgtggcggatggatcacttgaggtgaggctttcgagacgagcctggccaatatggtgaaaccccatctctactaaaaaaaaaaaaaaaaaaaaaattagccgggtatggtggcacatgcctgtagtcccagctactcgggaggctgaggcaggagaatcgcttgaacctaggaggtggagtcagctgtgagccaggatcccaccactgcactccagcctgggcaacagagtgagactctgtctcaaaaacaaaaaaacagttggtgtttactaacctagtagaaccaaggcacccaaggagctgagttttctttgtttatatgcacagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaaggtgagcctaaaatgaccagtttgatactgatttattggtatttgaggatggagaggtagtagaagtgggggggctctgatttatttatcatgagtttttttgtgtctgtgcccttagaagaaaaatctttttcctttaggtctagctagccaagcatcaagttcctttgtgttcttcgccactgaattctgaaaaccacaatgaaataggagcttatttcttagatgtctatttgttggaatatttacaggtcattatttgcagtaattatttattcctgatgtattttttctctaccaattctatttttcaagctcgacttatgcttatagctggttataaaatattaggcatgtaaaaggaaggttagtctattttggcagaatctttttctaatatggataatgcccaagtgttgttaaagtagactttgatactttgtgtgactgaattccctaagcctaccacttttgccaaaccaaatataggcattttgatattgtccattcattttgtgattcccaagaggttagtactttgattcttgttgccaccaagagtcctttgtggttaaaaccactgcagtactctgttgccacacagattattttcttataaaatgggtctcagttaaaggaatttataaacctttattgaaaatcacgtagtgttgttctagggttaagaattagattaaagggattaaatttattttattgcctagggagtttttatatgtattacaacaacgtagggctttggagaaaataattaagccttttcttaaatgtttcattgcctagtacaaatactaatttctatattaaaaaacttgaaatggattgtggagtttcatttttattcataagagtaatttggaattattggtgctcttaattttactgtgcctgagtattcctatgcttttcccttgagttcatgcttaactcttctacattgtttttaatttttatgatttcagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggtgagcctttgaatcagcccaggctttgatctattaaaggaatgtaaggcttatgctgaagcaagttgttgacaaaaattgtcaggtaaaacaatgggctgtcaatatacaaagtagtataatgatagagtgaagaggatgggtgtgaattgggtggttcattttgtttccttttgttcattttgtcatattttctgataaaagcctcttaagtgtaggaataagatgaagagagccatgataactcttattgtggaagtgctacgcaaaacagtaaaataaggaaagaaaacaaagactggaaaagaagagacaaaataattatttgccattgacttctgtaaagtcagtagaatttcctgtatctcacaagtcatgagttagaaaatataaaagattccattcacaacagattaagtaacagacataaaaataccatgaaactttactgaagaatggaatagaagacttttatagagatataatccatgttcttgaatgggaagacaaggtattgaaaagatggtagtgttttctaattgatttatatagctaaagctatgtttagacatatgtttatatagatacagatatatttaaatagatatcttaaaggttttagttgttacttagaacttgacctaatatggaaaagcaaaggaattggaaacactaaaatttgggaagaaaagaataataaaacaggggttttagatattaaaatgtcatataaacccataatttaagaagtatcatattgatacttcaatgcaagtaccaatgcaaaatagattattgcaaccaaatggaaatctcagaaacacatccatgattacattcctaattagtatattttaaagacgacattttaataagtagaaaaatgatagattacttataaaacagtccttagacaattggctatttgagcgaaatttttaaattaaagctttacctcatgctatataccaaaatgaaacaaagattaaagacttaactattaaaaaatagcattttaaagtaaactagaaaatatgtaagtaaatatccgatagcaaggtagaaaaggactttattagcaaagaaataaattaaaaaaggaaactgttggtagattggaatacttgaaacatttgtacattaaaaacaagtcagaggacactgaaaaagttaaaatatttaatattttcaatataaaaagaaaggattagtatcattcatctattaataacttacagtcaaataagagatgacactctaagaatgatagacaaaagaaagtcatgaattggcaattcaaaagagatactttatggccaataatcaccataaagcatgtaaaatatttctcatttgtattcataaaaaatgtaaattaaaataaatattaagactgaacattttttacttatgatatttgtagtagtttttgagaaaactaataatagagttaaatgaatggggaacaggccttgtcatacatatccctgctggttctatagatttacccaacctggagatcattttgatagtatgaatccaaaactttaaaaataaacatatcatataacccaagagcttttcattttagttttttctaatcagagatacatacagaaatttgtatataagaatgttcacttctgcatatttataacagcagaaggttggaaactaaatgtctgaaacagaaaaatttttaaataagttgtgctattactttagaattgattattatgtgagcattaaaaatgtgaacactctggaataacatggaagaaatggaaataatattaaatgaataaagaaaaggttgtaaaatgatatgaatggcatgattttagtcttctaataggaaaataacctggattatacataaagactagagcaataacaatgtctggggattatttctggttggtgagaataaggctggtgtttattcccctgtactttccccatgctttccaaattttctgtaaggactgtgtattgcctttttaataattaagtctcattgtttgtcaagttgggccatatatggtaaagaaaattatttttcatctgtattatttgatccctttaggacacagatattattgtatgggatgtgatcaatgaaagtggtctgtaccgtctaaaggggcacaaggatgccatcacacaagcattgtttctacgagaaaagaacctgctagttactaggtaaagaaataatggtttaatttccagttattttctaggaagagagaatttgctttattccttactcatttctctcatgagcagtgtgctcatgcttatgcattagttttctctcctgttctcctgcattccttctttccatttcttctaagtagtatcgtagagctatccaaagctatattatttttaaaatcatttttctaatttgtcattcttttttcttgatatcagtttttctgtgtttcttagccttttgaaactcattatagaatgagctttgtctaccttctagatctctagaaagccaggaatcagaatatggagcagagggaagatatgaataccaggtgttaaattcggcttgccttttgaggagagatgtactgtacttcataggccttctgaacacctattaggatgaaccatttgaaatttttatttgtgtacataaaaaatcatcaaatatcaacaattttatattgttcaacctaatataataatgaatattcctaaagaatggccacctaggaaaagctgggataccaaggtttgccaggcattaattagaggaaccatagtaatgactcagaaaaagctgtgagcactaaatgctttaccaatggtggatttgtttctgtgggataggatacaggtaaattagtgtcttgttcagataacacaggttctgtaagagaatgattctatagttctaatagaaaaaatatatattacagcttagggaatataaaggcaaagaaataacactgtaaggtggggttatatgggacggactttgtaaatcaggtttttgagcggtgtttttttccagtttgctcatgaaggaggattatattagatttatgtagtgaggaggtagggaagaggtgtttgagcaggagtagtagaggccattggctgcgagaggttatatttagggggttaagaacaaataaataggaaattttgagactgctgccaatgagcctgactttgattctacagggaacattgagctagtgcaaatattaaaaattaaggttatctgacagttgcacattggatgggatgagagaacagcaatggacaaagagaccaaatgagaagctgttaaaataatccaggtagtaggacttaagttcaggttagtgtacagaaatggactagaggagttaatacttagaaacttcacagaggaggcattttcaggacaagagactaactggacaggaagacaagggagtgggagcggtctaagatgtttccatggtagactgtctgaggggaatgccagtgctgtgatgatggaaatgataggaggaaggcctgatggatcaaattctgtattctttggtactctgcatctaaagtcattcttgtgcttataggtggaacattttattttctgcacaggaataactacaaggaaagttaggattctttgcttttcaaaagtaagatcagagagaatcggagctttagacattattgaagcatatgttccttttaaagcaacagtgagttttggatctccctattcgttgaatgagttttcctaaacaggctatatatttttttcctgtttcttcttttagtgggaaagataccatggtgaaatggtgggaccttgatactcagcactgctttaaaacaatggttggccaccggactgaggtaagtgtagggtcatgggcccagggaaataatgggaaggcaaaagggaaaaggtggtggtcttctcttcccctttcatggctctttgtttttagtgcacacagtaattatcatatgccatcttgagggacagtgaggctggtatgatggaagcaatgccagccattggagcagatactgctgctctgacatgtagtaaaaattggccttgcgtggtttttaattcctgagtttcatcatttctaaataataagtgtccacttttatgaatgtagggaagtttaatgatattatatgtgcagcacctagcttattgacaggtaagcagcacgtggtagctgttaaaatagttacttgaacagagatctattcagttgagttcagggactgttttttatatatctttgcatcctcagtgctttattcatatcaggcattcaggaaggtaatacctagaattaatgacaagaagattaaattctttgttgatttgcaacaatattattttcattatttaattcccggatacttgaagctgaaagttatgcaatggacattagtggggcaccttttatttgctagacactgctaaaagcaaagaaatagaagacttaaaatcatcatttgagtggattctagttaagatttatgctgaacagccattatcttaatttgattatacgaggttagagacaaactgctagtatcacaaaagtaacaatttcaccgcaggccatttttttctctgtaaaagtgagacttctcttagtgcattttgaaagggttgtcgatatgccttttctttgcctttaaattgctagacattttactacggtgtaacagacttttggaatgtcatattatgctacctggaatctcttgaaaatcgtattactcaaatctttttatattctataggtatgggggttggttctgttgtcagaagaaaagcgactcatcactggggcctcagacagtgaactgagggtatgggacatagcttatctgcaagaggtaattacttcttaaaatcatgggcaatatgtttagaagtttcataagcaccttggatttagaatcagatgtaattattcagtacttcacatcatattagaaggaattctatcacaccaataacctgcaacacttaaaaaagcttttcttccttatatgctcattatccttatttatttgagctcaggttagctttaggcttacagcttctggtaatactaatgttttagtttgtggcactcttaatcagatattcttggacctttgggtgtccatggatggccttcagaatatctgtgaacctttcccctcaaatatatatgtagaattttatgtttataaatatgtatattctgaaaagatctataactttttcttagacattcaaagaatttacatagaagaaaagcttgcagaccttaggtttagctgaatttcggtgtgtgctgggtccagcagccatttcgatgggagttacattagtaggctaggggttatcttttctttatttaaggagaaaatgtatctacctgtcttgcgatgcttttgcaattcctaatgccaatttgaattttttgttctataatatggtcaacctttcacctaaatacagaaaattttgaagttagtgaagagtggggtcattattttttcaccattgtcactaaacagtagtccttatgctatagaaagtttttggagatagtataataagtaatattttgtttgtatattatgtagtcagtttttaataagttctgatacctgccttgctactgaagaggtttgataagggagatcactgattagaagctgttattggccataagaaagatttctaagtcttcaggattaagagttacctcctgggccaggcacagtggttcatgcctataatcccagtactttgggaggctgagataggaagatcacttgagtccacacacacgtttgaggccagcctgggcaatatggcaagaacctgtctctacaaaaaatttaaaaattagtcaagcacagtggtgtgtgcctgtggtttcagctatttgggaggctgaggtgggaggatggcttgagcccaggagatcaaggctgcagtgagatgtgatcatgccattgcactccagcctgggcgacagagtaagactctgtctccgacaacaacaacaacaacaacaaaacaacaacaacaacaacaacatgcctcctggaacatactatttcagcttttattttctcatttttataaaacagattgaagacccggaagaaccagaccccaagaaaatcaaaggatcttctcctggaatacaagatactcttgaggcagaggatggtgcctttgagacggatgaagcccctgaggatgtaattcattttcatttcttaagtttaattgtgttgaataatgggaaagtaagaattgcagatttttagggaatcatcactttagggaatatttttgtcacttgcacttattagaattatgtttttttcagaagttcagcagaacttacatctaaccttcatctgctcttgcttcttctgtagcgaatcctttcatgcagaaaagctggttccataatgcgggaaggaagagacagagttgtaaaccttgcagtcgacaagacaggcaggattcttgcttgccatgtgagtaccatacttaggagaaaataacaaggactaggctgttccttccaaacactcattctttcatattcaatgtaaagatgactttttcttgactcatgttaataattcattatatggtactgtgtggacctataatctctagctttattagcataacaacaaaaatattaataattactattaggttggtggaaaagtaattgtggtttttgccatttaaaaagtaataattgcaattacttttgtaccagtattattattagcaaccatttattaaatgcttgctcttctaagcaatttaagagcatttaacttcttgttcagccttcagagcaatgctacaagtaggaaatggtatcctcattttacagatgagatagcaaacccagagagattaagttgtccaaggtaatgcaactactaagggaagaaaaataaatattgttgtttacttttaattgagaattaggtaaattacaaattacctctccttgactcacattaaccttttgcctttctagggaactgactctgtgctagaattgttttgtatcctttccaaaaaggaaattcagaagaaaatggataagaagatgaagaaagctagaaagaaagcaaagtatgttttcttaatacttacattaataatgaagtatcctgggtaggccccatgttactgaaaaaaaactggcttctttcatatttactgtcttatcaattaccattaaaagttaaagaacttgtgaggtatcgataacccaaatttgtcaagtctcagagagacagaaaatcatctgatttggcaaatcttttgatacctattctggtttatttaacatggttggattgttaagtgcaggttaatgagttttctaaaaagtcctgaaattagaaaaataaccggagacatttcagtggaatagttggaattacaaggaccttgttacaagaaattttatgggctattgcattcagaatccatttcttaagggtacctattaagtgaaataatactttatgacattgtagtgtacaaagcatttccacttatactacattgtttaattatcatggtaatcctgtgtggttaagtgacttttccagaataacacagtttgttggtcaaggggccagattttgaactcaagtaagagcaaagctgcttctagaaaaataagagcatgatatacttttcttcttccctctagattacattctagcaaaggagaggaggaagatcctgaggttaatgttgaaatgagtctgcaagatgaaatccagcgggtgactaatataaaaacttctgccaaaatcaagtgagtaaaaataaattatctgaagttatagaaatagtaagctaccaagtattattggctttttcatgctatttgtaagctgtctgtatgaattatatatgtggagacggtggtcatgagacatctgtgtcacactctgctcctgttgtcctaatcatgggcccactttttgtcttgtatttggattattatagtaccctttttagctagtcatttactgtcttttcctgcagctaatttaagaaaaagaaaagtgtgtcccacgttcagaaaggatataaggtcacttataaagaatacatacacagaaccaaagtatgtatcagaaccaggatctgagcctagttttttttttttttttttttttttacttaaaagcctactcagctactactcaatactcggagcactcttttaattttttttgagatggagtcttgctctgttgcccaggctggagtgcagtggcatgatctcggctcagtgcaacctccatctctcaggttcaagcgattctcctgcctcaccctccgcagtaactgggattacagacttgtgccaccacactcagctaatttttgtatttttaatggagatggtgtttcgccatgttggccaggctggtctcaaactcctgacctcaagtgatccacccgcctcggcctcccaacatgctgggattacaggcgtgagccactgcacccagcctcagggcactcttacttgaaaaattgtttatagttattcaaactttatatagatagaggacattgtaaagccttttcctggaaaaagtaaaccttgtgagctaagatggtagctagaacatttatgattattttcttgtacaggtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggttcgtgaaatgatgttttatatagctgtagttagtagtatttcttttaattttttttggtactcttaagggttagttattaactccttaaggccctaaatacaattatctttagtgcatttgggccattagcctgtggagcttagagaagaaaaagttgccttttaaaatgtggtgcaaaaaaaaaaaaaggcaagcttattccatgtttagagcttgtaactgtacttggctagagaaaaacacacaaccatactacctactctttaaacttaataaaaagcaggctgttattgctgcccagtaattgtaccctaatttctcacccttcttttactttcccagatgactgttttataccttgcttctgttgtcaaatcaaatacctccaaaaccttgaagctaatgatcatatctcccaccttaaaggaaataataaccctctctcacccctgcattgctctccagttactaccccattctctgatttgttttctccattctgtcttcatctgtctcccatcaagcttttgtccccactgtttcaccaaaacagtcattgtcatcagtgatcttgtttccaaatccattgagctaaaagctttattttatgctttgtccttgaattgatgactttctgtctttgacacactctttgactttcattatttccccttcccttgctgtctgtttattctcagtcctcgctccatctttcttatctttatgacgtctaagtgttagagtgctttagggcagagtctttggaccttttgtgtatctaaactcactttatgtaatctgtcatgtagctttctctgtatgatgacacataaatttatatccagctttaacctcctccctaaacatcaaattcatatatacaaatactttgtgtcaccacttggatgtctaattaagcatttcaaacttttatgtgtcccaaaccaaacttacgttgttcatgtctccaaaaatcttcccacctgctattccttcagacttccctatcttaataaatgattacttgctaccagttgtagtctaaaccttgtagccattcttgattttcttttatttatttatttattttgagacagaggctcgctctgtcgcccaggctggagtgcattgatgtgatctcgcctcactgcaacctccacctcctgggttcaagtggttttcctgtgtcagcctcccgagtagctgggattacaggcgtgtgccaccacgcctggctaatttttgtatttttagtagagacagagttttaccatgttggcctcaaactcctgacctcaagtgatccacccatctcggtctcccaaagtgctgggattacaggcatgagccaccgcacccagcccattgttgattttcgtatcccatattcatccaatctattagcaaatcctatcagctctaccttcaaaagtgatcccaaatccagcctcatcttaccacctgcactgccactaccccattcaaaccactgtcatctctcatctgggttattgtaaagccccctgactggtgtccctgctttcttgcttgcccctctatagtctgttctcaacacagtagccagtgtaatctttttatagtggaagttagatcacttccagtagttccatctcactctacctaccttacacaccttatctcttactactctccttttctgctccactagagccacactggtcttcttgctattccttcaacagaacaagaatgtgcctttcttatggctgttgtgctccctgttctttctgcctgaatccatcttccccatttatccataagctttttctgtgtcttatcagatgacagtcctatcattcttaccctactccttgcactcttcatcctcttctcccagcattatgttgctctatagcacctaacacctgatataccaaatatttagatatttattattcccaaagaatgttaacctttatgagattaggaacctctgctgtttcatccactgttgtatctccagcacctagaacagtacctggtaatgtagtgggcattcagtaaatgtttgttaagtggacatttgatatatatttgattaattaattaatgtttgtggtcctataaaaaatgtagggatatgtaatgatgtactaatttgacttgtaatccttcagactcactcacttcttggtaatggcagattgggctccgtggagcccagcagacacttttctactctgcttttgtgtgatttctgttccttaggatttggaggccttataaagtaaacaaagtttggtgctttttagtattttctcccatgactataattgtgtgtgagtcaagggtttttaagacttttatcttcttttatgttgatctgtctaagtgcattgaaacctacacactgacctctaaaatggggatgcagattctcttaacatgagttctttattttttctttctcataggtctacactgcagtgtattcgcacaatgacctgtgaatatgcactttgctcattctttgtacctggtgatagacaggtagtcataggaacaaaggtaaatggagactttttctgggatatctggatcttttctactcaaaattcataaagttaagaaatctggttcttctttttagcatattggaaatggactggagctaagtaatctgggaggatgttagtttattacatattttgtttactgaagttttactttattttttaaaaattatgaagaagaaaattaaaatcatgaccctgagataactaccattaacattttggtgatcatcctttcatgtgtctttttatgggcgcatatgtaattgtgttttaattaatgataaaatatattaagggtaataattaaatatattaagtacctaatatcatgcttggcagacagaagcattcagtaaagacaaactgatcaagtccttattcctaggtgctagtcagattgggagacaaccatgtggaaataagcagatatggatttggatttagtttctgccctttagaaataggtaatttgggccgggcgcagtggctcacacctgtaatcccagcactttgggaggccgaggcaggcggatcacaaggtcaggagatcgagaccatcctggctaacacggtgaaaccctgtctctactaaaaatacaaaaaattaggtgggtgtggtggcgggcgcctgtagtcccagctactcgggaggctgaggcaggagaatggcgtgaacccgggaggtggagcttgcagtgagccgagatagtaccactgcactccagcctgggtgacagagcaagactccatctcaaaaaaaaaaaaaaaaaaaaatgagtaatttggagcaagtcacataactgctcatagtgtgttcctttatattatgggatgacgacacttgctttttgacagcagctttcgtaccagatggactggtaccagcctctggcacttactagctatgtgaccttaaccctgttagccttggtgttctcgtggaaaatgacgttactgacccatttcacagagatgaagtatacaaaactcttagcagagaaactagcctgcagcgaatagctaatcgataatagagctggtagcagacatagcagtagtgattgtaccagtagtgagaataaaatggaacaaggtctatggagtgttttgaaaagtgctttgcaagtatttgtcattattattcccataaaacaaagccatatgtacatgagttttattacaaaatgtatggatcacaatggatatttcttgcttcaacaaaaaaatgtaggctggagagattttaggaacaatgccaggaaacagtattcacatctcaaaactttccttcctttttcactctttcaacaaatgtccatctctgatttgccgtcgggaaagtagttttttaattgcttaagactacccatgtggctaaaatgcaattgtcggcttactggctgtgctaggcaattaatgtacattatctcatttaatcctgacaacatctttgaaacattggtgatataaatttcattttacagatgaaaaactaggttcatggggatgaatttaccaatgggcacaaagcagacctggtactcaagtcttttagcttatgctgtctgtaccaccttgtgcagaagctcatcgtaaaacaggctttgcctctgtgtgtgttacatgctgacaccatgactatggcatatacagacctctaaataggaattttagagtgattgctttctatgccattatgatttttttttaaattcactgccttccttagtgctgtaggtagatcccatttcttattgtcaatgtattgcagaggaggaaaccaaaagcagatggaaaagaggtggttgcttaagccaataactatagaggatcatccgcttaaaggattggctaaactttaaaggcttttaggtttgcatttgctattttgtttattctgatttgcctatggtcatgatattttccttgtgaagttgtgtaaccaatgaaagtaatgcatccagtactgcatggtggtattattccatacttctacactatggtagccctgccaaggttaacccagcacatcagtaggggatttaatagtatttaatcaggtaggaaatacagaacatggaatgtgggatccatttcctaagcaatggatcacatttttgcagcttggttatgaagtcttttctaaattgtgcagtcatgaatcatggaggttgtacgtatgttcattggagctgtgctcattttgtgtcttcccagacagggaagctgcagctttatgacttggcttcagggaatctgctggagacaatagatgcacatgatggagctttgtggtccatgtccctctctccagatcaggtaactaaaccagattttaaagccctggagttcagccctgtggctaccctgatttctctcagggtttctttaaagaaagcctgaggtttttttttttttttggtctaatctttagtgtttgtatatgatgccttcttataaatgaccacctgtcattatgaaatgaaatcttgtttggctacttttgcttatcagcagcgtgacatcaaattgcttaccatcatgatttttttgccaatgttttgtaatacttcttaagggggaatattctcttgggcaacatgatgcagagaactgaatagactttgctgctccccttttttcctcaaacaaacatctatgactgtataagctaagtagttttagcaagtatgtcagcccttacaagtcaataaatatgtgctcaccttcagagcagttcctggcaaaagtatgcttattctaataatggtgctgttgcttagaaaatcttgagatttttttttttgacaacaccttaagaaattttggcccatttatttaaatattctcaatgatagacaattttcatccgttgaaagtagaacttagttttggaaaaaatcactgaagtttagagtgtttaataccacttggggtccaaacgaaacagctgtgagtctaaaatagtaataaatcttgcatttgtagagtgttctatcttttccataaactgtgtggtctttttttcaacaaaactagggatttacggaaaggttgtttcctgtgttataaatctatgagggacagacacttgagatccagtgttctatgtactttacactaacactgccatgtaatgagactaattttcttgataacggaaaacagcttcaaaactattttaagtagggacattgcaggactaaatttatatccttctgaggtgaatactttaaacaaatctagattatccattctatgtatatttttcaaactggtttactgagagtttttgtttcttcttgatgctagataatagtataactagaacttttcattagttattatttctgcctatgttagtcgatggtaggaattttcacataaggtttgtggcagcagacccaaaagatcagtgaaaggggctagggagaaccacgtttttcttaatttttatcccatgacgttaaataaaaatactttcttagacttttaaaatgtatcttcatagcaaagtttttatgctaaaatagtttttaattgaaatttcatttgattttcagcgtggctttgtgacaggtggtgcagataaatctgtcaaattctgggattttgagttagtgaaagatgaaaatagtacccaaaagaggtgagtagacattttttgtgtccattttttggagtgaaaatggggagctatggaatggccttttgacgtcttatatcatttgttgtgctctaaagagttaggatttgtctgaatttgtatactcatttattttttcttgatgttttttgtggtgctagactttctgtgaagcaaacccgaactttgcaactagatgaagatgttctgtgtgtcagttactctcccaatcaaaagctattggctgtgtctttgctggactgtactgtgaaaattttctacgttgatactttaaaggtacagtggttatgcctgcggatattttccctttctgactgactgaccttaagaatttgggttgaggctataaagaagtggccttgactgtgcccagcgatagtacatttctaaaaatgtgtgtgtgaatcaaagcaatgtaactatgctagggaagctagcattttaaaataattctatggttcatgaattttgtttaaagcaagttatatttcatatgttcaaaaaatcttgtggacagaaaattctgtcatactaagtagttataagagcattgctaggtgtcctgggcagtgatttcacacttggctatatattaggatcatctaggttgcttttaaaaatatagattactgagccctatacccagagagttgataggaccaggttgggcctgggaaatttttttgtgaaacaaatgccctggaatcttttcagtgaggagatacagagatctgactgaggcagtaagcttctgggggcttccttgcctccactatactgcagtattcttggcaagcacatggagggtctgtgtagtggacacaggtactcctgccaagctgtcttttgtgggttgtctttgaaaatacagatataaagcaatttaaaaatgtgtttaaagttatattttagacctacatgtaataaattatacccatattttatagacagacattaattatgtttttttgatgtttagttttttctgtcactgtatggacacaaactgcctgttatatgcatggacatctctcatgtaagtagtttaaatagtgtctcagtaatatgttgtcttttttacagcagatactttcttaattctggcttgatgtcttcatcttagattatttgtttttatcatcattctgttatatatctttctccaaaaacagtctcaaattaatatatattgtatcttatatatattactttaatgttttcagaataattttgcaaatatcatctcaatcaatccttataaatattatctctttccctcttgtagctctcccaaatagtactttattgtttaaaatactataattggtagagtacactaaaatatgaaagactttaaaaaggcattcctttttattctgaaggataatgctgctgaggagctcggatttatatttggatagttacggtattttacactatgtagacttttggtctcttgaccaaaatcatttatttcccaatacctagttttgattaggagtggcaatgtatattaaaaacaatgtctattctgcagagtgagactccgtctcaaaaaaaaaaaaaaagtctattctgtgtgaaaggagttgacctcatagctgtctgtggtcagtgcactaacaaagttaagttacaatgttaaatgtatttctttttttttttttttttatgttgacaaccatttggaccacgcattgaaataggagagataagagaaatactgatagggaatgtgggctacataaacattctagtagagtctttctcagcttctcttctgtttctttctcccactttctttccaaatcccatgccagagattagaaaatctttttcctatctaacgaagtaaatagataaccctatgtcaaggcacagcactgccctgtgacagtacgaaagtatttaagccacagagttcgtgcttttacttaacaagctttttaagttcctctgtaggtaagagcaaagaattcagtgtttttagtagagatgaaaatcagttttttggcttcattttaatgtgtttgaaagaaatgggttaaatattctggttagctttttattcatatacggaattcaaaaatcaaggtagtgttttacttttatttctcataggatggagcactcatagcaactggctccgctgataggaatgtgaaaatctggggtttggactttggggactgccacaagtctctctttgcacatgatgacaggtatgtatagtcttttcaaatgtctccctttgagtcacctgtaagttatcactttccttgagcatctgtgtctatttttcagtgttctcaggcagtgatacaagttctaaaatatagtcagacaccctagaactagctagtcaaaagctatttatgtgtgtaaaactctttttactaacctggaatttgatgacattttaatatttctgtcacttttcagtgtgatgtacctacagtttgtacccaagtctcacctcttcttcactgccggaaaagatcataagattaaacagtgggatgcagacaaatttgaacacatacagactctggaggtaaccacatgccttctgtgcttgcttggtacttaagaaatacttttaagaatatttacattacccactaagtagtggtcaatgaatgaggtattctttattttttttttctcctccagggtcatcaccaggaaatatggtgtttggctgtaagccccagtggagactatgttgtatcatcgtcccatgacaaatctctgagactttgggagagaacaagggagcctcttattcttgaggaagaaagggagatggtaagaactttaggcttggttacaaatatgccagtaggtatctgacaggctgtcctagttgaagttttctgtctagtgcagttacacctgatgcattgccaagtccaagaaccttcaggagatcttttcaagaccattgtcacccatttcagaagctaggcagagataaagatgccattagggtattatgttgtcaaaggagcagcttctcgcttcctcatttctcttcatatagagaccatgtttttttctctcaaattaatgtatatctatctcatggcaggaaagagaagcagaatatgaggagagtgtggccaaagaagaccaaccagcagtaagtaaattttggggaccttgagattatgccccatatatagttatcttattgaaattgactataatgtccagaatttctaatagaattaaaattgaggctagaagttgcaggtatcaccagctgataaagaatctgtgtaattctttctcttcaactgtatatcctaattttgtggttcaagtgattgaccaaatttgctactgaataattattctgtcaattgagactttagggaattattttattcactgtagcacaaaaataaaaattagaaaatttggatattctctttttaaacatttgcaggatgttcttacaataatacatatgctaagttctgttactggtagctgataacactgttagtattttcataaaataataatagctgttctcatatggatgtaagattaatttatcagctctttaactcaacagtcaacagtgttattcaaggatttctttgtttctggcaggttccaggagagactcaaggtgacagttactttactggaaagaaaactattgaaacagtgaaagcagtaagttgatatagaatgtggtatctcgttttttaataagatctcaactttttagtaaaagttttattctgtatcaaccagaaagccatttttttggcaaaaagttgatgagatttaaagatggggattataacctgtttccttctcttgtaaccaaagatgggagtagtcctgaatctctttgatcaatatgtgctcctttcaggtgttcctgggacctgccctattcagagtgtctagatatcatcccacctgagtccatgacactcagtctcttccctgtacattaaaaaataagaaaaccaaaaatgtctttaaatgctttttggcactctattcgcacgtctttattaaacagattgaagctatttcatttggcaaatttctggtcagttcttccagtttcagtgtcctgggatgatggagtatgttgtgatgacttctttcctttctcatcctctgtaggctgagaggattatggaggctattgagttgtaccgagaagaaactgcaaaaatgaaggaacacaaagccatttgtaaagctgcagggaaagaggtaataagagagtacagtaagttacagtatcaataaagggaattcccaaggagaaaaaccattgttttgggatttattaactaagatcaggatatgcaataaatggaatagaatctttccaactcactatattagaagaaattgaggaagtgtgggaagaagggaacttggtcttaatgaaagcgaaggaaaggaaattacagattgaggtgattattgtcttgagtagaaacccacgttctatgttggtttgggaggcagggtaaccatttcagatttctagataaaatacattgtccaagctcattcatgagtactatagaaactaacaggtttgataattcttttacactctgtcagttttttagggtctcttttttcccttttcaaaattataaaatacagttaccactctgtctataacaagtgctacctaagtctcagtttttttaatgacttgatttaataatttcttcataggttccacttcccagcaaccccatcctaatggcttatggcagtatctcagtgagtaaaatgtctaacggttttcctttgtttattaaaaggttacttacaaggacaagaaaggaagtagaggcattatgatttggggatggattattgggaatactttgtcttcaaaagtctcttttgaatcttggcattctctaggatattttgtatttcaaaaggaccactttagtgtgacttcccaagccagcctttttggttggactggactggcattcttctgttttctagtgcctgtttatgttcagtgtccaaagccctctgaagattctgttaatctaaattaacttttgaatcagccttcagaaggaaagttgacagaaatcagtctgatgagataaagaagagagagaggggaagagtgatgggagaatgtatgtttatctagtaatctctaattagtattttattgcatgtctcatcacagtaattttgtgagtcagggtatcttcaccttatagataaggaatctggcttgacttgtagcatagttggtaaggggcagagttcagttgtcaacccagatctgactgactctaaactcatgcagatcttgccattttagaatactttttctgaagtaagaaggaggggttcctgttttataggagatagaaattagagaactttagtagaaaccaaccaagagtatcactaatggtattaatccttcctttatagccttcagcttatgtattagagatttttaaagggatcaagtcgaggtgagtgagtccttgcgcacaatttttgtaatctgtcagcaaacatttatgaagtgcttatctgaacgggaaataaatagaaattataattgatggttatcttataggtttaactatatcaaagttttgatggaaaataatttataatgttctttttgaagtgctagaactaggaagttccttctaaagtatgaagagagatgcttttaaggacaaataaaggggagtgatttatgttgtaggcgatgaaataatatataattcaattagaagcaccaattgttaatttgttttatattttggcttcttttctatgtacatacacaattggaatattatataaagttttatattctgttctttttcacatatttcctgaacatttgtttgttgttcatattcttcaaaaaaaaaaaatcattggattcagaattattccattgtatgaataattactcgatattgcatttgtttctcctttttggctattatcagtggcttcactgaatatgtttacacatatatctttgtcatcattattgattatttttcttaagagtcctagcagcctaataactgaccagtaggcataagcttttaaagttttatattgccaaattactttccagggtgattatactgatttttagcaggctttaaaaaatttgttgccagtgtgtgagccaaaaggtaatattttattattttcatttcttttgactattaatgaagttaacatttcagcatatttgttgaccatttgtattttgtcctgtgaatttttagttacctctttttgctcttaagtattattttactggtttttaaagaattcttgctgggcacagtggctcatgtctgtaatcccaacattttgggacacttgagaccaaaagtttgagaccagcctgggcaccatactttattttctttgtcatacatttttgcaataattgttatattatttgtgattttccttttgattttatttatgagtttgaactactgaaggctatcattttcataatgaaccacaatatctacatatatattccttacaagaaacaacacttgtcttaggataaagatgaaacttcactacaggaatgtaaaagaaaattgattaatgtggaggttacaatacatttcaagataggaagattctgtgttttaaagatttaacttttcctaattaataggtttgtaatcccatttgatatcctcttaagattttaaattggaattgatgaaataataatacttgagctagttctagagggaactattttcccagattaaaaggctacaaaattagcaaaattaaaatagtgtagcattggtgtcaggatcaatcatcatgtcaggatcagtcatcataatagactctaatggactcaatatatggtaaaagaatatcatatgaagatggaatattcaacaaaaggctttggagatattgtttatctggaaggaaaaaaagttagattttcccatcatgccattgaccaaaatgcattccaaatagattaagatattaaatacaaaaaacaaagagagtcatctagcttacagatgaatatttaactctaggcaagatgtatccaagtataaaatcagtagaaaaaataataaagggaaggatttaaaaattgaccatgttaacaacgttaacaaatgtggcatttttatatttattttttctttttcagtgagctggaagaatctctacttgtgctgcctttctcttatgtcccagacattcttaaactctttaacgaattcattcagctgggctctgatgttgaacttatatgccggtgcctcttcttcctccttaggtaacatccttttccaaagaataccatgtctgttcagcagaactgcttcagtagtaccttaactgaagctgtcaacactttgggattaagaaatagtatgccgaactcggtggctcacacccgtaatcccagcactttgggaggctgaggtgggtggattgcttgagcccagaagtttgctaccagcccaagcaatcagtcttgcctttaaaacaaggatcatgatgacccacctctttaagtaagaagtcatggtaatacattgctcaggaatgcttactcagtcataggcctccatgttacaatcttaagatagctctggttctagtcagtttgccaaaagccaattatgattggccagtttgcctcatttgttgtttcttttaagccaaccttgtccagcctgtggcccgcaggccacatgtggcccagtatggctttgaatgtggcccaacacaaatttgtaaactttattaaaacattatgatttttttgtgatttctttgttgttgttgttcatcagctatcattagtgtattttatgtgtggcccgagacggttcttccagtgtggcccaggggagccaaaaggatggacattcctgttttaaagtgtttagtgtaagctaacaggttttgctttgtcctttaccaacattttaagaaagtcagtttatttctcttggtctctacaggtgcaaatggaaatgtaggggcatatatagaggtaaactaaggaacataaagcaaatatgttcattaggctatattcttacttatgaagattctgttaataggtagttgagaagaatatatgcacaaaggcttgatattcttctcatctctcaccctcattctcaagcggttacagcagagaacagggatggagacaaattgaacattccttcaaatactgttatgaagacaaaaactggtcagccaatgccaaatagttaaacaggtatatgtagtgaactgaccaaataggtatttggtgaattggcctggttttatgattcttaaccctccatttcttatactctatccaggatagtagcaagagaagaagaataatatgttctgttgccatattcataatttggggcaacttgtaaagacataagttcatatttaaccatgttactaacaatttttttttactgctatggtatacgtgctattgaattagggttgctggttctacgagtaacactgtgaatacttatagcgtatcagaggcttatggatgggtactacctgacaggtatggtagggtcatcaaggatatcttggtactctaggtcagagtttgaatctcacgaatgtctcttttttgctgtggctttattagaagtattaatgcatctttgttaagttagcatttcttagaaggctcattctgtctttgagttttccttaaagtaccactgtcaaaatctgtagccactggcaggttgctgggctggaagaagagcctttgcaaatgagttgaatgtgtcataaggtttaggacagtattttttaagttgtcatcaaattgaactgaatagtagagaaagaaacttctttggcttttttttttttttttgctcgaaacatttctataatgtatattttgttgttgctttgatattgtgtctgtttactgtttctagaagggttaagtagggctagaacctctctgcaacatggctgtgttttgtttttctatcaggattcactttggacagatcactagcaatcaaatgcttgtgccagtgatagaaaaattaagggaaacaactatttcaaaagtcagccaagtccgggtaagtgtctttgtatagagataaaataatgaggcaaattcctagtgtgatttagaaatagtatagtatgctgtgctttgtctttagcaatacccaccaccgataaatccatatttgagatagtttttgttagaattagtaggaatagaaaaaacaaacaagaaaagttcttaatgagggaaagataagtaacaacacctgaagctttggttaccctaactctcatacgctgctataatgaattgaagtgggagaaaattttttaatatttcttgtattgcactccaggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaattaaaaagtagccaagctaagatgcctggctgggcttctgaggaattaatacactcgtgtgtgtgtgtgtgtgtgtgtgtgtgtgtgtgtgtgtatgtgtatgtgtatgtacacatacatatatatagttgacacttgaaaaatgcaggtggtaggggcactgacccacccctacgccccgcacagtcaaaaatctgcatataacttttgattccccaaagtcttaagtactagtagcctgttattgactgggagcctgactgatgtattatatatattgtatactgtattcttaaagtaagctagagaaaagaaaatgttacttagaaaatcataaggaagagaaaatatatttactgtgtttatcaatact

SEQ ID NO: 38457 - DNA, 295669 bp, Homo sapiens
gttttaaaatgggttccaaagcggcgcgctctgtcggcccagcgggcttgcggcaccagaggtggtctgcagccgcgcaaggattcccacggtcgttctgggctggtgcagaagctggtgctcccgcacccagcggccagcaggctcggcgcagcacatctccccaccccacccccacacacccccgtggggtgcgtcgatcctgtagctcagagggagaagctacttagaacttcgtgaagcacagaggatctggagcgagccccgcagctgggatcagtggtcttaagttgaacccgcttacaggaagatgcagcccagctcacagcgaagtgtgggggggccgtctctaaagccgagaagggaaccgctttagaagtgggggtggggggaagaaagaatgaatgaatgaatgaatgaatgaatagaaagaagaaggaatattaaagatcggagaggaagttcaagagagaaaagagttttctctttcctttctgttcctggtgacttgggccctcaatctcgatgaagataacacgaggagtgcacaggcaagtgcccagttgccagcaattgcttcaaaagcccatgttcttcttttcccccattcttaggcacagccaaaattggtcagaaaggggagtaaagtgggacacgagcttcaaagtagggaaaccaaagaagggagcatccacgtcctctctctgcagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctgggtgagcgcaaagtgctggctgccggcggtgagcgcaggaggaggaggaggagggagaggaggtggaggaggagaaggaggagggagaggaggagggcaaggaggaggaggaggaagaggagggcgaggaggaggaggagggcgaggagaagggcgaggaggaggagagaagggaaagagctcccgtgtgcgctcggagatctccctctaatggtagaaacttttcccttttccagctctttaccaacagcctaatcgcctcattagcatatcaacaatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgccccaacaccccctctcttaccccaattccgccacattccccttcctttctttctccgcttccttttctccagagatgccttctgcaaagcccggcactgctcaaggtccaagcgccacgcctggggcccagcttctagcacttctcccttaaccctgctaccacgatccgagctgcccttttggccccgtgcaattttattagaaatcattatccctttcgcaattaaacataaccaccaaaccaagaccggcgaagtcactccaggattttttcccaacaagggatcgcctccgctcgaggcagccaccccctcgggccgcagcgccttgggagttttattggctttgagctttcccccaggttggagattctgccaagcggctccggtggctctgctggggtttgcaatcccttaattgcagcgtgtaaaataaaagttgtaccctgaagaggttacttgacagctccaggggttaaacaatttttctcctgtttgtgtgaagctagggccaactgacagttcaaattggtgttcaggctaaggtttcctgggtgcaacgtggacacgaatacagaactcctatggaactgcacacccgcttctgaagttgagcctaaaaacagacgtgtgtgtgcctgcaagtctagataccgtctcgtgcgtgcatcaaaataaatcaccgggaaccgacttttagctgtgttaatctgctctagttttcccaagattcccctttttaattaaagcagggagagttccttcatgatttggtgatgctactaacgcgggcgtgctcgcgaggcagagcccggctgccgcggaacctggaggcctgggagccacctactcgtccagactggtcagtccgggcttttggactcctcaccggggcctgctgggtcctctggggcttttatccctttcggttttgggatttttttttaagtaagaaaaaaaaaaaagaaaaggacctaatgtgacactaggaaatacagagtaattaattttcctggctgagcttcctcgtttgtcctccaaaagaaagttacctctgtcttttctctctgctatatgtacaaactccttaactacactaggtcccgcctcagagttgctctagtaaggacctttgattcatctgggcttgtttctcgaaaatctccaggcctcccatatttccaccgggcgttcctaaaaggggatgggaactgtggcagattggagcattccctcacaggtggaaggaaggcaggagctgggagaactccccattccacccaaggctgcagaaggggaattctccctccaaacacctcagcaaactccccaaacctagcagagtaggcagaaggctccaaaaagctagggagaagccggagctggcaaggggccttacagacccaggaagccctccccatgctctgggcctcccttgccctacctgaactgagcacaattcctcggctgaaccgggctggaggcttggcgccgccctccgtccagaaaatggtcgactttccagggctagaccctgcagggctgtcccagcctgtcgccagtgcagtggtttgaagtcaggatctgggctgccaggagcaccgacaccctcccagcagcggccatagcctgagcaggccaaaccctaggcctgagagcatgggtttttacactccgtagacgtcgccgcggtgtgcttaagggaactccaagtttcgctttcttgccctctgcgggcttggaaaggccgccctccatcctctgccaccccatttcaacccccgtttccacctccccgctgccccgcgcccaacagatctccggctccgcacccgctggggctgctaaactgttgttgtattcccgccgagggcgccattgaggtgcagattgggacctgccggctctggactgccgcccccggtgtaggcgctgatgaaaggcccgggcgagcgccagggtcgcctctggagccagccgagctgcatttatgccagcgtcattaccacgctaagtcgcttcattgcatgtcaatgctccggcggggccagaaccccgggacagcagcgccaggcctggggttggaggtcggagatccaggcctgacgtggggggcataaaaagggcgtcgcggggaagagggagtatttgtgtgagagacagagtcacaaagagaaagagacagtgaggggccagaacgactctcttttctccgattgtcaatgcccagtgggagccgggagcccaacaggcccagcccatcagattcggcccctccgggccccaaatccgctcgccccacccgagatccaggcctccagccacttgcctaactgtgagcccgcaagagccaggcccgcggctccctccttcctcctcctgcggcagtctcgcggctttcaaaccttagtcgaacccacagaaggcccagtcccaggccaaacctactcaacaggcaccttctcacggcctaggaattctgcagcgaaattcactggaatttgaggagaaaacccaaagactgctccgaaaggactcccccagtcttcagcctccaaataagagagttaggaagggcctttagcccacagggtcaggaagggaaaggtgtggattcccgggatttgtctctggtatgggatttgcatccttaaaccacgaggtttgtctaaacttgcggatgaaataccatttagtgaggcttaactagggagaagaatataaaagagctcactcttgataaaagtaataaatccaagggaaaaaagtacagaacgcaaaaggcctttctttctccaactccaggtagcttagtgaagactgcacttctcagaactttacttttaatggcctaaatctgaaacaagagaaagaactcgaccaggagtagcaaggcctcagatttttggggggaagttcagggcattagattcgaattgtcccctgggcttttgggcacacagaatctcaccctcaccaggcctcttggttggggcgaaaacagggcctcgcggttctgatgatgaaatcggcgacaggcagagccttttaccgccaccatcctggccagagccgctctgtttcccgaagggaaagtgtctggaagttggaaggagagagctggacaaatgcttccttggccagggtcggaatccggggctcaggaaggacaggagccaagccttggatgccttgtggtgtccgcggcctagcagggccaagttccacaggcgttggttttggcaaattcaccacccccctgcctcctcacccaccattctcacactccctcatccgtagcccaggcggcaaaaacccatttcaggaagtggagtgagttgctagctaaacttcgggcaaactttgtatctcctacagaaacacgctgcctccgcgacccagccatctggacccctttccattcttcacacatcctagatctcccgaaatctgggggtaccaagagagacaggtgcaccagaacctgtccaacactcaaccctggggtctagggcgaggccgcaggcgcagcaggctgaaaaccttcaccgccgcgcaccacaaccccaggccttctccctccccccttccgaattagtcatcctcccaagtttctacttgaggtgggaggggggtgggggaaacggccacagcacaaaccacaagtgacccaccaggccacctgtggagcgtgcgccggacttccccggcgccgggccccgcgggctgcgcgctttgcgcccagcaccgcagtcgctgcctgcgcccgtttttcctgtcttcgctgtctcctgggagctctcctgggcgctgccaggcgcgcctcacctacgactcccctgccctgggccacggcgcttcctctcctcctccccgctccggccccctcccctactccacccctgcccacctcaaccccagccaaggcaaaccccccgtacctgccagtcccccattttggcaagtatggacatcgcggctctgcgctcctggcgactggtccccgccgggcatgggctggagggctcggtcgggccagctccctggaatcgcttaggcaaatcctccttttttacctgctcaccaacatctcacctggtcataaagagctgggttgctacctgccgacgcatgcgcgctggcccaggaattcactccgccagctgcagtcccagcgccgcacagagctgacctgggaagtgatggatttatagccgcggcaatcttgccatcagctccagcttttcccaacagccccaacccgctttcccggtcagtccctggcccgggaaccgaagctgactgactgctggatgtgctgggtgcgatgcgagtgtgagtgtgttttcgcactccagtggtggggcatcgacaagctcgacccatggctagcctcccctcggaactttcgaactgggggagtctccactcccgggtgggggtcgggggttggggaagggctagactgctagaagcgtccagaccccatgatccccgcgcacctggacacagtggggacaggtcgccgtccccgcctccccacccgcccacgaggtgcagggcacggctggccttagcggatctgactctgccaaccccggggccacttcagcgttagattccacatgaaactgttgctcaataggtgaagacgttcatgattctgtgtcacttctggcttctaggtttagtctcctcccatcgtagagagaaagagagaaactctacacatacatacacacactcacacacactctctcttacacactcagacttagcacttctgtacaaaggtccacccccttcttcctactttcacagttcccttcccctctcccactcctctatggcttccagcgctttatcttttccatttagaactttttaaaggaagaatgggggcgttggtggctctgggatgggcaactgaggtttggtttagggtttgctttcccatgacagataaaatcactgaagtgatttcaccgctgcttctaattagaggggagctttaaaagaagccacgggatttggggctcccggagccgcacctggccaggagggaggtgagggtgaggagattggcctcgggccacactctcccagagacggtgccagtcccattccgcggctatgagatcgaattgtcctgggtctaggcctgggacgcctgggccaggcccagttaccctcccgggctgctgtcgccgggacttggagacgaacaaagaaccagttttaaatcgtcttctctgacatgtcaggcaaatatgtgtaaaaggtcagctccacgctgtggagcagagacctgtcccccaggcaccaaaacctcccctttctaaccgtgcccgagagcctccgacccctgggccctgtccaggcggctttgcacctctcggccttcccaggggtggggtggaggtgcctctccctggagtccccttatcggttccgcattttattcatccctgggctacaggactttcatcccaatgcccatcctttagttgatttaaaactttctgggacctgccttagaatcttggtcaaggctgggggtttctgtgggtagtttttttggtttgttttgttttgctgagaatttaaataaattagatgaagtttttaactcctaagtgcatcttccctggctttttccagacggtggaaatagggcggtgactaacttttcagagtggaagacacgcacgaagggcgcacctgcagctctccgggattcaggcgggggtcgctgtgctctcttaaaagtgagcggcggtttcagcctgccaccgcttcgcctcgccagctcggaggaaactctggctggaggcgacctcgggcccagccggacgggccgggccgagcctaggaggggctggcagacgtgtcccagggccagggtggggcgtagggagcgccgtctccaccctcagtacttttggggtgggggacctgagcgtgcggagagcgggaggcagagctgagagcggggttaagcgcgaagctaaggcgccgcatagggttgggtgggaatggacagggtgagctggaagcgaagcaccccagccaggccttaggagagaggaccgtcggcatctgtgcacatcctagcgggcggatgatgtgggagagaggcggagggaggtgaaatgcgggagctagaatttagctttgcagtgaggtcacttggggtctgcattcagctccgatatatacatgtaggggctgtgtgatcctggggaagttaccgaccttgtctgaactcctgtttcctggtttgtaaagtggctaattggtgggaattcaataggagaatgtgcgcaaaacgcttagcacagcgcctggccaacaatgcgctctcaagaaaggctgctgagccttgtccaggacggtctacaccgccccacgtccaagatgagttcacagcgcccaagacctgttcaatttaagatgatgtaaactgcattgcccttcttagacacgcagcagccaggagctggtcatctgcacctcccgcgatttcctcctcagaaccccagtcctgccagatttgcgtccttccctggctcctcaaacacctgctgcaccgctcagagcctttccccaccccgacctcctccgcagctccgcaccagcgagactgcgccccgtggcacctcgggggtgccacgattggcgggggatgggggatgcctcccagcttcatccgctctccgggttccagacaaccattccggagagccagctgctctcagtgcgggcaggcccaaggccactaactgcacttggcgacccacctccgttcccaagaggcctcggaaagtgcggcctcgggtctcttttgaaacagagacccgcggcaccccgcttctccccctgggataggagagggagagccgcgggagttccgcagccactcctggcgctgccaccacgaagcaggttcactagctaacagggcctgggacactgagccgtgtcgcaaacttttctgtgccccactcaatgagggaagcctgagctgcggtgaggggcgggatgacctggtgttgggttgagcggagctcccagcttcaggtaatgctgagctcaggctctctgaggcctgtggtgtcagaaactgcggtggaacccattctccgccaacaaccctcctcccagcgccatcagccccaaagtttctgagggagtaatctctgagttagggttaagccctgcttgagcctcattttcactccactccttcacttaccatcaggcaccatacccctagcgatttcacccaacgttctctaaatgaacttggatatctggacccaagtctgagcaatgggttcattcgggtgatgacctcggctttgcttttccgctggggagttgaagatccctgggcaggtggagtgacctctggcttcacgtctttcctcttcccctgtctcccacagtggctgctattccctgcccttggcagagcaaacctaatttaaactttgtttccttcttggtcccccttggcgtggtaaacttgccctcagggtcagggccaggaagaaggagaattgggctactcaaaggaaaaggtgagggaaactgagtggcatgactctccaattggattagggcaaaggaattaccaggagaattaccagcaaccacaggagaagaaattagccaaatctcttagcaaaggtgtccagggagaaggtgaagaaggaagggtgtgcattagggatgtcccactgtggctttccagaatgcacgctttcaactgacagcagtgggtacaggcccgaggtgtgcagcaagctgggaagcccagaggccgagaagctaaagatgccctggagactggaggagcgcatcaccggtcagtgcgccccctccaggagcggcctcccggccctctcggccttaggcgacaggtgcagcagctgtctctactgcccgctgtgccagggcggctgccgagcactggtgcggaaccactatcggaacgagtttgcacttctgtttacaaagcaatcctgccatcaaaagaggaacaaaatcaccacttatcacaccctgtcataaagtaatctgccctggagggaaacccttgtggagaactgctgtgtgtgtgtgtgtgtgtgtgtgtgtgtgtgtgtgtgtgtgttgggggaggggggatggaggaaagggggattctcccaactcttctgcagagtaaatcgctggaacgcgtggtgtcccaaccggcctggaaagaccgagagtaccatgagctgtgaagctggggtgtgacagggatgcccgtccagggctggcaagagtgcagaatggctctcttggatctttggaataggcacatctgcagaccccgctccaatgtttactttcctagcgccttcgaagatactcccaagggcccccaaaatagatcagcaaaaagtgttgggggtggggggagtgaaaaagccagttcttgaagactgtaaggtcccctttcgcatctcagcatctggagtgtgcagggaattcctgaccagtggttttgctccctccaatcccttgcctcccccctcccatgttatgcacttgttcttggagagatggacgttaaagaagcgtcaagcagttctcactgcaaataaatggtgcagaaataagagagagaggatgaaagcctaggaagttataagtgatcctgacccgacccagccaccagggggttatctctttccaggtcctgccttgtgtagagtgaggtgataaacgctttaggcagccaaatccaagcacagctgggtgcctggcggggatggggtgggggtggtcctatgtggtgcctctgcctctggagttacctttaggaaaggtcaagagaactatcctcccctccatgtctgctgaaaaggggctattttgctagtcttgttatcagtaattcaccacttaatataaccaggttttaggtttgtatatgagcgatcctggacatccaataccatccccccagttccccagcgccactcctggacattctagacaccagcgaggcttcttctgcagccattcctaatgtagcagatccattttggggggagtctggatgcaggtgtgtgtgatccagcctgaatttgagactctcagtttctttaacaccagcttgaaaagtctgcaatcactagccctgagagagtactttggttcctaatgggatatcctgagtcagggtggctgaaagagctaccagtttaccttgtacatggcaggcagaattctcaatgctaacttaccacttgcacttattgaaggcctgggggagatggtttcatccttcataattcctgtatgtctgatgccagtggagagtcaatgttttgctgtgtcactgtgcaaaaaacaaacaaacaaacaaaaaacctgtaaggtgagggattgtacttttcaatgactggggagctagttccaaagctggcacaatcgccaagagctaaatggaagaaggtccttgctccttctccaaaaaacctttcctgggggtaatgggtgacttagggcagtgaccttcaaactttgctgtgtattagagtcagctggagggttgtaaagtcgcgatgcctgagcggctcaacacaacaaagaaatcagaatatctgggagtaaaacccagatttgggaaccatttagggaaagtctgcctcgatctgtagcagagttttgggattgactttctaaactgcagccactcctcatctttggccttgtgaaaaacttgagaccccggctttatcagtcccccttttgaaaaacagggcgtgtctcagccctaggtatgcaaagctaaacgtctcaaaccgctctgcattcgaattagccaacttaagaacaagtccaacagcactgctaagcaagagcctaataactcagcgtttcgcgacatctcttggcggcgttgaccgtttgcccgggacactggtttagaagcacggcatagggtgtctctacatcttagaaatcaagacagcctctaggttagaataaagtttactctggactgggcataactccactccacctctgcgattcttcttctcgtttcccgtcttctgtcttttctttcctcccttcccaactcctagcgcgctactttaacgtctcagtctcgttcgctaagcccatgcgcctgggacttgttctttgaatctcaagtccgaaaagccaggaatcctcgatcatggacttcctcctgctaaattagagggagtgaaatttcgctctcctctccatcctacttccccatcccaaactcgctagattaagttcgctgaccaggcgcgcacccaatggcagcaccctctccaacattttccccaccagagaggcaagtgtcctacatttgtacgtaaaggtccctgagtggctaggtggagaggctcggatgtcttttcctggagcgggcctcggggagctgcagcagccccagcctcaggcaccacagccaagcgagcgcgccttgggctcgctgctctgcacgcagctggaggtctgggccgctgaccctctggccacgtagtcaacccgaggatgtgtgccccggggctcggccttgcctcgggtgagaaggctagtcaccattcagggtgcaggtgtcatggcctggaaatggcaatatctgagcaaacaggtgggcgtcgcttcccggcggtgcggtggccgctggctcgcagcgcgctccagctttcggcgccgccgccgcccctttgctctgcggactcagccagttcccgggtggcccagctgggtggctccgaggcctgcccccttgggctgcggcgggaggcggggactgcagtgccgagtgtagggcgccccagccgggctggcggttcacgctgcgctcgggcctctgccgggagggcgccctggcgccaaacccgggcgggcaggggggtggagagccgattgagtttattcccattcagaatttagaggctggtggagacagagagtctcctaaatggatgcaagtctcctgaaagtctgggccggaagcctcgaaactttctgccacgcaaagccccagctagtctccagggctcggtcctggttccctttgtgcaggcccggaagtgtccgcccggttttcccactgcctggaggggcccagggtcgcggatagactcggacaaggctccgtttactttcagtttgtcttagttgactaatggcgggactggttgtaatgcgtgctctgagattttctccaggatttgtcactttaattttgcaatatgaggtaaggccatgttttttaaagtggagacactctctttgcctttcctgccttcctaaaggaagcacatcctcttgatgtgcccgacgggacctgcagactccagactccactgctttttctcaaaaccacacacttgaaaagaatacacttcgattgctgttaaaacttgtcagatttccatgttttaatcgctggcaatgtcttaataatggaaccttaccacttttgcacgtgttgctgaaaagagagctctccagtaaaagtgccgtgcccatgagtctcttgaggctgtgcaaggttacttatcaaggatctcaaaatgacaggcaggctacctctggatttccaatcacatgttcaaaactcaaagattctcagtctggagaggtttggttttgttttggtttggttttaaaagctcattcctcccccccccccacccccaataacacagtacttaattgttttattaaattgttccaggctctggaaccctggggaggcactcttcaaatggtattgttttttctgtatttatgtcaacacaggaagttgcattagaaacttaagttgacaatttaataaggcctgatcaagtatatgaggtttttttaaaaaaattgacgtagcacatatcacttcatttgttttcaaactcaaaatgtgctctttctgaatcttacgatgtaaatcgtagagtctttatactagataattttagctgtgatattgtgaatataagaattgtacaattttcctttgaaatgtgctgctgagaagaataaaaatgaagttttctctctggaaatggctggaaacaaacgtcaaaacctgacaatttacacacacagttctctttctgacttgactcacccctttgagaattactttttaaaacaccaaagttataggatactaagttaattgtggtctttctaattctgaaaaactggttttcatttgcctcaagaacttttaaggcaaagttgtctaagatacttccttgaacaaagactcagacaaaagcatttgactgcttttaatttctcagcatttttacattttaaaactatagcttgaatgaaactcaagtgtcctgaataaagaataaatacttaaaaattgtttaaatacatattttctcctttcattgttggagcattcaagcaaagattgtgtaaaattcaggttaagtaaaatgtaaaaaatacatatccagtttacattacatattctttttgtgtacaaatatttataccaataaaaaccccctaagatatttatatctttaacatctatttttcttttacctttactactagaaagagaagctaacaaaggaaagcctcttcaaaaaatgggatttccttggccttagcagttctggtgtgttccactgccaacactaggtaggaaaaatctgacttgtgatgttgtgattaaatagcggcctggctcaaactgcccaaagagagggaattcactatgagttccacagttttatcttgaggaagaaactagcagaaacacagaattttagagccttagagctctcattacaaaatggccctcactataaagtggcatatactgaacccagcttagatgtgtgtactgagcccagtacaaatgtatatagtgaacccagagctctcattacaaaatgcctctcactataaagtggcatatactgaacccagcttaggtgtgtgtactgagcccagtacaaatgtatatactgagcccagagctattcagcttgttggtggtgggggtggttaggattagatgacaacacctattctcgaatgagttagtctatgatgctgtgtcctagattgtgctcaagattaaaaacctgattaaaagacctttttgactgaagagtgttcttaaaccttagcatccaatctgctttaaacaggttgcaattaaacataatgctatgtgttcattgttaattgcagacaggaaatgtccagtgttgatagaaattacctctaaagtcttgattctggaagaagctagagaaatggctcttggatttctaatactggcacttctttggtgactgtttcccatgaattacctcaacttgcactgaaagccacaagaaaaccaaaaaatgcaaactacaagcctgaatatgcctacagattacctgtgtctttaatgtgtcttgagcagtttggatacatgcttgatattttgtggcaacaaaatactagtgccagacctgtatacctatgtaacaaacctgcacgttctgcacatgtatcccagaacataacatataattttaaaaaattcaaaaataaataaataaaatttaaagactcaaaaaaaaaaatactagtgccaggactccacttttagtatcacttttcatattttagtatttagtattatcattttatctttcaatgtattagtgaagcttctacggtattgttctgtcttttcaaatcaacaggtgatagtaggaaagcaggaataatctcccaggaatcattattttattgagagttattagggagtaataagaaacttgacaataagagtggaaacattaaatcaaggtggggggaaaaaagaagtatctacctaaagaaaatgttttattcatcaataatcataacaatggaaatggattatgaaaacagctaaaggaaatcttcaccaataagtttgactatatttattccagtctctgtgacaccaaatctcatgattttctaaaaagatgtgactcaaaattagcaaacactgcaaagaagacacacgtgctatttatgagtgcttttaagtctcttagcagagacacatttggaagctaaatggaatcacagtgactaaaactttttctgaaatccccaatccgatgttgaagcacatggctcagaaacaatctcaatatcatcaaataactaaaccacaaaaaagaaaaagaagctctcaaatatccctttcccaaacgtttcccaaatgtatacacatatgtagacagtagaggctagaactggaattgtttttgcctaaacatttgctgcccccacgtgtccctttagaaaactgagtgttaaagctaaatcatgttcattagcaccttctatacagcattcgcaggttaggtacgcttaagtgtgatcacagaaacagcccagtgttggtagaaagtaccagagacagggcggggaagcagggagggaagaagctgacttttgccacagactcctggggtaatccccagtaattacataaggtccatgtgtctttgtctcttcaaacttgaaatgggtggcaggctggtgggacgggacgagtagccagattttcactaaggttccatctagctctaatatttggtcactctcattgaggatgataaaagagaagtagggaaacccagttatcccatttctggctaagtcgtcactttggaggtgtggccaaaaactcatgaatgaacttcctgtttcatcactcgaatccattacctcggttctctgtcatcttgacaaacttgcttcccaatgtctgagtggctctgagcctaaggagacaagaaggagtttgttttctttaatgtccaacaattatacattatacagtatcctgctcatgactacaaaaatgaaaatcatcttccacgtttatagtgtgtatcagtagcaggtgcctcaacacctcaacagctctgactagttttttttttttttttttttgagacagagtctcactctgtcacccaggctggagtgcagtggcacaatctcggctcactgcaacccccgcctcctgggttgaagcaagtctcatgcctcagttgggactacaggcacacaccaccacactcggctaatttttgtatttttagtaaaaacagggtcatcatgttggccgggctggtctcgaaatcctggcctcaagtgatccacctgccttggcctctcacaatgctgggattacaggcgtgagccacctcgcctggccactagttcttaaatctccacaataccatgatcagcatggcaaagccattctctccctattccagttttgttcaactctcaggcaaccacatgtttaaagaaaggctgggtccctcccttgcccaagggggtgaattttgattcatctaagagagatattagttttatcctgatcaccatctacgaagacatgtaacttaaaaattcaaagccccaaaggcaggaaatgcaaacttttaggttaactaggtggattttcaaacattttctccattaccagatggtctaatatttaactgaatagaaaacagatttatagtgtgaaaaatatttgtgtattcttacctaaatcatgaacccattatttaccttctctctgtgtaccaagaaaccaaagacatttaatgggcatgattaccaactataatcagaagtatctagggagagccagaggggatgtgatcttagaacaggctttagagtgacagacgtgaagtcattgtcctttgagctacagttcagtttggtggaagagcaaagtgccaggactattgcaggcccattcttcattctcagggttttgtcatttctgcaatgattctcaaatgacagtctctattcccatgctgcacccatattttcccaaagctgattaatttaactacaatatatacccttctcaaaaactgctaatgtaacaggtaggaaacactcaatattcgggaatgctgatgagtttcctgagtagcatgcgactggaatgggaagaacaggaatctggtatcagcctagccacaggctggctgttatgtccttgggcaagtttcatcttgtctctgggttgtatttcctgacctgtaatgcaagagtatcagtcccaaccatctctgaggccctttccagctctcagagactctggaatcagattcatacatctgtcagctgagtttccaaacaacacagcctggaaacaacaattctaaaaataaaacatacaactaagaaaccagtcacaagactagaaaacatcatcacatgtattctgtcactggtaacaaaatagttgcatacatatgcgagccagtcctatttattattattttttttttagagacagggtcttgctctattgcccaggctggagtgcagtcaccgctaactgcagtcttgaactcctgtgctccaacgatcctcctgcctcagcttcccaagtagctgggaccacaggtgaacattgccacacctggctaattttttattcttatttttattagagaagagttctccctttgttgccgaggctggtctcaaactcctggtttcaagtaatcctactgcctcagcctcccaaagtgttggggttacaagcacgagccactatgcccagccaagtcaatcctattttagattcatcattattcattagaaaaagtattttcacttatttgtatctcaccctaacttataaaatccaaataacgtttgactgacatgaagataatatgccacttaatcatgttattgacttcacttaagtgggctacacaaataacgccaataatattcagtaatataaaaattatgacatttttctaagggaactgagtcatacaggccttgaatgattatatataataatctttttttttttttttttttttggacacggagttttgctcttgttgcccaggctggagtgcagtggcgcagtctcggctcactgcaacctctacctcccaggttcaagtgattctcctgcctcatcctcccgagtagctgggattgcaggcatgcaccaccatgcccggctaattttttgtattattagtacagacagggtttcaccatgttggccaggctggtcttgagctcctgacctcaggtgatccacccgcctcagcctcccaaagtgctgggattacaggcctgagccaccgtgcccagcaataatctttatagtcaagtttgctgttgtgtgttttttttttttaaaaaacagaattagttgttttgtcttttattttgttttgttttagaggcagaatctcactatgttgcccaggcttattttgcaccactggcctcaagcagtcctcccagctctgccaaattttagacacctggacttggaaacccatgagaagttggccagcgcttccttttgcatttatgcagagcaatggtaaacgtcagcagcaaatttacaatcaatcttattttccagtgtctccagagatttgattgttttgcttatatggcttatggcaatacttacctccaatgtctgatttttcaaaaaaatttcatctaatcctttgtgcaatggtttacatctaattttttttgttctgagatgtagacagctattaagaactgatctttgcacagtaaatttttcctattcttagtcattatccttaggtgaggcaacatggtgccattcagttattcagcaaattctcacatcttccgtgtgccatgcattgttacaggttttgagcctagaaccatgaaaacaaaagacaaaaatctctgcccttgtggactttgtattccagaggagagaaaataaacaaggtaagtaaaatatatagtatggtagataatgaatggtatgggctgaaggaaaaacataaacaaagacgttaggtagtgctgagagggagggtggtttgcagttgagataaggatgtctccaaggatatggtggcatctgcattaccagagaaacattccaggcagagaaaccagtgagtgcaaaggccctgaggcagaagcatggctggcttgtgtggtaggcatgagtgagctaaggacagaggagctacagaggacgccaaagagaaattgagaattgaagggagttgggggatggagctgttggtaccgaagggagacattataaagaccttagcttggctgggcactgtggctcatgcctgtaatcccagcacattgggaagccgaggcaggtggatcacctgaggtcaagagttcgagaccagcctggccaacatggggaaaccccatctctactaaaaatacaaaaattagccgggcgtggtggcgtgcacctgtaatcccagctacttgggaggctgaggcaagagaatcgcttgaacccgggaagtggaggttgcagtgagccaagatcacaccactgcactgcagtctgggcaacaagagtgaaactccatctcaaaaaaaaaaaagaccttagcttttcctctgagagcagaaactttggaggggcttgagtcaagcaatggcgtgatctgcttcgtatcttaacagagtcaccttggctgctcggtcagggcagggggacaagtgtggaggcagcaaagtcaatttggacgctgtggccaacaaccataagcacggctgaggtcacctagggagtgcttgtggatgaacagggaagaggcccaagactggacgtggaggtctccaatgtttagagtcagggaaatgaaggacaccaacaaaactcacctaagagaggagcagtcgaagaaggaggggaactgctgagcatgggctctggaagccacagctccaggaagaggaagtgaacagctctgtcaaacgctgctgctgggtggagctccctgaagacagagagtgaacccttggttttcgccatgtagaggtgagtggatgtggtggaaaacctgcagggaggttagaatcagggagctctaccattttagccaaattcactacataaaacctaggcactgctaagcaatttactcacccctttgatcctcagcggtctcattagtaacacagatggaatgattcctacctcaggctggtgagctcttaaagagacaatgttaggagtattcatttgctaggatggccttcacaaaatacaaccgacctgaattgcaaacatttattttctcacagttccggaggctggaagtccaagatggagctgctgtgagggttggtttccggtgaggcctttcttcctagctcgtagacagccaccttctctctgtgtcctcacatggcttttcttttgtgtccatgccgagagagaggactctctgaggactctccctcttcttgtaaggacaccagtcctatcagactagggccccactcttatgacctcatttaatttaattatgtctgtaaaggcccctgctccaaatatagtcacattgaggattatggcttcataatcctgtgactctggggagaggacacatttcagtccataacaaagcccttagtgtgttttagtgctcaaaactgttcattcatacctcggttattccattattattgcctacgatattaccacttcagggtttttgttattttttacaatatagagcacaacgtataataaactacacatacgaattctcattgaggaattacagaaaatatatctatcgcgtctaacaaggtttaattagcatcttggaaaaaaaaaaaaacacctacgtttttaaggaaaaagttggccaatactgccatctgttggaattttggtcaaagctcatgtgttggactttactcattctttgtcaatatcttttctttctttctttctttctttttttctgagacggagccttgctctgttacccaggctggagtgtggtggcgcgatctcggctcactgcaacctccgcctcctaggttcaagcgattctcctgccttggcctcctgagtagctggaattacaggcacgcgccaccacgcccggctaatttttgtatttttagtagagacggagtttcaccatgttggtcaggctggtttcgaactcctgacctcgtgatccacccacctcggcctcccaaagtgctggaattacaggcgtgagccaccgcgcccggccctttgtcaacatcttatatgttgctgtgattattttcttccctaataagtgtaaaattggatgattttgttttcaatttaaacctacaataagtattctaagaaatacacaaagattctactatgacagaatgagtcttttcctacttgcgacattcattctaaatttcacaaatgcaagttgtggaaagagagacattgatggaaaaatttctacttttggagacaaattctcattcgcattagttttatttttatttctcaattataagttatttggcgttctggctcacctaatccgtgaaccaagagggttgctttcggaagcctactagtggaaaatgaaagtttcagatctgaagctagcaaatgctcacttgctgatgatgaggaacaagttctattataatagagttggttacaaggctatgcagcaagaaaaaggtgctcagctttatgagagaagtgcaacagatattggaatgtggtggccttgatgatgctgttcttaggagactccataggcattctttttttttttttgagacggaatctcgctccgtcgcccactcgccaccgcgcccggctaatttttttgtatttttagtagagacagggtttcactgtgttagccaggatggtttccatctcctgacctcgtgatccgcccgcctcggcctcccaaagtgctgggattacaggcatgagccaccgcgcccggccgcagtaggcattcttatactttgatgggagtagtgtaatatggtatagcttctttgtgaaatcgatccaaataaatatgagcacacctttgaacctagcgactccacttgttggaatttatcctacagatggagttgcaagtgtgcgaaatgatgggtttatatatcgtgacttttttaataatagcaaagactggaaacagtctaaatgctatcaataagacacatttaaataaatgatgggtcagtcgtataaaggaataacattcagtcattacaaggaatgaggcagttctctatgtactctacagattcatttccaagacatattgttaaggaagaaagcaaggtgtagtgcactaggtatggtatacacatgtgttaagaattgtgttttactgtagtataccataccttatatgtttaatagaacatatctcatctatattttgtaattcatttttataaaactgcctgtaaatagaaaaattttattatctctttcatgtctacagcttctacatttatgtcccctcttactttttttttttttggagagacagtgtctcactatgttgcctagaccagtttcaaactcctgggctcaagtgatccttctgcctcagcctcccaaagcgttggaactacaggtgtgagccagcccgcctggcccctcttacattctttgttgttgttgttttgttgttgttgtctttgttgttttttgaagcagagtctccctctgtggcccaggctggagtgcagtggcttgatcgtggctcactgcaacctccgcctcccaggttcaagccattctcctgcctcagcttcccgagtagctaggactgtaggcatatgccaccacgcccagctaattttttttataattttagtagagatgggttttcaccatgttggccaggctggcctcaagctcctgacctccagtgatcttcctgccttggcctcccaaaatgctgggattacaggcatgagccactgggccgagcccccttacattcttaatatagtttatttgtgtcctttcttttttcactttttcactcttgcttacaggtttttcaattgtgttaggctttttaaagaactgcttgtctttgtaatgctctatattataaattttagttgtatttatttacttctgctcttacattaatttttcatttttgatctttgaatttattttgctgttgttttctaattctaatttggatgactagctaattaaaaaaaatgttttcccacttcttaaatgtcagcatttataggcttttgcgctatacatttcactcaaagtagattttgtgaaatgccacaatatttggcatgtggcattttcacaattgtcaattcaaaatgttttctagttttcagtgtgacttattttttgatccatggctttacttataagtgtatatttaaaaatttccaaatatatcatttgttttgactattacatttttcattaaggtataactgacaaataaaaattacgtatgtttaaaaaaggaattgtattttgctgcaagtaacagtgagcttgttatggtgtttaagctgtttcaactgctaaaaaacaacaacaacaaaacagatatggacagggccatggcttataagggaactccatcattctcaggacctaatttcctccatcttgttgctctgccatcccaagtgggctgttttacagtccaagaaagctgcttaagctccagtcatcacgtccacatcccagccagcagaaaggcaaaagatctgacaaatgttacattctagtatcttccactccagtatcgaaaacttagttacatagcctgcattattagctaacagaaaggctgagaaatgcagttttttgctggacagcaatgagtggcttcaaatacatttggacggctgttataaaaagagtgaggagatcagacgccagtggctcactcctgtaatcccatcactttgagaggccaaggtgaaaggatcccttaggcccaggagtttgagaccagtctgggcaacatggtgaaactctgtctctacaaaaatttaaaaattagccagatggtgcgtgcctgtagtcccagctactcaggaggctgaggcaagaggtcaaggctgtgctgagcctttgttcatgccactgcactccagcctgggtggcagagcaaaaccccatatcaacaaagaaagaaagtgggagaatggatgttgagacaggcgacttgctgtctctttcatagtatgctaacatttatgtgatgaggagaatatataatctgtatatgttaagaaaagtttgggatgtctagaaatacacaagtacctagtaacagtatgtataggtgtctttgggaagatctgatgactaggggaaaggaagagagacaagctttgcaacttaccattttgccttttgaattttatattatggccatgtattttttaaagaaaaaaattacatgcaaaaactagcatttgatgttaagattttccaactggatctgctttgtggctaaaagtttccctcccctgtagcttgaatatatacaactaaaagatatgtatagatatgtatatgcaactatatatatacaactaaaatgtgtacaatgcaatgttttgatatatgtctatcttgtgaggtgagataccataatcaagctaattcaaattcacacatccatcacctcacacagttaccatttctatgtgtgtgtggtgagaacatttaagctttttttttttttttttttgagatggagtcttgttctgtctctcaggctggagtgcaatggcgtgatcttggctcactgcaacctccacctcccaggttcaagcgattcttctgcctcagcctcccgagtagctgggattaaaggcgtgcaccaccatgcatggctaatttttgtatttttagtagagtcaggatttcgacgtgttggccaggctggtctcgaactcctgacctcaggtaatccaccctcctcggcctcccaaagtactaggattacaggcatgagccacattacctggccacatttaagctttttaactaaaagtttattgggagaataaagtggagggcagttaaaatccctctagtggaagaaaagacctggacaatatgagctgtgttcattatgaccactgggaagatgagtttcacccttcacatgactatatggtgagaacatgtttctcagctgagacaagatttcaggaaagtttgcaagaaccgagagaaaatggaagaaaatgaaatatttgttcttcagagtcaccagttttattatatgcctggactctgtcacttatgtcaataaatttacaaatgcaaaatacacatttaattccagcgtggtagcatacacctgtagtcctagatactcaggagggtgagtatctaggactacaggtgtgtgctaccacgcttgaactcaggagttcaaggccagcctggacaacacagggagaccccctctctaaatgtatatacacacatacacacacacacacacacacacacacattcaaacattggaatcagatgtcctggacaaaatgctcaaatcagctgaacactttggaatgcttaacttttcttttttttagatgtttatttatttatttattttgttttttattttattattattatactttaagttttagggtacatgtgcgcaatgtgcaggtttgttacatatgtatacatgtgccatgttggtgtgctgcacccattaactcgtcatttagcattaggtatatctccaaatgctatccctcccccctccccccaccccacaacagtccccggagtgtgatgttccccttcctgtgtccatgtgttctcattgttcaattcccacctatgagtgagaacatgcggtgtttggttttttgtccttgtgatagtttgctgaggatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacctacgtgtgcatgtgtctttatagcagcatgatttataatcctttgggtatatacccagtaatgggatggctgggtcaaatggtatttgtagttctagatccctgaggaatcgccacactgacttccacaatggttgaactagtttacggtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttatttttttcttgtaaatttgtttgagttcattgtagattctggatattagccctttgtcagatgagtaggttgcaaaaattttctcccatttcgtaggttgcttgttcactctgatggtagtttcttttgctggaatgcttaacttttctttcctgcaagaggaagactgggagattgagaggtgtgcccagggtgtcagctcagtgcctggtagaggcaggtaacatgagctttgagccctggcctgtggattgtgttgtgcttggactggcctgttacgccatctgcttgcttctgcctgaaattcctgtaacacaagataaaacctctcattctgcaatttaccaataaaccttataaaatctgaggctaagccttgtgaaatggcaaaccctagaaagccagagagctggcatgcggtagttcagcagtggctgcaggaaatagaaggaaagggagtgaggagacagggtgcaagctggaatgtgatcacaggggagggggatctctggactatgggggaatgacgggcagcttgaggccctgagatgaaagacactccctttaagaaaaacgtctgtgactcagagccacaaggcgtgtcaggagaaagttctgatgaaactgcattccattcctggaggaatacgcattgccattgaagtacaaactctaaaatgatgtaggattaataattaaggcaacactagtagtggatggtggcccagagagctttccctagctttgttaattttcttctctccacagcttacgtaagcaaatattcacccaaagagtagagaatgttgagacatttagcattatgtattagtctgttctcacagtgctataaaaaaaaaatacctgagactgggtaatatatgaagagaagtttaattgactcagttccgtagactgtacaggaagcacagctgaggaggcctcaggacacttgcagtcacggcatggggcaaaggggaagcaagcacatcttcacatggcaacaggagagagagcaaagggggaagcgctacacacttttaagccaccagatctcatgagaactcactcactatcatgaggacagcaagggggaaattctcccccatgagccaatcacctcccaccaggtccctcccccaacattaggaattacaatttgcatgagatttgtgtggccacacggagccaaaccatatcacattggtcaacctatatagtaatgtttttcttaatctaaatgtatactaagttagtgttttatcgatttaaaaatacatcttgaaaaggattttgcaatttactttttttttttttttgtgagacagagtctcactcttgtcccccaggctggagtgtagtagcgtgatcttggctcgctgcaatctctgcctcccaggttcaagcaattctcctgcctcagcctcctgagtagcttggattacaggcgcctgccactactcccggctaattttttggtatttttagtagagacagggtttcaccatgttggccaggctggtttcaaactcctgacctcaagtgatccgcccacctcggcttcccaaagtgctaggattacagacgtgagccaccatgcccagcccacaatttcttttaaaactaaacatatacagttgtccatcagtatctgcaggggactggttccaggtctccctgcaagtaccaaaatcacagatgctcaggaatctgatataaagcagggtagtacttgcatataacccacacacatcctcctgtatactttaaatcatctctagattacttataatacctagtacaaggtgaagactatgtaaacagttgttatactgtatttaaaaaaataatttccactttcattttagattcaggtggtacatatgcaggtttgttatataagtgtattgcatgatgctgaggtttggagttcaattgatcccatcactcagatagtgagcataattatactgtatacagtttaggaaataataacaagaaaaaagtctatacatattccatacagacatgatcatcctttcctcccaccccttgattttttattgaattcatgaatatttgctgagtccatgaatgtggaacccacggatagggaaggctgactgcacctacattatgacctggcaattccacacctaggttactcacccgggagaaataaaagcatatgtcctcaaagaggcttgttcaaaaatgtccatagctttattcataaataactgaaagctgaaaacaaccaataggagaatgaataaactaactgtggtaaattcagacaatgaaatactacacaataaaaaagggaggaaccggctgggcgcggtggctcacacctgtaatcccagcacattgggaggccgaggtgggtggatcacctggggtcaagagttcgagaccagcctggccaacatggtgaaaccccatctctactaaaaatacaaaaatagtcaggtgtggtggcacgcacctccaatcccagctactcgaaaggctgaggcaggagaatcagcttgaatccaggaggcagaggttgcagtgagctgagattgtgccactgcactccagcctgggtgactctgtctcaaaaaaaaagggggggtggggggaggaaccattgatacatacaacatcatgatgaattccaaaaatgttgtactgaatggaagaagccttacacaagaaagcacatactgtttatatatttatcatcctagaacaagcaaaactaatctatggactaatctaaggtgggggcaggggaatccagagaaagggttacctttgggagttgggccatggggttggggaccagctgtgcaggggagctttcagggcagtcttaaggtactggatctcaccaggggtttgccttgcttgtatacatggccttccttgcaacttgctgaatggcacacttataaactgtgcattttttgtatttaaattttacctcaaaagaagaagaaatcaaccaacattgaactctaataaaagatatgcatgttggaacatatggggagaagtgtattgctgactgcaacatacttagaaatgcattaaaaagacaagatgctttgggaggccaaggcgggtggatcacctgaggtcagaagttcaataccaggctggccaacatgatgagaccccgtctctactaaaaatacaaaaattagccgggcatggtggtgcacacctgtaatcccagctactcaaaaggctgaggcaggagagtcacttgagcccgggaggcagaggttgcagtgagccgagatcatgccactgcactccagcctgggcaacagagtgagactccatctcagaaaaaaaaaaaaaaaagacaagatagattggtgggtggataaacagctggataaatggataaatagtaaatgaagtacagaagaatgtttattgttgaatctagctggtgagcatatgagtgttcaccgtacagtttcttcaattctgagctatgcttaaaaggttttataataaaatgttgaaaaaaattgatctcgaattagaattaggagttctaacaaagagcttctgctataacttacatatttctgtaggaggtattcccatgaagttggggcagtgggaaggcagagaagttgcaaggagaaaaatctgtcagtaatggaaggctcttatattgcattcgtttcccaaacactggcatatcatagagcttcaataaaagctttttgaatgaatgaaatgaataagacattcctcaaccaatgactgcagaaactataaaggaatgattctgacatgaatattacagaaaactccgtgagggtatatacttaggccaaagaataaacaagtgtctgaaattatcagactttaatactcattccagtgaatgtttctaaaggaccaaagggatgaaaaagagaaatttaaagtcatatctaagactagctttttgacttgacacgtgactcagccacttttgtattaccactgccatctttgaattaacactggagaagtatctagaacaattgtgtttttctcagaggttggaggaaacgagcatgactcttccccaaaatgcattacttctcaaaaacttacagggctattctcttttataggtttttgtttctgtttttgtttttgagacggagtctcgccctgtcgcccaggctggagtgcagtggcgccatctcggttcactgccacctccgcctctcgggttcaagtgattcttctgcctcagcgtcccgagtaactgggactacgggcccagctaatcttttttgtagtttctgaaaatttctttcacctgtagtacatgcagaccctgtctccatttattttccttggcctgttcttttttttgacaatctcactccattgcccaggctggagtgcagtagcatgaacttggctcactgcaacctccacttcccaggttcaagagattctcgtgactcagccacctgagtagctgggactacaagtgtgcgccaccatgcctggctaacttttgtatttttagtagagatggggtttcaccatattgaccaggctggtctcgaactcctgacctcgtgatccacccacctcggcctcccaaagtgctgggattacaggcatgagccaccacacccggcctcttttataggtttctatgtaagtaacataaagactctggcaagcagttaaagctctttaattgttcaccattctgggcacttagggttgtgttctttcttggttttggaatagcttatgcttacctctttaataacagagtagaattctactgtataagagatcctgggccgggcgcagtggctcacacctgtaatcccagcactttgggaggccaagatgggtggatcatgaggtcaggagttcaagaccagcctgctcaatatggtgaaaccccatctctactaaaaatacaaaaagttagccaggcatggtggtgcatgcctgtaatcccagctacttgggaggctgaggcaggagaatcgcttgaacctgggaggcagaggtttcagtgagccaagatcgtgccattgctctctagccgggagacaagagtgaaactctgtctcaaaagaaaaacagagatcctgggggacaagggtgacaccctttaccaggacaagaggcgtattcagggacagtgggctggggtaactcagaaaatcaagatgaaatttttttccccagaaaaatctcaaatttttctttgttttaactgatttccggtttgacactccacaagcaaagttaatttttaggaacttcttaagtttaaggactatgtattagcactgaccatgtgtcccgcatttttgatgtatcgagaaacaagaggggctcagctgtttcttgtctgtcttcacagtcaaggccacatactttttcctgcctttttaaaaaagtaagctcaatcagaaaagctgaaaaatagcacacaaacagccaaatacccctcacatggatttaacaactgttattatttcatcatgtttgcttatctcttgatagataggtaggtagataaatagacagcagataccatatttttttcctaagccatttgaaagtaagttgcagatgatacgatgtatcatgctgacacacttcagaatgcatcccctcaaaatatatatcaaggctagattttgaagagagaagtggtgatgctttttttttcttttttttttttttaagcttgactgggtcattgagagagactatgttctgggcattgtattgaaagaaggtaggttgaagttcaggtagttttggagcctgcaagttttttgtatttttgtgtttttcagacagggtcttgctctgtcccccaggctggtgtgcattggtgtgatcaccactcacagcagccttgacctctggggcccaagccatcctcccacctccgcctctggagtagctggaactacaggcatgcaccaccatgcccagctaatatcagcctgcagttttgacttggacttggattttataactggctcaacaaaattatatccactgttagtctgtttgggctactatggcaaaaatacctgaaactgggtgtcttttaaacagaaatttatttctcacagttctgaaggctgggaagtccaagatcaatacctcagctgactcagtgtctgatgagggcctgtttcccagttcacagacagccatcttctccctgtgtcctcacatggtggaaggggcaagggagctctctgcagtctctctgtaagggcactaatcccactcacaagtgctccaccctcatgtcctagtcacctcccaaaggccccatctgctaataccatcaccttggggattagaataccagtgtatgaatttggaggggagataagcattcagtccattgcacccttatttccaaggcccagggataacgctgagctcctctgtgggtgaagcacattcagctataaaacagtatcttaagattttcttctcgagttagatttggtacgtagataacgacctttaactatttgcatctatgcagcttttacttccacctcctcaacccactgtctacaattctcacatagaattaagaataattttgcatagcagataattggctgagcatgcggtattcttttgacccattcaagtgaataaaatactgtataggaacactgtcacaatttaaatgaaattaaatttcttgccccttttcctcccccgaccatttagtctttgggtagcaacagagatcactaacatgatataacaattaatgtagttttgtttcagggcattaatttgatacaaattgtaattctgttctcatcagttctgtaaattgctttactgtaattacaccaagtatttgatcaaatattgccgatatttccatctgtttagtgtatggtattatgatttcaaaattgattctagatttagtccaataatttttagaatgtctctttctatataaaagtcaatgcagaaataataatattttgagataaaaaataaaggcatcttctagttaatataacagattttagtcacatttatattctttaatgttcagtgtatgtatccactacatgagaaactcaagacacaaacaaaatggttatatttactgcaacactaagcaatatggaacattaaaaagaatatgtattcataaacaagacaaaagatggtatagcaacataaaatttacaagaacattatagctggactgtataggaagagcttgactgatttctttccacaatgcattttcatcaaaactcatacatattcagagatacaaatagcataccagtgaattcaatgaactgccactgaaaccaaaacattatttcctagcatctgtttgtgggaattatgtaaaatacttaatgcaatgtgttttcattgcaatcctatttttgtttcccaagcagtgaattttcatttaaaccaatatgtttacctgagacccacacacatgcatttattggaactgaaatacagctacagatacaggcaacacgtctgaggccaaaccaatgcattttgatgcaactcagccaattttccacaacatgtgttctgattctctagggatataaagccccatataatggtaaatgcactgaattgtgatgacaaggaggggaaactgatgtctggattgtaaagaaatacaggagcctcagctctctggaaaccttgccaccaaaagcgtgcttcagggaccagcagcattggtgtcacctggggagattgtcagaaagacagaatctcaggccccactctagacctactgattcagaatccaaattttaacaagatccccaagcgatttgtttccacagtaaaatttgaaaagcagtgttttaaagcaaacttctaaatggtcatagttaactttagggtaatactctaagttttctgagatggaaagcacagcatggtgactacagttaataataatgtactatatacttgatgaatatgttaattcatcaagttaattactacaaattggttgtaataatcctttcacagtgtatacttatatcaaaacatcacattgtgcaccttggatatatgtacttgttatttgtcaattatacctcagtgaaccagaaaaacagttttctgtggcaagcacttttctccagtggacagagagttcggttgaaactagcttgctttatatgcaaaagcaaccccaacccctttttcttttataggacatgtgatacatgaatttatttttcttgtgaacactcaaagaattcagaagtctgctgagcattctcttcatttttattaattaattaatttcttttagaaatggagtctcactcggttgcctaggctggagtgcagtgacacaatcatagctcactgtagcctcaaattcctgggctcaagcaatcctcctgcctcagcctcccaagtagctaggatgacaggactatgtgcaccatcacacctggctaatattttaattttttgtaggggcagggttttactatgttacctaggctagtctcgaactcctgacctcaagcaattatcctgcctcggcctcccaaagtgctgggattataggcatgagccacatgcctggaccttcttttaccaaagttactcaccatcaatactttcacttccctttagtttcttttctatgaatttatgtacatattatatatatgcaaacatttaaaaaacataagtgggatatattagtatattgttacatattatatacatattatctttttcatttacctacatgttcctgaggtctttctttgtctctgctggtcaacttcaatctataaccaaccgcatggtcctctgcagtatggacacaccataatttctatagccagcttcctatttatggacatttgtattatttttatttttgcttctattataaacaatgccgtaggactatacgattctgaccctccctaaactgctcctaagatcagtgcttgagatattttgcataccctgcacttgatagatcagctggccccacccagataataaactggctcatctgatcttgtggcccccacccaggaactgactgaacacaacaagacagctctgacttcctatgatttcatctctgacgagtcagcactcctagctcactggcttcccccaacccaccaacttgtccttaaaaactctgctccccgaatgcttgaggagactaatttaagtaatcatcaaactccggtctcctgcaaaaataaaaaataaaaaataaaaataaaaaataaactatgccatatgaacattcttgaacatctatctttttgagaatttctttagattatattcccagaaatggaattttagggacaagagaaagagagaaaagcatatggtaatagactcacactcagtagtgatcaaatgtaaattaaacaatagagccctttcccttcttcaggttggtaaaaatgaaaaagaatgatgcacttgtggtaggtgtatgaattggtaaagccttctaggaagaaagtttagcaatagccaatcaaaagctttgatgttcaggaaggtgaggtgcaggctgcttccagggctggtggggtttgcctcagaggggcgggcgtggagccccagaaggcctgagtcccatgccttacaactcgcaaacaaacctccttcattccatgggacacttcctttaggcaggcaagccccagagggacagtgagaacttgctccagtgtcagcaaccccatggcactcacacttccacctcctcttcccgcgggctccttgacaccggggttagcctgtagcccccctctctctcccgtcagagtggctttacttgaattgtcctactgcccttcccagcacctggctttaattggggctgctctgggccactttgccaggaatcctgaagttgatttgtagggaacagggattgagtgaccgggccctacctccgctccccaaaaacaatgtcctgttctcatgtgctggcccacctcctccccaggacctgggtccctacgctgaacactgaggtggcttttgctcagctagtctccaagacagcacgagcctattttgcctatattggtaagagtaatggagctgttcattccagttatctttcactggactgaaaggattggcttaaaaaattactgtaccctactgcgatattgaaaaatatatatttcatcttccaccttgtttccctgtgtacaactcctaaattccttggaatctccaaagtgatgtcttttttgtgtgctgatgagttgacagatggccggcagcccatcggtagcttcagaacggagactggtcatgggaaaggctaagccatggttagagggttggggctttcagcctcatcccccaacctctgggaagggaagaggggctgaagtaaagttaatcaccaatgaccaagagtttaatcaatcatgcctacataataaagcctccatcaaagcccaaaagaaccatgtttggagaccttctgggtagctgaccacgtggaggttcctggagggtgtggtgcttgggaaggacgtggaaactgcttctgccttcccccatactttaccctatgcatctattaatctttatcctttgtaatatcctttataataaatcggtgtttccctgagttctgtgagctgctctagcatattaatcaaacccaaggaagggccaccggagggggccataggacccctgatttatagccagtcagatgcacagataaaacaacgtggagcttgcagttggcatcaggagtgaggggtggtcttggggaatgagtcctcaacctgtgccttcttacactatctctaggtagctagtgtctgaattgaattgaattggaagagtctcggctagagtccacagaagaattgtttgcttcttggtatgtggggaaaaaaaaccccacacatgcggccacagaagtcttctgtgttgggtgagagaatagaagaaacgcgttcagtctgtatttttttcctctcaggtctgctgtgctgagactcatggcaaaccccaggagccacctatgatgtgccagacacataagcccctccctcacaggcgtgggtgcagccggggccgaccgcattccaaggagcatttcctctgaaagccaggccaagtgcccgctctccagcgtgagtcaagcagtgccatgcctcccacaccccttgcatcacatctctgggaatgcacagaccttgctgttacgctctctcttcccaccctttatgggtgttttctttaagtggcagaaggaagtgggcatgggttgggagaggaccatgaattctagtttctgccatactgcaggtggatttggggaagaagagagtctcctttctggcccacaccacagggacattcagaagcagttgttaaagggggagcagcattggctgggcccagggaaggacaagtagatgactgtataaagccaggcatgagagcagttggaataagttgtttcactcataaatttatggtgagccttgtccatattgttaatggcatattcttgtgaagcagacctacatacttctgaaaagcacggccttgttccctgctcagctaactctgtctgatctcctgacatatatatgtggcaatttggaattctaagcagagttcaaaattctaggccaagattgggatttggaggagaaaaggggccagttccagagcaaggggaagaataaaatctctccactgtggacactgaaatgagactgataatgacctatttattatccatctagggcagaccccacaggcaggggtcatgcatgggggagttcaaaacctagttcatcaggttctttcctccaggattttggtctaggcaacatcagatgaaaacgaacactaagggcaatcctgaagaaccaaaagaaactggcaatggacaggtataaaagtgtgtgtgcgcgtacctgtgtgtgcgcgcgcatctgtgtgtgtgcgcgcacctgtgtgcttgcacctgtgtgtgtgcgcgtacctgtgtgtgcccgtgtgtgcgcgcacctgtgtgtgtgtgtgcacgtgctgacattcaaggcaacagcagggcttctttactactaatcaacctttttcttctctgttggccatgcacttccgtatggctcagcaaacgtgcaaaggaaggaatagtgggagttggagaggaagaaggcaaaacctggtctatgtgtggctctgaggtttttgtttgttttttaaaatgtaatccactaaattcacctctgggaccatgtgaaatgtgactcaggaatgggaaaatgattttagctcaggaaatgccactgccttcctagaaatagctttggctcaagtgaaaaagagatgggcaggccaggcgtggtggcttacacctgtaatcccagcactttgggaggccgaggcgggcggatcatttcaggtcaggaatttgagaccagcctggctgacatggtgaaacccggtcgctactaaaaattccaaaaattagccgggcatcgtggcgggcacctgtagtcccagctactcaggaggctgagtctggagaatggcttgaacccagaagatggaggctgcagtgagccaagatcgtgccactgcactccagcctgggcaacagagcgagactccatcttaaaaaaaaaagaaaagaaagaaaaagaaatgggcaagacaaaaccaagtttaagaatgcaagtttattacttatgaaattatagattgcaggaaccagagacttaagtttctccaggcagtagtgtatattatcaggatgaggtaaggaacaccagaccaacagggcagacaggtctgatgaaggaaagggacctgaaggtcattctgaatccagtggagctctaagtaggtcaacttttggcctcctcagaccaacatccctttgtggtgactcaagaccaatgtctacctcagggtcaggctggtttggtcaaccacctccagtatggctgacttagttttcaaattcagccacaaggatcacattgaggagtctttttttcagagacagggtcttgccctgttgcccaggctggagtgcaatggtacaatcataactcactgcagcctcgacctcttgggctcaagcaatcctcctgcctcagcctcctgagtagctgggactacagacacacaccaccatgcccagctatttattttatttttgtagaaatgggtcttgctatgttgcccaggctggtcttcaactcctgatcctcccatcttggcctcccaaagtgctgggattacaggcatgagccaccttgcccagctgatcttgaggagtagttctttctttgctctgaagccccatggcttcatttgaatgtatgactaagcccctgttaatggtaaccagtgaaatgaattattattttttttatcatttttatttttttttgagtcagaatcttgctctgtcgcccaggctggagtgcagtggcactatctaagctcactgcaacctctgcctcctgggttcaagcgattctcctgcctcagcctgccgagtagctgggattacaggcgccagccaccacgcctggctaattttttctatttttagtagagatggggtttcaccacgttggccaggctagtctcgatctcctgacctcgtgatcctcccacctcggcctccccaaagtgctgggattacaggcgtgagccaccgagcttggccagtgaaatgaattattaaacattattaaccttggtattgatatatcaaaattaatttactaaagagtgttgtggcccacacctgtaatcccagcactttgggaggccaaggtgagaggatttcttgagcccaggagttcaagaccagcctgggcaacaaggccagaccccatccctacaaaaaatttttttaaaaaaatagccaccaggtatggtggtgcacgcctgtggtctcaactgcttgggaggctgaggcaggaggaatgtttgagcccagaaggtcggggctgcagcagtgagctgtgatcacaccactgcattccagcttgggtaacagagtgagatcttttctcaaacaaacaaacaaacaaacaaaaaaaagatttggaatcaatatcctagcaagactctgggttgcaactttgcaaatcttctgctgtgcacgtttgttgttgttgttgagacacagtctcgctctgctgcccaggctggagtgcagtggcacaatcattgctcactgaaacctcgacctcctggactcaagcattcctcccgcgtcagcctcccaagtctctgggactataggcgtgcaccaccacgcctggctaattaaataaaaaattgtgggtgccaggcgcggtggctcacgcctataatcccagcactttgggagggcgaggagggtggatcacgaggtcaagagattgagaccattctggccaacctggtgaaatccagtctctactaaaattacaaaaattagccgggcgtggtggcgcatgcctgtagtcccggctactcgggaggctgaggcaggagaatcacttgaagccgggaggcagaggttgcagtgagccgatattgtaccactgcactccagcctggcgacagagcaagacttcgtttcagaaaaagaaaaaaaattttttttttttgtagaaacagagtctttctatgttgcccaggctgatcgcaaactcctgggctcaagggatcctctcacctcccaaagtgctgggattacaggcctgagccaccttccccagccctatgcacattttcacaaagatattttgaaccctagcagtgggaaaggatactttttgactggtgacatcccagagctaccttgagttcttgtggttttcaatggatattgctgatttttgtttaaattttggtcaaatttgtttacattaaaggagcatagttttgtgtttatttcggttggcttggcgacattgtcttaaacatggtatgatacacataagcctataattttttttaattaagtgaagtaaaagcctgacattaacactttgtgtaggtttatgtaagtaatttattcctgaaactaatgcctcttcaaatggagggttttgtttgtttgtttgtttatgggaattttaagtaattttcagtgcctgagaatgttctccataaaacctgtaacaaaacacataataatggttccagtgaaaatagttatctcaaagttggattggatttgaaattctaaataccctatgactagggtatcaaaatttaaggtttggtcaaatgtaactttttaggtgtcttgtgtatggtacaagtttgaaagtgtttatgtgcactacctgttccattcatcatatctacccatatctgtatcacttaaaatgaatacttttaggtttattaaaaagtaacacttcaagcaagcaaatggaaattattttgcagtaactacaaataatagagaagtattaacatagagttgtgggccatgacctagtgggttgtttgtcactgtttattttctgccatttcctaggggtgaattgcatcctgtactgtttacagccttatctccaacttttgcagagtcaagaatttaaaagcagcagggcttggtggcccatgcctgtaatcccaatattttgggaggccgcagcgggaggatcacttgaggccaggagttccagacctccctgggcaacatgatgagaccacatctctacagaaaaattagctgggcatgctggcatgtgcctgtagtcccagctcctcaagaggctgaggtgggaggatcacttgagcccaggaggtcaaggctgcagtgagctatgatcacaccaatgcactctagcctggggacacagtgagaccctgtctcaaaaaaaaaaaaaagaggaatttaaaagcatttactactatctagtgtactatatacttattattagtttatttttggtctccctcaccagaatgtaggctccttaaaggcagtagtattgcacataatagggactaatatacctttattgaattaattaatgagggccaagatatctcatgtattgggtatctactatgtgccaagccttttactaggtgctttacacacacatttatattgtgccacttaaaacttatagtaactctaaaagatgatggctgggtgcactggcccacacctgtaatcccagcaagttgggagcccaaggtgggaggatggcttgaggccaggagtttgacaccagcagggagaacatagcaagacctcatctctacaaaattaaaaaaaaaaatacaaaaattagccgagtgtggtggtgcacacctgtagtcccaggtacttgggaggttgaggtgggaggatcacttgagcccaggaggttgaggctgcagtgagctatgattgtaccactgcgctccagctcagataacagagccagaccctatctctaaaatttaaataaataaataaataaataaataaataaataaataaataatgtctattatccccattttgaaaaaaaaaaaaaatctgagagaaggccagacaccatggctcaaacctgtagacagagacgggcagaaggcttggtcaagagttcgagaccagcctggctaacatggtgaaaacccctgcctctactaaaaatacaaaaattagccaagtatgatggtggcgcctgctatcccagctacttgggaggctgaggcagaattgcttgaacccgggaggcagaggttgcagtgagctgagatcacaccactgcactccagcctgggtgacagagcgagtatccatctcaaaaaaaaaaaaaaaaaaaagcctgagagagaaatcaagcaatatgccccaaattacactactagcaaataacaaaatcaaaattcaatcccaagtctcaattttcttttcaaattcttcacttactatatccgtttcctgttgctgctgtagcacgttactgtgcactttctcacggtgcaggagatgagaagtctgaaatcaaggagtcagcaaggccacagtccctccagaggctccaggagagaatccattccttgcctcttctggctgtcaaaattctgtggcttggagccgcatggctccaatgtctgcctccaaggtcacacggcttcctcctcttctgtctgtgtgaagtctccctctgcctctgtcttataaagacacttgtgattgcatttaggatacccctagagaatccaggataattgcctcatcccaagatccttaactttacatctgtaaagtcttttttttttttttttttttgccatataaggtaacactcacaggtccagggttaagatgtggatatcttttggagagcctaacacacacatcttaaaaagagaatttgtgctcaggtccccagggccaagacaaggcgtgctctccagcacagtcatgccaattacaacactcaggcaaagcccaaggggtgctggggtcctttacaagatgcagtcacttttgtctggatctggaccttataacctgagcctagtgcagcagagggggttggaggagtgaggactggatgggccagatgccaggaaggtaaaaagataaatgctgatttgtcagatatgagtgcttggtgactgtagggttcctgaaaacagaaggaagagagaggaaggaaatatgtttcatgaatataaaaagaatttaagtattcactttaaccaagtgatcaggcttagtgtcaccaatatgaaaaaaaaaaggtgacattgttcacttctggtgtgattcaataagatactcaacatcacctgttcaacactcttaacaaagctaaaaagtaaataaataaataaaggttaaatcacttggaaaccatcagacaaatccagaatgtgggacattttatgaaacaactgtcttggatgcttcaaaatatttcagtaccatgaaaaaaatctgaggagattgttctaaattaaaaggcactaaagacacatagaccaaagtagcacttgaaccttaattggatcctgggtggtggtggtggtggttgttgttgttgtttttcatttttttattattatactttaagttttagggtacatgtgcacaacctgcaggtttgttacatatgtatacatgtgccatgctggtgtgctgcacccattaactcgtcatttagcattaggtatatctcctaatgctatccctcccccctccccccaccccacaacagtccctggtgtggtgtgtgatgttccccttcctgtgtccatgtgttctcattgttcaattcccacctatgagtgagaacatgcggtgtttggtttttttgtccttgcgatagtttgctgagaatgatggtttccagcttcatccatgtccctacaaaggacatgaactcatcattttttatggctgcatagtattccatggtgtatatgtgccacattttcttgatccagtctatcattgctggctggacatttaggttggttccaagtctttgctattgtgaatagtgccgcaataaacatacgtgtgcatgtgtctttatagcagcacgatttataatcctctgggtacatacccagtaatgggatggctgggtcaaatggtatttctagttctagatccctgaggaaccgccacactgacttccacaatggttttaaaaaaacaaaaaaaacagctattaagggcattctgggaacaattaggaaaatataaataggaactattttatcataggatattgaattaacattaattttctttttttaaaatacatgttagcagcagatttgtattagatggaggataacaagggttaggtaagcagtaacaaatggcaagtacagccatgctacagaggagtgaaggcattactgggtatgggaatgggcacttatgaaatctaagggtcaggtctcctgacgaactctgaccacccagtaagctcttctccttggcacgcaatatgaccagtgctggcatgaaagcgtctacagtagctagttcaacttggccaaccgttcttccagttctggtcgagctttgaatcttcccttgaagtcttcttcagtgtgctccttcaacgacaatctgactccttcaggaagactgctttggattatttccaagaaaatctctgcaaacgtagcactcaaactgctgatgtgaaccactcgctcatgggtggtaagcactgagtccaggaacgttttgctgccttggtcctgcaaccacaacacttcagtggttttggttggcatcacataactttcctcgactttaatggagagagagttgcagaagttgtgaacatactgggcataactctctgccagggtcatgtcatatgcaggcaggtgaatgtttaaaaccccatattcatcatctgtccccaaattaatgagtttcacttccactttttgcttcttctcgggctcttctgctttaattaggtgcttgtactttccaatggcgtgggtgggctttgtcttgtagggccgactagtacttagtagaatgccacctacagaatagatgggcttctctgctgaagttctaagccttaagagtgaaaagccttgcttaaaagtggtattgttcctcaggcacagcactttttccaaggttctgctcatcctttgctgctgcatggcctctagctgtgcaaaccgaagacccgcccccccaacattaattttcttagatgtgataatgttttatgtcagaaagaaatttttaatctcacaagatacatgtgaagtatttagggatgaagtatcctggtgtttgcaaccaacacggagtacaattaaatgaagggtatgtgggtgtttgttggactattcctccaacttttctgtaggttatactttctttccacataaaaaagaaaaaaaatgttgatgcttatctggtgaatttggtggtgctcttcaccagtgatgagtgacgggagtttgtcagtaacttataattgctgcgctgtctttggattgctctattttcagtaatcatcagtaaactgacacagtgtgggagactcactaagggccctgggctaagccattcttaacgcaatactcctcaaaattgaagccactaatataaataaattagttgtagttgtctattttttatttttttgagatggaattttgttcttgttgcccaggctggagtgcaatggcacagtctcagttcactgcgacctccaactcccagattcaaatgattctcctgcctcagcctcctcccgagtagctgggattacaggtgcatgtcaccacgcccagctactttttttttctttctttctttcttttatttttagtagagacggggttttgccatgttgtccaggctggtctcgaactcctgacctcaggtgatctgcccacctcagcattccaaagtgctgcaattacaggtgtgagccaccgcccccggcctgtagtttgcctattatctgtgattctgttctcctctatttggatggaaaacaaagcactaatgatggatgtaacctttgtgagcattttttcaccatgagcatttattcattcaatgaatttgcactgggcagctacaatggactgctgtagtcacaggggattcagtggacaggatatggtgcttgctattatggagattatattctgagtagaagcattagaaacaagcacttaaaaaatctacaaagagtgattctacttactcactgctcttttattaactctcattatatctaccaggacacaagctgaagatgtttacaataccataaagcagatgtcaagatggctcctgcaggtcaggcatggtgcctgatacctgtaatcccagtgcttttggaggccaaggtgggaggatcagttaaggccaggagtttgaggccagtctaggcaatatattaagacaccatcaagaaagaaagaaggaaggaaggaaggaaggaaggaagagaaagaaaggagggagggagggaaggagaaaggaaggaaggaagggaaggagggagagagggagggaaggagaatagaaggaaggagagaaagagagagagaaagaaagagaaaggaaggaaggaaggagggaaaaggaaggaaaggaaggaaggaaaggtaggaaggaaggaaaggtaggaaggaaaggtaggaaggaaggaaggagggaaggaaggaaggaaaggacggaaagagggaaggagggaaggaagggaagggaggggagggaagggagggaggaaggaaggaaggagagagaaagaaagaaagaggggaaggaaggaaggagaagaaaaagagaaaagaaaagaaagaaaggagggagggagggagaaagaaagaaagattagtccagcatggtggcagtatatgcctgtagttccagctactcaggaggctgaggtgggaggatcatttgagcccaggagttggaggctgcagggagccatgatcgcatcactgcactccagcctgggcagcagagcaagaccatgtctggaaaaaaaaaaaaaaacttgcagtcccccattatttctagtctcctggtatccataccctcatttagtccccttctattagcctgctcaataaatgtcagcttatttttggaatttaaagtcataagaatggaaatggatgaaatgacttacggagaaaacatggatagaagaaagctccaaaatctgagcccttgggacttagtccatttgggcggccacaacaaaagacctcagcctgggtgatttataaactgcagaaatggattgctcacagttctggaggctgggagtccaagatcaaggcactggcagattccgtatctgctgaggtctctgtctattacacagatggtgccttctatgtgtccttacatggcagaagagccaagggaggtcccttaagccacttttataaggcactaattctgttcatgagagataaggaggaccccgcaagagagactaagagggagcatccagaaaggtaggataaatatcaggaaaatatgatgtctggaaaccaagtaaggtaagttttctaaggaagagagagagagcgagaggagattaactttcaaatgccattgagagttgctaggaataacaattaaaatgagcaatgtggaggtcatcggtgaccttgatttaaaaactaacaaacaaagaaaacaaaaaccattctgccgaggcacggtagctcatgcctgtaatcccagcacttgggagccaaggtgggaaaattgcttgagcccagaagttcaagaccagcctgggcaacagagtgagatcccgtctccacaaaaaataaacaaaattagctgggcatggtgatgcatgcttgtagtcccagctacgtgggaggctgagataggagaatcgcttgagcccaggaggttggggctgcagtgagccgtgatcacgccactgcactacagcctgggtgacagaatgagactctgtcaaaaaaacaactcactgggcgcggtggctcacgcctcccagcactttgggaaactgaggcgggtggatcacaaggtcaggcgtttgagaccagcatggccaacatagtgaaaccctgtctctactaaaaatacaaaaaactagccgggcatggtggccggtgcctgtaatcccagctacttgggaggctgaggtaggagaatcacttgaacttgcagtaaaccgagatcacgccactgtactccagcccaggcaacagtgagagactccgtctcaaaacaaaacaaaacaaacaaacaaaaacttgtcagtagtgttaagagaaagaacctctttggaatgcgttaatgaatgagaaaacataaactgaaagcagtacctagacacatcattttgaaagaatgttgctataaaaggaaggtgatagatgaggtagcagacggaggggtaagtggagtcaggaaggaatcgtttttgggatgggggaaataagagtatgctttatgaggattagtataatatggtaacaagaggaaattttatagcacaggggagggacagaattgctagagtgatgtccgtgagtaggagaaggttggatgggatcacgggctttgggaagagggtcaattcatccacaccagcaagggagaagggagcgtatatgggcacagaggttagtgtgctggtgggagcttgtggcacttgtgatcactttactctttaccaacctccagaactgtgagaaaataaacttctgttgcttaagccaaaaacaaaacaaaaaaagacacctcttattactggtcagatgactgtgtttgctgaatcaactgaaaagctttgtctgaacaaccccctacaggctgtcatttggcggagaatgtgagagccttcgataaacttatccgggacctccctgtcgtcttcttctcactgaaacctggctccctgggactcggccttccctgagcatctcaaatggtgttttctctcctataacctttgtgccactgaaactaggggtggagtaggtctcttcctcattcctcatcactgcttcaaaccatcttccctttcatcttcacagatacatccagctacaaatctcacgccattatcagactcttccacacatttttccacttcgtaagcagtcatcttctggggtcacacccccattccttgcagagatacactgccactctaggcaatacacttctgccccaattcctggtgatttcaatgtccacttagacgacctctcctccaatgacccccttgtccgccctacctcagcggctcacttctgtggtcatatccttgacgttgcaaccaagtaacaacaaccctgacataacatcaattgccacaactcactctcctcctcaccaccatcttggcattctccctctcatttctccaactccaacaatactttgaccccattgggacttcacttatgatcctatcaccattttgcttctttcaatgctaccatatccgttcttcccttcttattcagctaaactctgtggtcagttattatcatgacttcttgcttgaaccctgagctctcttgccctctcttctccgtcacttcaggcggctccaccacaaccctgatgaaatccaactctgcctgttccacgcttgtccctatagaaaagcatccaaccctgcagaatgttttaaatttgtggtcactcacctatgtgggccttgttcattctccctgtttcctagaaaattatttcatcacttattcctccccaagcctgtaaacacccatcctcctgtcagctgtcactgtcagctgataacatgcacggtggctcatgcctataatcccagcactttgggaggctgaggtgggaggatcacctgaggtcaggagttcgagaccagcctggccaacatggcaaaaccctggtctctactaaaaatacaaatttagccaggtgtagtggcacgtgcctgtaatcccagctactcgggaggctgaggcagaaaacttgcttgaacctgggaggtggaggttgcagtgagctgagatcatgccactgcactccagcctggaagaaaatgagactctgcctcaaaaataaaataaaataaaatgaataaaattaaaaaatagacttgtgacaatggaacatagtagctctggcacatagtagttgattaaaaaaatagtagctgcgatttttgcacttgcaatggtttatgttattcaattaatcaaccaggattgaaaaccaggttatcaggtgggccaaggaaaaggtcagaagaggtgccgtccacagagacaaatctgagcagaggtctgaatgaggggaggagggagcaggagctgcttgagggggctgaggggtctggaggtggggtgggggaggggcgatttaagggtggaagagagccacaggcactgaggtcgcctgctccacggctccacctggtggaaatcatccttgcagagctcaagctacagacaaacccaaggaaaaaagatgtaatactcaaatattgcagccaatacttctgttataaatgtttttaatgtagtggtgttcttctaattattacttgtctttcggaagtacacatttaaatgtttttgcacctttgttcttagatcattttgcagcatcaacttttctccctggggttcctgagcccccttttctctagcctcggaggcagaatatttgtggagtcgaatcagccctgctcagtagtccagcaaactcttttctttttaaactagtatctctgcaagcaaactcttcttccacatcccacaacccaactcctcatccccacaaacacaaaggcacctcgcaccacaccttactgctgcttctcggcccccagcgcacactccctttgctctgcgacattgcacctgggagctccacagctgcgcttctgccttgccggctggcttgggttctattctggcggagatttgaaggcaggaggaggagggcaggactgcctttttctggtttgagcgctgtccctgcaatggcgcttccccctcagcagcagctggttccagcctccgtttcccctcagcgctaacgtcattgctccccctaaacagatcagcagcagccgtgtgcccttctcggaggtctgagccccagcttcatagggccatgtattagcttcctaggggccgccgtaaccaatgatcagagatggtgtcatttaaaacaatagaaatgtattcgctcacagctctggaggccagaagtcagaaatcaacatgttagcagggccgtgctccctgtgaagggtccagggaagaatccttcctcgcctctcctggcttctgtggttgccagcaatctctggcgttccttggcctgtagctgcaatactccaagctctctgcctctgtcttcgcaccatgtccttccccttgtgtcttctgtgtctttccatggccttctgataagaacacaagtcactggatttagggcacactctaatctaatagaacatcttttttttttttttttttttgagacggtgtctcactctgtcgttaggctggagtgccctggtgcgatctcggctcactgcaagctccgcctcccgcgttcaagtgattctcctgcctcagcctccggagtagctgggactacaggagactacaggcgcccgccaggcctggctaatttttgtatttttagtagagacggggtttcaccatgttggccaggatggtctctatctcttgacctcgtgatccacccacctcggcctcctaaagtgctgggattagaagcgtgagccaccgcgcctggcctagtagaacatcttaacctgattacatctgcgaagaccctatttccaagtaaggtcactttcaaaggttccaggtagatgtcaatttttggagactactcctcaacccgtgattgcctcctccaccaagtctctcagttccaataactccagactcttctctttaagggaagagttattctaacccttagaataacttctaacccttaagggaagaagttattttatattagcatggtgctttatttcattttgtttgatgtttgtttgttccgctcttcaacacgtgttaccaattacctttagtgaattccctccattgaaataacattatgtggtttcttctttcctgattcaaccctgacacagtgcttgttaccgggagaggttctaggaaacaagactatcaaaaatgagagtctataatcccagcactttgggaggctgaggcaggtggatggcttgagatcagagttcgagaccagcttggccaacatggagaaacactgtctctactaaaaacacaaaaattagccggatgtggtggtgcacacctgcagacccagctactcaagaggctgaggcatgagaatcgcttgaaccctggaggtggaggttgcagtgagccatgatcgtgccactgcactccagcctgggccacagagtgagactctgtctccaaaaaaaaaaaaaaatactgtaacgcagagtgacatgtgcctgtagtcctaactactcaggaagctgacacagaagtattgcttgaagccaggagtttgagtcttgatatggtttggatctgtgtcctcacccaaatctcatgttaaattgtaatctccagtgttcgaggtggggcctggtggtagatgatttcttcatggggacagtttctcatggtttaacaccactgccccttggtattggaaggtgagtgatatctggttgtttaaaaatgcacggcacctccccaccacctcttcctcttgctcccagccatgtgaagtgttggcaaccctgctgccctccgccatgattgtaagtttcctgaggcctccccagaggccaagcagatgccagaatcatgcttcctgtacagcctgtggaaccgtgagccaattaaacccctctctctctctctctctctctctctatatatatatatatacatatatatattacctaatctcaggtatttccttctagcaatgtgagaatagactaatacaaggctgaagtgcactataatcgtgcctgcaaagagcctccatcctgggcaatatagcaaaaccccatctttataaaaaaaaaaagagattctgggattagcttggaaatgccacttgccttaaaaagagtgctgagctccttgcaaatgggacagtaatgcatgtcatgccatagcattatgattaattgcagtatcacctctagtgattgtgatgaaatgcctaataaagcaactattaggagaccagttagctgctgcacttgaccacttcgttagtaatgattactaccagggctgtggactgttgtattagtttttctttgctagataatgaagtaccacacacttggcagcttaaaacaacacccacattgggcacggtggctcacgcctgcaatcccagcactttgggaggccgagacaggtggagcgcttgagatcagaagttcaagaccagtctggcaaacatggtgaaaccctgtctctactaaaaatacaaaaattagcagggcatggtggcgggcacctgtaatcccagctacttgggaggctgagacaggagaatcgtttgaacccaggaggtggaggttgcactgagccaaaattgtaccactgcactccagcctgggcgcctgagactccatctcaaaacaaacaaaacacccatttatcagttcacagttctgtaggttgtaaatgcagtatagttgtgtcccctgctcagggccctacgaggctaaacttgaagtgtgggctgggagctgtcatcggccactatcggctacccacattccttgccacatggctgcctgtcttcaaagacagcaatggagaatctagtttgctttgaatttctctcatgctttaaatctctgccttcctctttctctgacccatagaccaggatttagagggctgatatgattaggtcaggcccacctggatgatctcccttttgataaactcatagtcaactgattagtacctttaattacatctacaaaattttttttgtctcaaaatataacacaatcatggtattaatatcccatcctattcacgggctccacctacactttaggggagaaaattatacaagttctctacaccatgggtgagaatctttggaaccttcttagaattctgcctaccacagatggtgtattttggactacattgaagagcttacaggggaacaaaaagataggcttaaaacactgaacacagagaaccagagtgtgtctatggtactccttaaaaaattttgctattttgtgtggctgcaaggttaccctcattgaaaataagaacttgtgtgggttgcagaattataacataagttgacttcgcagacttgccaagtctcctgccaagagcactgattgggaaggatagacacatctgggtaaacttagataaagctaagaattttgaatccctgattcactgtgtatttcttgccaggagaagcaacgcttcttcatatgtgtaaggaaattagctttctcttgcttgaaaaccttataatgactttgaggcagttatcttgcaagaggatgcctattctccccaatatccgctccttcactcttcattgctttcagacttttaatggagtcagagctcagcctatttcagagagaaaagtacaacacatgtcccaggaagagataattcatttttcaaaaaattgcaagcttttgctaacatatcttggcaggaacctaaaaaatatatgttgggatggattctaaaggttatagaacagattaacattgcatttggtcagtttattaatggggatgcgcttactggggaatctggatttcatgtgtccactcaggcatctagaattggctgtaacaatttgatggattcagtgggcaaaacttggattcaacggttgcctatatccaataaagttaagttgtcagactttcctggtgtgatgtcaagggaagaatctaaaagcaaaagggaaaaggaatgctgcagtggacagaaatgttaaccaggagccacccccgccccaaactcacactctgagatggcccagaggatgttctcttcactctgtgttttgatatgaaccatgaagtgtcccagatattaccccacttgcacaattatgtattagcatacgtgaatatgacagaaaacacatggcacctgggtcagggaaaactatattgataatctttccttgaagaggatcttgatgtccgcctctactaggtccaccactgtgctgctcaaatctacttcatctacatctggggagcagctcctccagccttccagtgggcctctcttcctggaggaaatataaaagtagatggcttagaagcacaagctacaacacctgctgctgcagctggtctcagggcaatgactgatacttttcattttcctcccctaatccccagtctagattccccctcacctctgcagcttacctcctggcttatccagtggtgtgaccctggtcctcattcccatggggtctgaactctggccaccatgcccttcccaaaagtgttcctgcacttgtctgtcatcacaactggccacgggagtaccatgggttgcaaaagtggatcagtggtgccacacgtcttccctaccctcatagtggaaccacagcctttcttctcctgctgatcagggtcaattagccctgccaagactgtgactcttctcttttattgctggtcccaattataagaagcccaaaatccccaggcagcaggcatagctgcaatgtagtggagacttttgctgtgtcccctgataaaattatgcccccttttgaccaggatttctagcactgcagaaagagaggctgcagggacaggaagcaagacacttctgcttcatcccttggttcatgaccaatatattcttcctactggggagccatctccttatcaatgctgtgtgattcaatgtgtatgtgccatcctggagatgatgtctcattctcatggagtgttgcctctaagctggtactttaacggggccatctacaagttattccaatgccttataagtctgtagcttctggatgatgtgacaggtgatacagtcagttgacatcatggtcataggcttggctggtctgactcaatcctggtgaatcaacattccttcaaccttcaaatagtggtaccagaggaggctccatggcaggaaaggtcaacctatgcctgcaacacatgcctattcctcttagaacaaatctctgtcttcccagaatagaaacagcccagtgtagtcaacttgccacaaagccatcagttggtcttcttgtggaatggtgtcatatcaacagatctgcatcgggctcccttgctgaaagttttgacattccacagcagcagtagctaaatcacccttggaagttgtttttctgctcactcatgtggctgctgtcagttgggagctaagctgggatacctcggttctgctccccatggctgttttccccacatggtgtcttgtcctccagggcctccttctacagcaggatagccttgcagaatcggggcaacaggtttggaaagaacaagcccaatgtgcaagcaccgattaagccacacttgcatcatgctctggtgtcctattagccaaagcaagtcacatgaatgagaatgagcttttcctcaaagcataagaaactaggccaaagcaaacaacaaaaggatcttagacagacagacacacacacacacacacacacacacacacacacacacacacagaacttctctttctctccttttatttatttacttgaccacatcatctgctaaaacgttaaaagcaaataagatgcattttccattttgtgattttagaaaaatttacattattacaatagtagtacattcttgcctgtgagtgtaggtgattgattgtatgcaatgcagttctgctcagagcatgaaagaggctgcagggaattacaaaagcaatttcatttacaatagtatcaaaaagaataaaatacttggaaataaacttaaccaagaagacaaaagactgtacgctaaaactttaaaacattgctgaaagcacttaaagaagacacaaataaatggaatgacatctgtgctcatgattggaagacttagttttgttaaaatgtcaacactacccaaaacaatcttaatgtaatcatttagcaaatgattatgactatgatttcatatttgttgggggcataagaaaatcatatgcattatgattacattaagcaaacaatgtaatccctattaaaaaatccaattaaaaatttatcctaaaatttatgtggactctcaagggaccctggatagccaaaataagcttgagaaagaaggacaaagctggaggcatcacacttcctgatttcaaaatatattacaagacgagaatcgcttgccaggaagcgcaggttgcagtgagctgagcctagattgtgccactgcactccagcctgggcaacagagcaagactgtctcaaaaaaaattttatgtatgtataaattttatgtatacataaaaatttttatacatacataaaattttttagacagtcatatatggtaacaataatcaaaacagtgtggtactggcataaaaacagacacatagaccaatggaatagaagagaaagcccagaagtaaacccttgcctatatgattgaatgactttttacatgggtgttgagaccattcaatggagaaaggggtcttttcaacaaataatattgggaaaacatgaatgtccacatgcagaagaagaaagtgggacccttaccttacaccgtttgtaacaattaacataaaatagatcaaagacctaaatgtaaggcctaaactataaaatttctagaagaaaacatagagggaaagctttacaatgacattggatttgacaatgatttcttggttgtgttaccaagagcacaagccacaaaaataaaatagataaatgttttgtttgtttgagacagggtcttgctctgtcacccagactggagtgcattgccataattatggctcactgcagccttaacctgccaggcttaagcaatcctctcatctcagcttgtcgaataactgggatcacagatgcatgccaccacacctggctaatttttctgtgttttagtagaggcaaggttttgccatgttgcccaggctggtctcaaactcttaggctcaagcaatccacccacctcaacctcccaaagtgctgggattacgggtgtgagccaccaggcccagccataaaatagataaattatactacattaaacttagaaacttctcggcatcaaaggacacaatcaacagagtgaaaaggcaaccaatggaatggggaaaaaatgtttgcaaatcatacatctgataaggtgttaatatccagaatacataaatagctcctacaactcaacaacaacaaaaacaaaactatctgatttaaaaatgtgcaaaggaggtgcagtggctcaagcttgtagtcccagctactgggaggccaatgtgggaggatcacttgagcccaggagttggagaccagcgtaggcaacacagcaagtgatatagcttggctgtgtccctacccaaatctcatcttaaattgtagttcccataattcccatgtgtcatgagggaaccagtgggaggtaacttaatcatagaggcaggtctttcctgtgctgttcttgtgatagtggatatctcacaagatgtgatggttttataaagggaagttcccctgcacacactttcttgcctgctgccatttaagatgtgactttgctcctcctttgcctccctagcaatgtggaactgtgagtcaattaaacctttcttttatgaattacccagcttcaggtatgtctttatgagcagtgtgagagcagactaatacagcgagactctgactaaaaaaaaaaaaaaaaaagagagcagaggacttgaataaatatttctccaaagaagataaacaaatgaccaataacacatgaaaatatgtttcccatcactaatcactagggaaatgcaaatccaaatcacaatgagacaccacttactgtgtgtgtctccttttgttttcttttttccttgggctgcatctgggtcctggtaatactccttccattgcacaactaattcaatgtttgaactctggaaaggaacacaagtggatataaaaagtttaaaatttgacattgataaaatagttggaaatgtgcatgcagtagcagcagattctggtacactgcctcctgcccctgggcttgcctctaatttcagctgctgctatggtagacagttccatgagagctcagctgcctgcttgcctcaagcctatgctctacaactctgcttttctgccttctccaaatcatgcgagcctccgaagtgcaccatggtgcaccagatgcatggaattaatgcatctggtggcaatcttcccatgatagaggatgagagccaatgacaagtgccccagctcccaaatgctgggaggaattctgtacacttcttagaggtgctggtggaatcagcccctgttgcttagagcagcaacctggagaacggccatatagttaagctccttttactctagaaaaagataacaaaaggttgaaagcaattaccaagcaattgaaatctgagtatgaatgccagagaacctctttggaagtgtacagagaaactctcttttgcattgggaggccagagaaagctgaggaccagggctaagaattaatcatctgagaccaaagaaggtgacactcccaaccatgccagatctgctgtgtcaagttcagggccctgattggggaagaacaggactgtgaaatacaggatgcaaacatctgtgttgatgccctaccccttgaaattctagtttcctctagaccctccaaccccacaaatgtgggctatccctccatagcaagagccagcccacccccggccccattgcttgaagacaatgcagaggcctcttcccttcaagacacttgtgccctccacccaggatgagccccagcttctttcccggatactagtataggtttaaattccagcatcacccagctgaggttgcactgggccttataagggaagaaagggcttaaactcaaagagagctgatgacccagctaacaggtaccaaaagtgtcagggggtatgaataagactggattcttggggtacttggtcaagggggccagaacataaatgtggatgggggagagtctactgactggagagccctggccaaagatataggatttaacccccgagtaaagaccccaggagatggtgtacatttggaactaagatgacatagtgagtttggtgccctccaccccaccccctgcaaacccaaaagaaatgtccacatcctaatccctaaaacctgtgaaggtgaccttatttgggaaaatggtcttttcagaattaaggatcttgagatgagatcatcctggattatatgggtgggccctaaatccagtgacaagtgtttttataggagacacatagatagataatggagaacagggggaagaccatgtgaaggcagaggcagagactgaagtgatatggccacaagccaaggaatgctggaaaccaccagaagctggaaaaggcaaggaaccgattctccccctaaagccctggtgggagtgtggccctgatgacaccttgacctctaggactgtcagagaacagtttctgttgtttttacaccatccagtttgtggtcatttgttacggcagccacagacgctagtacagatggctttcggaccatggaaaaagaggatgcccatgctaggtaatgttaaaatgtcagaagtgccaagtcagacagtggattaagggattgtaagactcagggaggtgtgtatgatcagtgaagtgccatccaagaccagatcacttaccagatatttatgctccacaggaaggctcagagaaaacatcctccaccaagacgtaaagcacccacatcactcggaagctcagtggtggctctactctgccagcctgggcagacagttggaagggttcaacagagctgggcttactgatagcaagtgggatgacaagaccctaaaataggagaactacgtggtggcacataatcctcagaagccaggtggaagccatgaccgcaatcagggaaaagctcagaaaagcagctgagggagcctggaccacagagagctatggagatagttcatagaggaccacatccctagcagcaaaatacacaggcagacaggggtgcttctcaacctgtgtcataggaagaaatccaggatggataatgagcagactaaggatgggtgctcctacaaaagtcaggaccacctgcccagtttctgaatatgcgccagatttcaaaccctgaagcccttgactgggaggagggccaggtatctaacagaaagaccctgtaacaccctggcaaatgggcacagtcatgatttcctgagtccttctgcaaggggacctaagatctcacagaactgttcaccagggaaggggaaatactcaagtatttgaagtattttggaggactgttagaacagggtcagaagtgacattgataccctgagacctgccacagcattgcagctgcccgcactctgcttctgtggggcacatggtgaccaggtgatccatggagtcctgtccatggcatggtggctcacagtggattcagtaagactacaggcccaccggcagtcatggcctcagtccacaaatgtataactggggtaaatattctcagaagttggcatagcctccccattgggtctttggcctgtggggtgagggcattccatggggaaagccaagtagaaatttctgaaattgaccctatccactctgccaagatagcaaacaaaagagatatattgtgtgtacttcatctggggggaggaggggacaatgggaggatggagaagagggcattatgagatgcacacagggagacggagggagatggccaaaattggtgctacccgtaagaatcgaaaacatggtggattggtgctccttgtaacatctacatttatttgttttgagtcagagtttcgctctgtcacccagggtagagtgcagtggcatgatctcggctcacagcaacctccacctcccaggttcaagcgattctcatccctcagcctcccaagtagctgaggctacaggcgtgcaccaccatgcctagctaatttttgtatttttgtagtagagacagtttcaccctgttggccaggctggtctcgaactcctgacctcaggtgatccaactgccttggcctcccaaagtgctaggattacaggcatgagccactgtgccaagccatccatttcattaaccagtctggatcatgaggaatcctggtttgtcttgggatagtagattatgcaactcaaccaagtagcagacccaaattgggccagatacggcacgctggctggaagagatgtgtgcaggctcaagtacatggtatgcagccgttgattttgcatttgattttgattgtgttcttttctatccccatcaggaaatatgatccaaaccagtttacattttcattcattcttattattttgcagttcacaatgcacattcacaattttgtcccagggctaagttaactctcatgtctctgtcatgatacaataaagagatttaaactctggggaccttgtgcagaacatcacaatgatccactacatagtagcctttcctaagggtcactgagtacccgatttactgacatgggatccagagtaacagtgcctaggacattctaaagagaatgaggtgaggcagggggcgcataaccaggggacctgctgatcccgaccatacacttcatcacccaaaaagctactgacctgatgggagttgagatgaacccctgggttgccactatgcctacagcttggggatgacaccccacagggccaggcactgtccttcaacatgtggaatgtactttgccctttatatggttccaaagtatttcagtgatactgaatcagaaacacggggctagtatcttcctctgtttccagtttgtagcttttgatgttgatctgaaatgaccgcccagcaggaaagttaaatgaagagctagtacattacatgcaacacaaatcattgtaattcacaagttaacctgcagatggtgccatattattgctgtctctttgttgatctttttaaaaaattacctccctgacccctgtgggtccatatctggttgtgacaaactcatgaggaaagaccacagtcactgagtcccaaaacatttggagttgaatttttactaacactgtctgatgtgcaaccttccttcaagaaaaaaaaaagagatgctcaggacaaatagctaatgcatgtggggcttaaaacctagatggcgggtcgatagttgcagcaaaacaccatggcgcacatatacctatgtagcaaacctgcacgttctgtacatgtaccccggaacttaaagttaaaaaatggaaaataaagcttaaaaaaaattgctatctagcccttcacagaaaaaggctgactcctgctttaggagaaagcacaaaaaaggaggtaaaaataaacagtgcaatcagacttctgttggaccctgagagtttaattatggaaggtgaagggggaaaaaaacagaagaggaaaagagagctaagtggaaaaagtctttgaaaatttagtagggccaggtgcggtggctcacgcctgtgatcccagcactttgggaggctgaggcgggtagatcacctgaggccaggagttcgagaccagcctggccgacatggtgaaaccctgcctctactaaaaataaaaaaattagccggctgtggtggtgtgtgcctgtagtcccagctactcaggaggctgaggcaggagaatctcttgaacctgggaggtggaggttgcagtgagccaagatcatctggccactgcactccagcctgggcgacagagcgagattccgtctcaacaacaacaaaaatctgaaatccaaaatgctccaaaatctgaactttttgagcaccaacacgatgccacaagtagaatattccacatgtgagaaccctaatacaaactgtttcatcacagatttaaaatgttatataaaattaccctcaggctatgtgtataaggtacatatgaaaagctaagaccaatttttgtgtttagaattgggtcccattccccatgatatcttactatgtatttgcaaatatttaaaaatttgaaaaaatctgaaattcaaaacacttttggttccaaccatttcagataagggatacttaacctgtagtacaaaaatgcactttataaatttttttcttcaatttttaagttcaagggtacacgtgtaggaggtgcaggttacctaggtagacgaatgccatggtggtttgctacacagatcatcccatcacctaggtattaagcccagcatccattaaccattcttcctgatgttccccctccccctacacccgataggtgcccattgtgtgttactttcccccatgtgtccatgtgttctcatcaatcagctcccacttaaaagtgagaacacgcagtgtttgattttctgtttctgtgttggtttgctgaggataatggcttccaactccatccatgtccctgcagaggacatgatctcattcctttttatggctgcatactattccatagtgtacatgcaccatatttttcagtctattattgatgggtctatcagtctatcatttgggttgattccatgtctttgctattgtgaatagtgctgtaatgaacacacatgcatatgtatctttataatagaatgattcatattcctttgggtatatacccagtaatgggattgctgggtcaaatggtatttctgcctctagctctttgaggaattgccacaccgtcttccacagtggttgaactaatttacactcccaccaacagtgtcaaagcatttctttttctctgcaacctcgccagcgtctgttgttttttgactttttaacaatagccactctgactgagaggagatggtatctcattgtggttttgatttgcatttctttaacaatagtgatgttgagcttcctttcatgtttcttggcccgatgtacgtcttcttttgagaagtgtactttacagattgaagactctctaaacttgaaaacttttcatttaaaaatttttatactttttttttttaagacagggagtctcactctctcgcccaggctggagtgcagtggctcgatctggactcactgcaagctccacctcctaagttcacgccattctcctgcctcagcctccccagtagctgggactacaggtgcctgctgccacgcccagctaattttttgtatttttagtatagacaggtttcaccgtattagccagaacggtctccatctcctgacctcgtgatctgcccacctcggcctcccaaagtgctgggattacaggcatgagccaccacgcccagccaaagttttttatagtttttataagtgaccccacttccaccaaccctctcttttggacgctggaatcagctttggagatttgtgtttgcacccagacttcattccttactagcttggcgccctgcactagaaacctccatctctattctgtaaaagtgaagcaataatgccaatctaattgatggaatgaggaataagctaatccattcaggcagtttacttagcaattgtaggaaattaaagctttttctctcctcttgtctcctttacactaaaacagggtggactgggcacaatttaacccctcctgaataacacggatgtttttgagatgagtaactattgcttttttttttcccctgaggtgtggaaaagcagagaagcagagaagtagagaagcttcagaaattgctttgtgaagttgaatgtggatgtaaataggcagcagttgctgcctcctcctttcccaaggctcagctcccatttctagtagtttaatttagaatccaagaaaccctggacctgtgccttccctctaaatgacaaggagtaatagaagatgaggataacaaggtaaaggtagcttacctttgcaattccagcacttttgagaagcacaaaaattacttgagagccatgacttcaaaaccaacccggggaacagaataacacctgctcactcccaaaaacgtaaaatgtagcctgacagagcgtccagacttggtgcgttcgtctcacagacttcactcagcagatctttgtggtgagtgttacagcttttaagaatatgtatgtggagatttctattcccctctcccgacttacttattctttgttaagtttaatgacctgcctggcctacagacataaacctacgaaccttcataataagcactacaaaacaaagaaaatacaaacctaaactgcaacaaaaatctattgcaaaaaacaaacacttccacaccacacaaaaagtactgcagctggttaccagtactggctcccgcagcctgctattatactcttatctggccccacccacatcctgctgataggtccattttacagaaagctgattggtctgttttacagagagctgattggtctgttttacagagagctgattggtctgtttcacagagagctgatttgtccattttgacagggtgctgtttggtgcatgtacaatccctgagctagacacatagtgctgattggtgtatttgcaatcctctagctagacataaaagttctccaagtcctccccagattaactagacacagagcactgattggtgcgcttacaaaccttgagctagacacagggtgctgattggtgcatttacaacctttagctagacacaaaagttctccaagttcccactagatgagctaaacacagagcgctgattggtgcatttacaaaccttgagctaggtacagggtgctgatgggtgtgtttacaaacttgagctagacaccgagcgctgattagtgcatttataatcgtttagctagacagaaaagttctccaaatctccaccagattagctagatacagagtgctgattggtgcacccatgaaccccaaggtagacagagtgctgattggcacatatacaatcctccggctagacataaaagttctccgagtcccaactctactgaggaagccagctggcttcacctagtgaatccaccatcagggccgtgggcggagctgccctccagtccggcggtgtgcgcccacactcctcagcccttgggcagttaatgagaccgggtgccggcggaggaggggggcgcccgttaggggaggcttgggccgcctgggagtccactgcgggggactcgggcgtggcgggctgcaggtcccaagccctgccccgcgggaggtggctgaagcccggagagaattcgagcgcggcgagagcgggccagcggtgctgggggacccggcgccccctctgcagctgctggcctgggtgctaaacccctcactgcctggggccggcagcgctgacggcccctcccagtgcggaacccgcgcccgctgggaactcgcactggcccgcgagcgccgtgagcagccccggttcccgcccagcgcctctctctccacatctcgcaagccacacctcctggcaaacacagggagcaggctcaggcctcagccagcccagggaggggctcctacagtgcagcggcaggctgaagggctcctcaatcttggccagagcggacaccaaggccgagcaggtgctgagagcgagccagggctgctagcacgttgtcacctctcagcatggtggcacgcacctgtggtctcagctatttggaaggatcacttgagcccaggaattagaggttgcagtgagctgggatggcaccactgcaccgcagcttgggtgtcagagcagcaagactctgtctctgaaaaaagataaaaataaaagagacagatgaattgtgcccaatggccctagatgtagggcctccactataccacatatgggatgggggcgtgagtcacagaatagcatcctttctggagtgtcctggcggagacacatgttctcatagtgtagcagcagagttacctattcctcacttccagcttttgatggttttgctatttttcatgtctgtttttctaatggttctagcacagctcttactaagtcaagttgagaagctggccgagtggcttccatcccttcgccctttctccccacctggcagctccgtggggcagtcaggggcatgggcctgggagctgccctggctgacgtgaaaacaggctccttccagtgtgaaatggggccagtaatccttgccgcccctgctcttaggagggttgtgtgcagtggctgttccctccaggttttccaaagtgcccacggagagtgaaacggtgaatgaatgaatctaagccaaggcatcatgtaggagtcagtggctcacaataatttgtggtgaggtgtgcctgaagatacaaaatgtgtcattaaaacacacacaggggcaccgtggctcacatctataatcccagcactttggtaggccgaggtgggcagattaccttaggtcaggagttcgagaccagcctggccaacatagtgaaaccccatctctactaaaaatacaaaaattaggcgtggtggcacatgcctgtaattccagctacttttgttgggtgggggggcggcgctgaggcaggagaattgcttgaacccaggaggcggaggttgcagtgagccgagattgtgcattccaggcattctagcccgggtgacagagtgagactcgatctcaaaacaaaaaacaaaaaaaaaactagctccaccaattttaatggcttactaattttaatgctcttgagaaaaaccacgtctgggttggttccctcctttacaaaatggagataacagttttgttttttttttaagaaggggttcttgctctgtcacccaggctataggccagtggcataatcatagctcactgcagcctataactcctggcctcaagtgatcctcccacctcagcctcccaaagcattgggttacaggcataagccactatgtccggccgatattatctatttttttaattaaaatttttatttggggataactgtagatccaattgtaaaaagtactacagagagattccatgtaccctttacccagcttcccgcagtaaagtttgcaaaactatcatacaatattgcatctagtatattaaaatgtacataaactaccaattttattcagtttcactgttactcatgtgtattttgttctaaataactatatcgcatgtgtaggtttgtgtatttacttccccagccatgaccacaaagaactctgacctctcctgttgtccttttacagccacacctacctgtcttcatcatgacccccctcaatgcctggcagccacaaatctgttcacttccaaaactttgtattatcaataatgttatatacatagaatcatgtaggcgtgtgtgggatttttttccactctgcatacttccttggagcttcatccaagttgttgcatttattgtgaatttgttccttttgattgctaagtgatagtttgtagtttggatgtacacagtttaactattcattaaaggacatttggactgtctccaaattttgggctattatgaacaagactcctatgaacattcttatatgggtttttatgttaatgtacattgtaatttctctgggataaatacctaagagtacaattgctaggttaatatctatttttataggtcttggcgagcaataaattgaatgagatcgtgtatgtaaaatcactcatctgactttttttttcattcctcaaccttcttcctttccttccttttgatgacgttttggtcataggtttgtgctaggatgaaagtcttgtttaaaaagaaaaaatgagaggatggacttctttttggaaaagatgtaatgaacagatgccgttgagacctgttaggattttctgtccttaagtttctttccacagattttcagagcttgagtcactttataatttcagagaacacatcttcgtcacctgctgtggcgtagtgactttaatctagatgatcttgctggcagctgtgctggatgaacaagtgtcttctgttttataggcagcatcgtcacaaacactgtcaggtcaggaaaagaaaaagaaacacacaccacagcactttattccaggcagattgaaaaatctgcgtctgctttcctgaccctaacttttttatttttttttggaatctcactctgtcgccctggctggagcgcaatggcacaatctcggctcactgcaacctccgcctcctgggttcaagcgattctcctgtctcagcctcccaagtagctgggattacaggcacccaccaccacgcctggctaattttttgtatttttagtagagatggggtttcaccatgttggccggactggtcttgaactcctgacctcaaatgatccccccacctcggcctcccaaagtgctgggattataggcatgagccactgtgcctggcaccttaactttcttattgggcgtaaagggtaattttacatgtcaacgactcggcgggccatggagtgcccagatatttggtcaaacattattctgggtgtgtttgtgggggtgtttctgggtgagattcaccttcgaattggtaaactgagtaaagcagattatcttcctaatgtggatggatctcatccaatcaactgaagacctgaacaggtaaaaaagaggctaagagagaattttgcccctcccagctactgatcttggacatcaactgtctgagttgccctgttgcccagactggaatgcagcggtgtaatcagagctcacctgggatcaagtgatcctcccacctcagtctcctgaatagctgcaccacaggcatgccaccatgcctggatagtttaaaactttttgtaggccagctgcggtggctcatgcctgtaaccccagcactttagaaggctgaggcaggcggattgaggtcaggagttcgagaccagcctcaccaacatggtgaaaccctatctctactaaaaatacaaaagttaggcatggtgcctcctacctgtaatcccagctgctagcagaggctgaggcaggagaatcacttgaacccagcaagcagaggttgcagtgagttgagatcatacgcagtccaacttgggaaccaagaccaaaaactccaaaaaaaaaaaaaaccaacacaaccacacacacacacagaaaagacacactccagggacagggactcagactttccaaatagtcttcacaaacttatgcttttccagggctgctggtgtgtccagaattggtcagtgcccggtttcaccgacttcaaaaatgaaaccatgggcccttaacagtgagtattaaatttcttataagcggcatgtctggagcttgctccttctaatgttccaatgtgttcagtttttttccttttggtggattatgtagtcttccttgctcagaagtgaggctactaactttcacagtgaatgttatagctcgtaaaactggcacgtctggagttacgtctcagtgaatttgtgggctcactggcttcagaagtgaagccacagaccttcataatgagtgctacaattcacaaaagcagcacagacctaaagaccaagcagaaacaaaacgagggaggaggaggagaaaaagcttccacacagcaaaagtaggttacagcttattactactggaagctcaaggcagcctgcttttattctctcatctggccccactcacatcctgctgattggtccattttacagagagctgattggtctgttttgacagggtgctgattggtgcgtttacaatccctgagctagacacaaaaattctccatgtccccgctagattacctagatacagagtgttgactgatgtatttacaaatcgtgagctagtcacagagtgccgattggtgtattcacaatcccttagctagacataaagattctccaagtccccaacagattaactagatacagagtgccgattggtgcattcacaaaccctgagctagacacagggtgctgattggtgtgtttacaaaccttgagctagagacagtgctgattggtgtatttacaatcccttagctagacataaaggtactccatagtcccacaccagactcaggacccaagctggcttcacccagtggatcctgcactagggccgcaagcggagctgcctgctggtcccgcgctgtgcgcctgcacttctgcactcctcagcccttgggcagtcgtatgggatctgggcgctctggagcacggagtggtgctcatcggggaggcttgggctgttggggaggctcaggctcggcgggctgcaagtccggagccctgccccgcggggaggcagctaaggcccggcgagaaatacgagcacagcagctcctggtctaggtgctaagcccctcactgccccggacttgcgagccggcggccgctccgagtgcggagcccgctgagcccacaacccgcccggaactcgcgctggcccgcaagcgctgcacgcagccccggttcccgcccggcttgtctctccacacctccccgcaagttgagggagccggctccggccttggctagcccagtaaggggctcccacggtgcagtggtgggctgaagtgcttctcaagcgctgccagagtgggcgcccaggcccaggaggcgctcagagcgagccagggctgagggctgtcagcacgctgtcacctctcactggtacagcccccttatctccaggctttttcccttctcacccgtttcgcgtgccttttaagatgcgggatttttcttctacctgacttcagacttggtgacctctttgttaatccaagtccttgatctcaggaaacccccaagatctccattcactctactcatcccaggcttaggtacctgacccctcagtgccagctgtgtgactgtttcctgaatcctacttccagtctgtggtctcatgttgcttctaccgtgctttaaaggactgccaatgtgtgaagctttttgtatttgatgtgttaatgaggttgtgagttttattctttgctcagccaaatgaatttgtaaagagaattatgtattagagaatttgtaaagaggattatacacatatatatatgaaatacacatatatataatccatgtatatatacatatgatccataaataatctgtatatatatgtttaatgagtaacaactatctattgatgaaaatggtggaagttatgtaagatgacttgtaaggagcatcccttccctgggagaaatcagcactgaatgtctcctgggaggtagcacattttgatgctgctgctgatgatgatgatgatggagaagaggaagataagcatctccattgctttttatgtgctaggtacatagtctcatttgctctcacgttaatccaggaaactaggcactgttttggtccctgtattagctagcttgggctgccataacaaaataccacagactgcatggcttaaacaacagaaatttattttctcatagtctggagctggaagtccaagatcaagttaccagcagggttagttcctggtgaaggctctcttcctagcctgcagacggccatcttctccctgtgtccccacatgacctttcctctgtgacatgctcctggtgtctcttcctcttcttagaaaaacaccagtcctattggattagggccatgcccttataacctcattttaccttaattacctctttacagaccctatctccaagtacagtaacagtctgagttactgggagttgggacttcaacagatgaaatttgggaggacacagttcagtccgtaacagtccatctcttaggaatgatgaaactagactgagatgagatatacaccttgcctaagatgatagtaaagaccaaagaacaggaatttgaagccaaatttgctctcatggcctcttagccaccagaccaccctgccacaggcatcagaacagagcagctccacaaagtgggcaggaatagcacacgctacctgccactgccattctgactggggaagaaggagtgcttcctggcttctctggacctgagctctcacagtccagccttacgctcttgagataggagctctgagcttttgaaatagtccttgcaaacccatgctttgctagtgcaggaaagatgctgtttgctgatgtcttaatgaaacacaacctaagcattgattactgtttacgtgcggacatgtgtcaggaagaaaaggcattaaaactcttgtgggggaagcctgtccaaggtggaaatgagcccaagattcccagtattaatctgatgccccaggtgtttgtcaactttagtttatctggagagtggaacatttgtgttggtgtttctatccaaatctttccaggcccaaaggctcaacattttttttttgtggagacttccccaatctctggggttctcaactgctcttgagttcttttaaaggaggggtccccaatccctgggccacaggcaggtaccagtctgtggcttgttaggaaccaggtacacagcgggaggtgagtggcaggtttgcgagcattaccacctaagctccaccgcctgtcagatcagtggtggtattagattctcacaggagcattaaccctattttgaactgcacatgcaaggggtctaggttgcacatgccttatgaaaacataatgcctgatcatctgcggtggaacagttttatcccaaaaccatccctgccctcatccatcctcatctgtggaagtcccaactcccagtaactcatccatggaatgtcttccacgaaaaccagtccctggtgccaaaaaggctgaggaccactacttttaagaccctctgtccaggccccaccttcagatgctgaccacccagtgccttagacttcatttgttcatctgtgttaaattgaaggctttttttttttttaaacgaggggctctgggcttgcaatgtgttcttgtgaaatgaatgaatgaatgaacaaatggctttagaaatcagacaattatatttccctaaagtttttgaaagattccataaaataaaaagactatttggaagcacaaaaccagggaaaattgccttggtttctcattacctactggcaggggttgctcagagctgagcggtatagaatagacagacctggatttactatgctttatcttacctgatattcaaaactatcttacaagtggaatactagtaacatctcgccaccccccaacccttttttttttttttttggagacagagtgtagctctgttacctaggctggagtgcagtggcgcaatctcggctcactgaaacctctgcctcctgggttcaagagattctcctgcctcagcctcccgagtagctgggaccagaggcacgtgccaccacacccggccaatttttgtatttttagtagagacggggtttcaccatgttggccacgctagtttcaaactcctgacctcaggtgaaccacccgcctcagcctctcaaagtgttgggattacaggcgtgagccaccgcacccagccagcatctcccttcaatggataaggaaatcagagcttccagaagttaagtgaggtttgcggacactttattgttgggcacaaactcaacaagtctgactctagtgtaactggtaactcccatgccaacatggaattcagagcctctagtggtgggatttcttgcaggccctgtcatccctgggctgaggttcttgtggaaggtcaaggtggctgggtggaacttggcagtgtggtcaatcaacagcgcatgggcattgaaattaggatacttagattcaaaacagatctctcactttctgatttagggcaagttacttgacttcacctgcctccattttctcaattgtaacgtggaaccgagaaatgacaatgtgccagcagccctccctcgctatcggcgcctactctggccgtgcttgaggagcccttcagcctaccgctgcgctgtgggaaccgctctctggggttggcccaggctgaagccagctcctttgctcgcagggagtgtggagggagagccgcgggcgggagccggggctgcgcgcggcgctcgtggccggcgcgcggtctcggcagtcgccgaacttcactgtcaactgacgtctgctgggcttgactagggaaaaagctccctctgggctgccagagtgcccgaattgggtgctgcaaagtgccccagcgcctgccggtaagaggtgaaaccggctgggtttctgggaggggtgcgaacttggagaacttttgtgtctagctaaaggattgtaaactcaccaatcagcattctctgtgtctagctaaaggtttgtaaaagtaccaatcaacactctgtgtctcgctaatcttgtggggacttggagaacttttgtgtctagctaaaggattgtaaacgcaccagtgagcactctgtgtctagctaaaggtttgtaaacacaccaatcagcaccctgtcaaaaatggaccaatcagcattctgtaaaatggaccaatcagcactctgtaaaatggaccaatcagttctctgtaaaatggaccaatcagcaggatgtgggtggggtcagataagggaataaaagcaggctgcctgaatcaataaggataactggtttacgtctgttctttgtgttgctatagacttgttgtttgggtttgtgttatctttttgatctgcaggactaatagtaaaagtctgtagcttcagttatagactaagattactactctgccagaagtagtgaataaagaatcaactgggtgggatgaatcacggtaggtgttctatgcttaagagctgggaggtttaccatctctgtctgtagctttggtcgttaaagcagcgggattctgaaaaaaagctgtagcactcagtgggaaagtaggtagcttcagtttttaagttagtgagattaggaaggtgtgtaatgctcccagtccactcaatgtgaagatctgtaatgtcattcctgaagtcagtaagagcacgaacccactatagagaagaaacaaaagaggcaaacccaccagagagaagaaactttgagcacatctgaacagaagaaataaactggggtcacatgtttaacaattgtaattctgtgagggtccacagcttcatgcttgaagtcagactgagaacccactaattccacacgcagttgtgaaaactatagaggattttttttttcttttgacagtttcacttgtgctgcccaggctggagtgcagtggcactatcttggcacactgtggcttatgtcacgggttcaagcgattctgctgtctcagcctcccaagtatggattacaggtatgtgctactaggcccagccaaattatttactgatcatttttggttttgttgcccaggctggagtgcagtggtgtcctctgtgtactgcaatctttgcctcccggggtcaagtggcttgcctctctcggcctcctgagtagctgggactgtaggcacccactaccacacttggctaatttttttgtatttttagtagagatgagatttctcaacattggccaggatgttgttgatctcctgaccttgtgatctgcccacctcagtctcccagagtgctgggattacaggagtgacacactctgcctggcctatttttctatttttaataaagattttcaccacgttggccaggctggtctcgatctgacctcaggtgatctgcctgccttggcctccgaaagtgctggggttacaggtatgagccattgtgcctggtaaataagtttatgtaccagtgctgcatccatgtcatgtgagctggtgtcttcacctccatataaatatgtttacatgcttttggaaagaatgaaaatctgtggatgacgactaaaaatgaggaacggcggaaaaaaagtcctgaagtttaaatggacccgttttctctagtggtgcttgaaacgaactggttacgggggtcaaaaacatgattcatcgcaccagggtggtctttggtagctctgagtggccaccgtgagttcagtcttagtcttgaatgcaatagataatccttatcaattccaatgagccagttaaacggatttcatggaactctgcaatggattactaaaatgttcacggcggggcgccgtggctgaagcgtgtaatcccagcgctttgggagactgaggcaggcagataatctgaggtcaagaattcaagaccagcctgggcaacatggtgaaactgtactaaaaatacagaagttagccaggcatggtgatgcacacctataatccaagctacttgggtggctgaggcaggagaattgcttgaacccaggaggggggaggcggaggttgcagtcagctgagatcatgccattgcactccagcctgggagacagagcgagactccgtctctctctctcacacacacacaagttcacattgatcccggagcattaggaccttggtttcctactgctgtgtggatggatgagacctcagctggcatctgagaaccctggggaggggaaagaatcaaaaccagatatacctgcacccaactcccagggcctcaccttctcaaaacatcaaccactgtcgccttatagtgcaaaaagcattgttgagtgaagtgcatgcacaagtttgatcgtgccccaagtgcaaacttgccttgagaaaaatgtcatttccacgtccccctcttaaacattaagagaccgtctcctacctcttaggtctgggcagcctaccccagaatcttggctctccctctctgcccgaatcgaaatcagagatttgaaaaagtctggcaaaaggtttttgaaaggtcaccaggccatttctttgctacctttagtggtggtagcatttatcttaccatagacgtcaagtcaaaaaaaagttccgcagacatttgcgtcagtaaagcaaagagactgggcctggctccgcgggactcagtggtgcccgctggccctgccagctctgctgagtctgtgaggactggaaggctttggagctgctgcgccgactccgacgtggaaaaagcatgtagtcggggcagcgcctgtttccacaaggaacgcaaaaaggtggcgtcaaggattacggtcccccttgcagtaaagtaactgggcaggaaggcgacaaaggtactgcggctccgaaccacagtgggtaacaagggaaacctgctcagacctgtgtgtgcatcgccaatgtcggattttggtttggttttgtttttttacttttaaaaagatataaagtctttggttctttgcatgaaaacattagtagtgggatgggaaatttatttggatgaagttcagtagttactcaagtgatagtcgctcttcctgggaggatcttagtgatcattaaggtccgggccacccttaataagtgcctgttaacagcagcagtcattgatttttgaaagtgtgtggtcggcagcagaaagcctggtacagccttgcttctaccgttttctcggttgttttggaatcgcctttgcaaaagccatgcacggctatagttctgtgatagcacccagggctcatggtctctctctgctgtgtaccaaatgcgtcgaactagcgctgaggacttcttgcaggggatgtctgtttaacagcggtcatttctgcttccctggcggtgaaagcaggaaacacctggaatccttagattctgaaaacttcatgttactctctggaatatgtgcgtgcatgtgtgtgtgtgcatgcgtgtgcatgcgtgcgtgcatgtgtataagtatgatctgctctagtgcattctctcaagtgatttttttaaactgtatgatttattgcctactttgtaaatgcaacaggcttacacagcagttggtccataacctgcccccaagcacacagccctcatgaccctacactggccaaattcacccttttttttttttttttttttgagacagagtctcgctcttgtcacccaggctggagtgcagtggtgtgatttcggctcactgcaacctccgcctcccaggttcaaccaattctcgtgcctcagcctcccaaatagctgggattacaggtgcctgccaccatgcctggctaatttttgtatttttagttgagacgaggtttcaccatgttggccaggctgctctcgaactcctgatctcaagtgatctgcccaccttggccttcccaagtgctgggattacagggtgagccactgcacccagccccaaaattgctcttatttggatcgggaaagtctgtctactgttctctgaggggcaactaactattagtattcattaccatacagtaatgttgtttgtgaaacaaaaccaaacaaatttttaaaaagcaaaataaaagctctgtgaagttataatgtgaggctggtaggattttacgggaaaggtgtagtattctggaaaattctgagattgcaccactaatgcctggctaaggaaggagtttgctgagagaaaactctttaagttgtgtccgtctgtcaattcatccattcatccatctagctatcacctcagctcctctgagttcagaatcttgctgaagttcatacagttaacactcaggaaccaggactctgctcttctcaccagtggggcagcccaattagcagacttttggccctgtatcccaaatttttctggagtgttattgaatcagattatgaagagatgccacaattaaggaacattgacccttattttctgtgtaaggtcaattttctacttggagggaggttaatgcttaagctcctctaacaaagtattaaacataacccagctggtgctctgtggactcagggcttgtgctggagacctggctgcagggccacaggctccatagcgatacaagggtggtctgaaaggcaggctgtgcccaccacgcccctaaatatctcttcctaagcaaaaacggaccacgctctgcttttgcctgagtaagggctgctgattaggtttttttaaaaaaaatttattttggaatttttttaaatgtacaagaaatttgcaaaggtagtaccgaatccctatatacccattgtccaattttagttgctgctaatattatcaactcatattacatttgtggtacatttgtcaaaactaagaaattagcactgatgcattatactaactcaaccccagactttattctgatttcactagtttttccattcaggttgctttttgttccaggatccagcccatattacacgttgtgtttggttgttgtacctccttagtcttttctgctctatgacagtttctgtcttaccttgtttttcgtgaccttgacagtttggaggaatactagccaggtattttttcaaatggtcctcaatttgggtttgttcgatgcatttttctcatgcttagactgcagttgtgagttctggggggaaagaataccacagagttgtaaaacgcccttctcatcatgccaaatcgggggtacagtagacacaggatgtcgctgaggggttatctttgatccctcggtcaagataatgttttccaggcttctccacagtaaagtgaccccttttctctttccataccccattctttggatgtgagttatgaaatcagtgtaccctcaggggtggggggattaaactctaccacctgggggaaaagtgttagattgttttttgagaactggggatcacctggctccatcctcccctgtttataatttgccatttcattgtattgtgagggagaatgtgtccatcctttcatagctaacttagcagttaaattttgtcctgggcactgtggatgtaggacgtagaggtgaacaggaaatagaccagtggaaaagacgtggagggcaaggccgatgtaataaagtttaaatacagctcatgcataaaatcacagtgggacctggtttggatttaagctttttcatctaaaaacttgggataataatagcttcctcttgagtaattgtgagaattaagttggacagtgaatgcggaaggactaaacatagtgtttgatatgtagtagctgctcaataaatgttagttgtcttccttcaagaagaaaatgatggacccaggccgggcacagtggttcacggctgtgatcccagcactctgggaggccgagacgggcagatcacgaggtcaggagttcgagactagcctggccaacatggtgaaacctcgtctctactaaaaatacaaaaataattggacgtggtggtgggcacctgtaatcccagcactcgggaggctgaggcaggagaatcatttgaacccggtggcagagtttgcagtaagcctagattgcaccattgtactccagcctgggtgacagtgcgaaactacatcttgaaaaaaaaaaaaaaagaaaaaaataacatgatggacctttgctgctaacagcatggattctggcaccaaactgcctgcttttgagacgtggttctatggcttcaagcctgtgtgaccttgggagagttaatcaacttctcagtgcctcatatttttcttgggtaaaaggaggataataatagtatccctctcatagggttgctgtgagtatgattcattgtatgtaaagagcacagaacagcgcatggcacattgtgtgttacaagtgtttgcaaatattccatatcattccattcattcatatcttaggcagtacaatatgcattaatttggtatttaaccattctattgaattcaatagattagaattcagttattcaatagattagatttttatttatttatttttcatcttttatttattttttgagacggagtctcaccctgtcgcccaggctggagtgcagtggcttgatctcggctcactgcaagctccacctcccgggttcacaccattctcctgcttcagcctcccaagtagctgggactacaggtgcctgccaccatgcccggctaattttttgtatttttagtagagatggggtttcactgtgttagccaggatggtctcgatctcctgatctcatgagccacctgccttggcctcccaaagtgctgggattataggtgtgagccactgcgcccagctagattttaatttactaatgtaataaccattctatagaattttatttatttattgagacatagtcttgctctgttgcccaggctggagtgcagtggcacaatctcggctcactgcaacctccacctcctgggttcaagcgagtcccctgccttggcctccccagtagctgggtttacaggtgtgcaccaccatgtctagctaatttttttgcatttttagtagagacggggtttcatcatgttggccaggctggtctccaattgctgacctcaggtgatccgcctgcctcgaaccccccaaagtgctgagattacaggcataagccacggcacccagccccattctatagaatttaatggatatagattactataccaatttaattttttctttctcccatattccacccaacctagcaacactgagatataattgagataaacttcacatacatgtacaattgatgagttttaacttattaaaatatctgtgaaatcatcacttcagtaaaacacagaacatattcatcagccccaaaaggtttccccgggtccctttgagatgtctcccttccagataactgctgattgactttctgtcgctatagaaagtttgcacttttagtttgcattttctagatttctatattaatgaaatcttatagcaggaactttgttttctggtatggcttctttcagcattaatattttgaggtttgtccatgttgttgcacgtattaatagtttactccttttattactgggaagtattcccttgtatgactataccatactttttttaatccattcacctgctgatagacattagtattacttccactttttttttatttgtttgagatggagtgttgctctgtcacccaggctggagtgcagtggcgcgatctcagctcactacagcctctgcctccgagtagttggtattaaaggcgcacgccaccatgcatggctaatatttgtatttttagtagagatgaggtttcaccatgttgacaggctggtctcgaactcctgatcttgtgatctgcccatccagcctcaaaaagtcctgggattaccggcatgagcccctgtgccaggctttttttttttttttttttttaaataaagatgtcataaacagctatatacaagagtatataccaacatatgatttgaattccctggaataaatatagttgatccttatttgcgggttatgtgttttaaattcacctactcattaacatgtttgtgtaaccccaaaagtattaaccttacaagtagtattcatggtcacttgcccatatgtgcagagctgccaaaagtctaagttcccaggcttgcacattcccagctaaggttgaacaagatgactctactttcttgtttcagctcatacacagaggtgactagaaaatagagacggggccaggcatggtggctcatgcctgtaatcccagcactttgggaggccgaagcaggtggatcacgtgaggtcaggagttcgagaccagcctggccaacatggtgaaaccccatctctactaaaatacaaaaaattagccaggcgtggtggaggcgcctgtaatcccagcaacccagggggctgagggaggagaatcgcttgaacctggaaagtggaggttgcagtgagctgagattgagcatgccactgcactccagcctgggcgacagagcaagactctatctcaaaaaaaaaaaaaaaagagaaacgggagggaacattatacattatagggcaaaaagttgcagctgtggggccagctggacagatctgaatctcacctccggcgcctgtagatcccggagcattaggaccttggatgtttttaaaagaatattctctgatcacacggaattaagttggaaatcagtagcagaaaacgccccttggtggagtatctcaggcaagactcttaacactttggaacatagttttctcttttataaaataaaagaaaatcaatcaggatgagttgtcttggagatttaagattataatccatgttagatatatatcctctagcgacaatatttcagagttagctaattcagtttgtggcaactttatagaaataactacctcgaataatgagaagcaattgtacctagaggggatggataggtcttacgacgggtatatttaagagtttaggaaactactgaactattgtccaaagtgtttgtgtgattttacatttccagcaggataggaaatttccagttgattcacatctcaccaacacacggtatggccaatctctttaattttcgctattttagtgggattataacaatatttccttgtgattttaattagcactaagcttgcaatgaataatgattttgaatatcttctcaggtatttatttaccttctgtgtgtcttctttaataatctgttcaaatcttttcctcattatttaaaaaatcaactttattggtctttatttttaagaacatgcttctcacatatttacctatgtaacaaacctgcacatcctgcacatgtaccccagaacttaaaagttgaagaaaaaaaattttaatcttaaaaaaaaaaaacatgcttctgccttcattgatttttttttccccatttttttcctgtttttcagtttattgatttttgttcctatctttagtatttctttgattctgcatggtttgggtttaatatagcctcttgctttattttgttagagaggaaactgaagtcattgatgagagaactttcttcttttttaatgtaggtatttcatgctgtaaatttttctctgcattgcgttagctgaatcccacaaattttgatacatcatgttttcattttcattaagcacaaagtcctttctaatttcccttttagtgtctcttttggactacgaattatttagaagtatggtctgaaattccaaatatttgggcattttccagatatcttcctgttaccgatttccaacttaattccacgtgatcagagaacatcctttaaaaaaaaaaaagaaaaggtacttttttggctcatggttctgcaggctgtacaagaagcatggcactggcttctgcttggctgctggtaagggctcttgtgctacgtcaaaacatggcagagaaggtcaaaggggaagtgggcacatgagaagcaacgttccttataggacctgaaccctggtgtatttatcaagacttgctttatggcccagaagatgatctatttggtaaatgtgtacatgaaaataatgtgtattctttgttgttgttgttgttttgagacggactcttgttctgtcacccaggctggagtacagtggtgtgatcgcagctcactgcaacctctgcctcctgggttccagcaattcttctgcctcggcctcccaagtagctgggactacaggcatgagccaccacgcctggctatttttgtatttttagtagaaacagggcttcaccttgttggccaggctggtcttgaactcctgacctcaagtgatccacccgcctcggcctcccaaagtgctgggattacaggcacgagccaccacgcccggccaagaatgtatattctcatattgttgggtgaagggctctttctatgtcaaataggtcgaccttctatatccttcgtggttttgtggcagctgttcatctagtttgactgtgctgaggcaatccccttctaagtatactacctaatgacttagaattacaaggtttttctactccagctggaaggaacacaaacaattgttagccccgtgtaagctttgctgtttcttttctctaatcctcgggtcattctttccttggcattgggtcatttctttgcatatttcctgatcggtcgttagctaaagacttgagggagaccctcttgcatgtgtctggagttctctctctggactatctccttcacagtaactccaccctaggaacctcagcagtcttgacctcctcaaactctcaaatctgtctgctccattcaaggagatggccaggctccccctggactcctctgcctgccctgtggcagaataactctgtactcagtaagctggggcaatcgcggggctcatatcattagtttcccctctttcggagttcactgtcccgtgctgtgtgatgtcctatgtttgcaaactgttggctatagtaacgatgaaatatgcgtcctgattactgaattgctatctaattaagctttcattttggtttaacaacttacttgacttattcccgataatgtatacgctagaatgttccttgattctgaacttaaacaccagtggcatgaaagaagaaggctactgagaattgtaaaccttcatccttggccctgctcttgctgattcagtatcctgcagagctgagcttccttcggctttttcactcctgtgtcaggctctcctaccgtgctctcttctgaggttcacattcaccattattggattcttcttgttgctgttattgtatctttattttctaattgttataaaaatttgtccctgaaccccaatttggtgcaacttattgttcccaggtttgtttgtttttctccctggcctgaacctcatccacttctttgcatttcttttggcatatgtgtcttttaatggcattttaatctctttttaaaacctcaatatttcaaaggcatttgcttattatgacaaattcaaatgctataggaatgtataaatttacaaattaaacttttctccaagtcaaagtgggaactctgggtctggtcagaacacctgatttttttaaacatgccttcattctattaactcaattatcaagttagcttcctcattataaataatatgcaaggccagacacggtggctcacgcctgtaaatcccagcactttgggaggccaaagcaggtggatcacttgggctcaggagttcaagactagcctggacaacatggcaaaaccccatctctacaaaaaatacaaaaaattagccaggcatggtggtacgtgcctgtagtcccagctacttaaggagctgaagcaggagtatctcttgagcccaggaggtcaaggctgcagtgagctgtgttcacacgactgtattccagcctgggtagcaaagcaagaccctgtctgaaaagaaaaaaaaaagatatacatatattttcagacattatataattcaattagacattaccctaccaaagaggactgtattgtcaaacaagctcacatagggccactcgtggtggctcacacctgtcatcccagcacttcaactttgggaggctgaggcaggaggattgcttgagcccggaaggttgaggcttcactgagccatattcatgccactgcactccagcttggctgacaaagcaagaccccgtctcaaaataaaaaagaaacttagctaaaaaaatgagtttgggcaacactggaagaaataaagccaagcaagtttctttaccgcttcgcagatcttcttctgagctagtttaaattgtcaactttcaaggtgggggagggattagcccttttcaaatagcctttttgtatgagtaaatccataataaaagttgatcaataaccagtagacatttaaacttcaaatataagggaataaaacaaacactgattttagacactgtttgaattaatcaagcccgggctccactttacaaacatctgtctctgaaggttattaaatttggcgttggcctgtgcacttcagtggccaggaggtcagaaggcaagggaaggccagaaatgactgcttccccccaccgaaccctctcctggatctggaaagaatatgtagaaaaaaggatagtgttttaatttattcttgattaatctcttaatttcattaaagtgaattaagtttttcagaacacagaaaagaacttcataaaaataccagatatatttttttcttttcatgaacataaactgcccagaagtctctgggtatttctttcaggaatttcagatctcctgccatagtttgaaacatggtactgtctcaggatgtggtatttggtccactgtgatactcctagagcagatgcagtttccgctttgacatttctggatttcagaaattagctccacacattgagactgaacaaaatcttttccctgcttataaaagcagtgcaagctctggaatagagtaaaagtaataaaaataatccataatgctacaactcagtgagaaccactgttaacattcttgtgtatatatcccagtctttttattctgtgtatatgtgaatgtatgtgtgtgcatctgtgtaggaagaaatgtgtctgggctgggcgtggtggctcacacctgtaatcccaacacgttgggaggcctaggtggtcagatcacctgaggtcaggagttcaagaccaccctggccaacatggtgaaaccccatctctactaaaaatacaaaagttagctgggcgcagtggcaggcacctgtagtcccagctactagggaggctgaggcaggagaatggcttgaacccgggaggcagagattgcagtgagctgagatcatgccactgcactccagccttagcgacagagtgagaccctgtttcaaaaaaaaaaaaaaagtatctgtttctcacccctgtattccaaatactcagcacctatctacctcagtccttggtataggaaaggcatttcttaagtagaacatgaataaatattaggggccaggcatggtggcccacacctgtaatccccgcactttgggaggccaaagtgaaaggattgcttgagcccaggtgttcaaaaccagcctgaaaaagatggtgagactctcccccccgaaaaaaaggatcacaatgggtccgttcttaaccactttcaagtattccattggagctgcctgatctccacctagcgatggtctagtacagtgagaactcccagatgtgccccttctggtgagaggcaagcttcctgacaacgccatgctgagtgtttgattggccggccagacctgttcataaagcatttcacaaaccgtcctttcttacgcaaactagctgggaataaacaggccccctgtgggtcttagaactaaagcaaatatgaacctcaaagaacaaaggaaaatcattactggtggcaggaatatgagagtgcttccacaatactatttcacaagtcttttctacatgggcttcagtcacaaaggtggtttgacattcactgagcagcatgggaacaattctagaacacttattctatccctgagctatttctgggataaaaatattgttaaaatacggctgggcaccgtggctcatgcctgtaatcccagcactttgagaggctgaggcaggcagatcacctgaggtcaggagcttgagaccagcctggccaacatggtgaaaccccatctctactaaaaatacaaaagttagccaggtgtggtggtgtgtgtctataatcccagctacttgggaggctaaggcaggagaatcacttgaaccctggaggtggaggttgcagtgggctgaggtcgtgccatcgcactccagcctgggtgacagagcgagactctgtctcaaaaaaaaaaaaaaaaaaaaaaatatatatatatatatatatatataaactatatatgtaattttaactatatgcatatataatattcttgacaaaaagaacactattgtttattctaataaaacaaacacacctcttctcttccaaaaagaatgtgagacagcttagactgttacagtactgtgaagggaactattaaaatttataccatattctagttgtcaaatgttcagaataggaaagactttagaatcagaaggtagattagcagctctcagggacccagggagttggggcagggatgtaatggttggatggtttcttttgggataatacaaatattgtggaattagatagagatgatggttgcacaaccttgtgtgaatatactgaaaaccactgaactgtacatttcaaaagggagaattgtatggtgtatgaattaagtttcaataaagtcgttacagaaaatttgcatcataacagtggcttgcgtgtgtaacaagttcctactttcagagtaccttccttttattatataacttttaatatcattataaccttataaaatacacagggcaagtttatgtaatctcccttaatagttggtagagctgagacccaaagagactcagtgattttgccaacatcacacatctacttagaggtagagccagatttcgaataaaaatattccagttcctatccagtgaacctctattgttcaacgtcccattaatgggttatactcaatatccagctactcaatttcatatattttatatgatgttattaaataataacagctcttattattaagtgcctgttatgtgccaggtagcatcatacactgtttttgtttgttttgctctttagagagcagatcttgctatgttgcccaggctggagtacagtggctattcacaggctggatcacaatgcactgcagccttgaactcctgggctccagtaattctcccgcctcagcctccccagtagctggtactacaggtgcatgtcatcatgccctgctattacaagtcattatacaaacctcataaagttttgttagctgcattttacttcttttggaaggtagcttattcgtccaaggttgccccacaggggacatttagcagtgcgtggagacgtttttggttgtcacagtgggagggggaggatgctactagcatctagtgggtagacgccacgtatgctgctaaacgtgcaacaatgaacaggacaggccccaccacagacaattatctggtctaaaatattgatagtgccaagggtgagcaaccctgctttaaatgatgatgacatagtatgtgtgaaaaccctctacaaatccatactgctatttttaccattttacaagtagatttttctagtatgacagctattcctggcaatgttagccagcactaggccctcagctcatgtttgttgggtagaccagtgcatgtcaaagatgattagcaaacattatgctaagtgaaattagccagtcacaaaaagaaaaatattgcatgatttcacgaacatggggtatttaaagtaatcaaactcatgaaaacaaaaagcagaatgtggttgccaggagttggggggagaggaaatggagagttgttctttgatgggtatgaagtttcaactttgcaaaggtgagaaagttctagacatctgtcatacaacaatatgcaatatagttaacactatattgcacactcaaaggtggttcagatggtaaattttatggtaggtgttatttacacaatttttaaaactttaggtgggcgcggtggctcatgcctgtaatcccagcgctttgggaggccgaggcaggaggatcacttgaggtcaggagtttgagaccagcctggccaacatgatgaaaccccatctctactaaaaatacaagcaattagctgggcatcgtggcacatgtctgtaatcccaactactcgggaggctgaggcaggagaattgtttgaacccaggaggcagaggttgcagtgagctgataattgcaccacagcactccagcctgggcaacagagctagactccgtctcaaaaagcaaaacaaacaaacaaaaaaacctgttttagcaagtcttcaacattagtgattaggggtagaatttgaagtttccaggttactgtggcagtgtgtacacctgattaaacactactcttccagctaatttgacagaaatgcaacaatatattaaatatggaaggagaggggcaggtgatgggagagagaagttgtgaaaagccccacaatgtgtcctcatcctggagacactgagtatgtgcttgaaaataggctggttccatcgtgtaatggttagaactctggactctgaaaataggctgatgtattggactaacctgtaattgtgagaaataatttatttgcagaagataaaagacttagaggacatttataaatataaatgttattagaattaggtgaccttcaaaggagtactgaatacgcctgttggttttggtcacaaagtttcccaaatcatttttgttttgcttcgattatatttacctaatcctgataagtttcacccgaatgaataaatgttatcgctctgagcttcaaagtgcaaatattttaccagcctcattgaaaagcacaaatattatctttagcatagattggtttctcagggtagaaaactgcatataagaacaaatctcatgaagttaaggttatctcattccctatttaatttgtcctttagttgaatagtgagttagagctagagacatgcttataaaattttgttttctgatgtcttctctgtaggacaaatggaaggaaagatttttggaagcagcttcttgtgtccgacccgctgtgatcagctgctactcccaggtctggggttagatggctttgtgactttccttctctggatggcattttgctttcctctgtaaaatggtgtgatgaatgagatgacctctaagcctctttccatgtctgtcactggactgtcctcttatgtagccatttaagttttctaattaaaaaaaaaaaatttaaaatttgatgctcagttaagttacatcaaaataattaaaatgaaactacaggttgagtatcccatatccaaaacgcttgggaccagaagtgttctgaatttcaagttttttctaggttggaaaatttgcatatacataatgagatgtcttggggatgggacccaagtctgaacatgaaattcatttatatttcatatacaccttatgcacatagcctggagataattttatacactattttaaataattgtgtccaagaagcaaagttttggctgctgttcgactgagacccatcacatgaagtcaggtgtggaattttccactgatggtgccacattaactctcaaaaagttttggattttggagcatttcagatctcagattttcagactagggatgccgaacctctatgtaattttgctttgaatgtgtctgggacactggggaaattttgatttttaagattcatctctaattctgaaaataacctggttgggtgcagtggctcacgcctgtaatcccatcattttgggaggctgagttgggcagatctcctgaggtcagaagttcgagaccagcctggccaacatggtgaaaccctgtctctactaaaagtgcaaaaattagctatgcatggtggcacacacctgtagtcccagctacttgggaggctgaggcaagaaaatcgcttgagcctgggaggcagaagttgcagtgagccaagatcgcgccactgcactccagcctgggtgacagagggagacttcgtctctaaataaataaataaaatctaagtgatggcacgtcaccccggggcatctttccactttcacattctctcctggctgctttacctgccctgccagcacagtccagagggcccccactagcattccacatgccaggccttgcttagatggaaggccttttcttccatctaatctaacctgtctcttgtcccatttttccagaacctctattggatggcattttctagaacctctattggttacttacggcataatgagatatatagaggttattgctaggtcatccttcttgactcaaatctcatttaagcaattagcttccttatgaaacttcataagggtcattgtggatcccttggctggctgatggggctgagatcttgggataggcaggtttttccttgcgcctcgaatgccacgttgaatactcctcatgtctttggagacatgtccttcccttcgagctgctcccagtcaggtgaggaataaaatgctatgatggcgtgaaaattctcccttggtctcatccatagatttgcaatcacctaaaaaaaaaaaaggaagagtgtgccaagccaccccatatagagccactgtgtggcagcactgcctctcgccaaagcttgggccactcggtgtcaggcaaagtgcagtggggtgagtttccagttcactggcggtacaggtagcccctagaagcgatcgtgtgcagtgagaatagctagcatttcagagtgttcactatgcgtgaatactgctcagagtgcattctacttattaacacatcaactcacaaaacagccctactggtattatctttattttactgacaaagaaattaagacagataggaaaagtgatttgcccaacgtcacacaactaggaactagcaaagccaggatctagacccacgcaaacctctctttgaagctcatgctttgctaccaaatatcgtgtcattctggcattcacgaggaaatcttgaaaataaagcaaaaagttgtaaaatggtatcaagtccacaatcgctgtcttgatgtagtgcaagcacagtggtatacaagggacatccgtagatacagaggagagggtcagcaaaccttctctggtaaaggccagatggaaaacattttaagcttcggtggtcagatgtggcaacaacttagccctgccattgtaacgtgaaagcagccataggccctgtgtaaacaaatgaggacggctgtgttccaataaaattgtatttatggacaccgaaatttgaatttcatataattttcatgtgtcacaaaacatttttcttctttggattttctcccaaccattttaaaatataaaaccattctagctgagagattgtctaaaaacatgcagcgagccagactggacccccccagctgtggttttgctgatctctggtatagaggaaagaagggtggctaaacttaattcggtgagtgcctaccataagcaaggtgttgaaagtgcagtgaccagcagaccgaaatagttctccatgggacattatgttgagtgaaataagccaggcacagagagacaaatattgcatgatctcactcatgtggaatccacatagaagtagagaatagaacagtggttaccagagaatgggaagggaaaggagcaggggggtgatgagagatggatcaacaggtgccaagctatagatagagaggaagaataagctctggagttctactgcataggaggaggattacagttaataataatgcattgtatatttcaaaatacctggaagagcagtttttgaatgttctgataacaaacaataaatgtctaaggtgatggatatgctaattaccatgatttgatcattacacaatgtatacatgtattggaacatcatgctgcatcccataaatacgtataattaccacctgtaaatcatacatttaaaaataaaatattaactttttgttttaaaaataaatagtcctccatggactagtggtagagcaaacaaacaagcaattgtaggagtacaaggttttattagggcaggtgaagggcttctaacccagacttggaagagcaaggaagggtcaccagggaagcagtgtcacatagggacctgaaagatgagtaggaactcaagacaaggcagggggagagaatattccaggtagatggcctatgcagtgagaagagataagcttgaggctaggcacagtggctcatgcctataatccctttggggggtcaaggaaggagggtcccttgagcccaggggttcaagaccagcctgggcaacatagtgataccccgtctctacaaaaaaacgatttttatttttttattttattttattttttttgagacggagtttcactcttgttgcccaggctggagtgcaatggtgtgatcttggctcactgcaacttccacctcccgagttcaagcgattctcctgcctcagcctccctagtagctgggattacaggcatgtgccatcatgcccagctaattttgtatttttggtagagatggtgtttctccatgttggtcaggctggtatcgaactcccaatctcaggtgatctgcctgcctcggcctcccaaagtgctgggattacaggcatgagccacctcgcccggccccaaaaaaaatttttttaaggctgggtgaggtggctcactcctgtaatcccagcactttgggaggcctaggcgggtggatcacctgaggtcaggagttcaagaccagcctggccaacatggtgaaaccacttctctactaaaaatacaaaaattatctgggcgtggtggtgggtgcatgtaatcccagctacttgggaggctgaggcaggagaattgcttgaacctgggaagcagaggttgcagtgagctgagatcgcaccattgcacttcagcctgagcaacaagagtgaaactctgtctcaaaaaaaaagaaacaaaatcttatgtttaattaggcaagcaatgtggctggcacctgtagtcccagctactcaggagactgaggcaggaggatgggttgagtccaggaagttgatgtggcagtgattgcactccagcctgggcacagacccagaccccaactctaagataagaagaagaagagttaggtttgaaaaccccaggctgccattaactcattactggatatcaggcaagctagcatatctttgggcgtaatttcttcatgtgcaaagtggatataatgtcaatgcttacctctcaggccatcagtgagaaaatggagacaaaatgtgatagaatagtcgttatgggtcattgtcagtgttctttatttgtaactgaatcaattggtgagaataatctgcaagattcctttcaatcctgaaatactataaattcttgatctttatttttaagtaaagagaccccactatcgaggagttctgggtgctgtccacgtaaatggtgacctacttcaggacaactgtgattgcctgaagttgaagaaatatagtgtcccttgcattcaaaggtgacatcagtgatggtgatggtggctctgcatgggaaaaagaggtgccaaatgaacacacattccacctgtactccacatgggaaaaacaccctgagctggcagctgtggccgatttgctagggtcttaatttgtggttgacctagacagaggtgcccaactgtgcctggcttttgtgaagtggtcagctggccccactggctcatgttcaaagagtcacctgattttttaaatagaagagctaccgacttgtggttgatcctccttcttttaagtaaatggtcatattgcacttcttgctgcaaataagttgctagagcacatttctcaagtctgggcagggacctgcagactgacttcagcaatggcataaaatcaggtgaatgatgaatccagaaaagaccataggaaaaataaaggtagaggcatttgggttggtcctagggcttatggccacgtccataactcttttattcctgtatagtaactattaggtcccgcaaaaatatcttccatgggggaagatctcaaactcttcagtccttgcagaagtgtgtggcatgattgtgacaggcaagaaaatgttcttggatgaaaatataccagtgacgccattgagaaataataacctgccagcgatacttgatccgaaatcactgcataatggaacctgtgtccaaagacgaagccgagttccctttggcctatgtcatggtcatccgcaaagactgatacatttgaaagactcttgagggccatctacactccccaaaacatctactgtgttcatgtggatcagaaggccccagtcactttcaaagacgctgtaagaaagctactgagctgcttcacaaacgtctctgtggcttctgagagggagtctctgttctacacagggatctccaggctccaggctgacctgcactgcctgaaagaccttgtggcctctgaggttccctggaagtacgtcatcaacacctgtgggcaagaattcccctgaaaaccaacagggaaatacgttcagtatctgaggttacggaaaaggaaaaatatcacccccggggtgccgcctcctcctcatattatcagaaggaccaaatacatgcacttggagcagagatagcttgttttccttcatgctgtggacttgcatgagaaaaatgcctcctccccaccatctgacaatttactttggctctgcctatgtggcccttacaagggaatttgctaattttgttcttcaaaacctaagggccattgatttacttgagtggtcaaaagatactgactctcctgatgagcatttctgggtgacactcagtaggattccaggtatgtggaacttgatttccaatctacataaagtctaaactctgtgagtgcacgcacacgtgtgtgttacacattgaaaatggtcttgatgaagttatgtatacccatctgtgtttctagacttaatgaatatcctgttgactgctttccatatgtttcaataaattaatataaaatatacttctggccaggtgcggtggctcatgcctgtaatcccaccactttgggaggccgaggtaggcagatcacttgaggtcaggagtttgagaccagcctggccaacatggtgaaaccctgtctctactaaaaatacaaaaatcagccaggtgtggtggcactggcctgtaatcccagctactcaggaggccaagacaggagaatcacttgaacttgggaggtggaggctgcagggagccaagattgcagcactgcactccagcctgggtggcacagcaagactccatctcaatgaatgaatgaataaataaataaaataaattatgcttctatgtgtcactaaatagactgttagcttatagaacatccttattaaatttctgctgtcattgtatgttatgttttgttaaattttttgttggtacacagtaggtatatatatttatgggttacatgagacgttttgaatcagtcatgaaatgtgaaataatcacttcagggtaaacggggtctccatgacctcaagcatttatcctttgtgttacaaaccatccaattacacttttattccttttaaaatgtacgattaaattatttttgacttatgttatgctagcaaatactaggtcttattcattctttctgtttttgtacccattaaccctccccctttccctccatacccctactccctttcccagcctctgctcatcatccttctactctctaactccatgagttcaattattttaacttttagctcccacaaacgtgagaatatgtgaagtttgtctttctgagatctttgaatctctgatatgacacccaaaactttttttttttttttttttttgagatggagtttcgctcttgttgcccaggctagagtgtaatgccacaatctcggctcaccacaacctccgcctcccgggttcaagcgattctcctgcctcagcctcccgagtagctggaattgcaggcatgcgctaccacgcccggctaattttgtatttgtagtagagacggggtttctctatgttggtcaggctggtctcgaactcctgtcctcaggtgattcgcccacctcagcctcccaaagtgctgggattacaggcttaagccactgcgcccagcccccaaaactcttttttaagcaatgataatatgttgtctagaaattcagtatcttcaatatggattggattattcattataatctcattttctgtgaatctatattacacgcatttgaaaagtttgagatctgagaatgtcaataaaatttctataagaacaatatgaaataatgcaaatttctccaaatgaaaaaagttttaaaaatccattaagaatttcaagaatttggccaggcacggtggctcatgcctgtaatcccagcactctgggaggccaaggcgggcggatcacaaggtcaggagatcgagaccatcctggctaacatggtgaaatcccgtctctactaaaaatacaaaaaaaattagccggggttggtggcgggcgcctgtagtcccagctactcggaaggctgaggcaggagaatggcgtgaacccaggaggcggagcttgcagtgagccgagatttcgccactgcacttcagcctgggcgagagtgcgagactccatctctgaaaaaaaaaaaaaaattttttcaagaattcagaaccatcttccaggtgaactgtctgtcaactgtgtttgggccatgtccacatgctggcctcacttggattgatgggtagaaaccctctgtgggccagccttcatgagtcttcaggaagtcatccttcgtataaaattttaaaatcctctactagttatccgtgggcagaacattttaaaacattcttttcttattataaaattcaatcttactgcggaaactctgggaaaaacaaaagcataaacaagaaagtaaaatctacgcattatacaaaactgagaagtaatttctgttagcattttagcattatttacctctttctctgtgtattgcttcatgtagttaggttatactgatgatgtaatttttttatcctgctactttcatttaacactatatcataatagtttccctatgtgattaaaaatatgacatattgtattttatcatagtatggatgtaccatagtttgcttaccaattcctcaatagttcgttttttcctttttttttttttttttttttttttgagacaggttcttgctctatcacccaggctggagtgcagtggcacaatttcggctcactgcaacctctgcctcccgggttcaagcgattttcctgcctcagcctcctgagtagctgggattacaggcttgagccactgcgccccacctaatttttaaatgttttgtagaagtggggtctcgctatgttgcccaggatggtctcacactcctgggctcaaactatcctactggctccgcctccttttttttttctgaggcggagtctcactctgtcgcccaggctggactgcagtgacgtgatctctgctcactgcaagctccgcctcctgggttcacgccattctcctgcctcagccttccgagtagctgggactacaggcgcccgccaccacccctggctaatttttttgtatttttagtagagacggggtttcactgtgttagccaggatggtctcgatttcctgaccttgtgatccgcccgcctcagccttccaaagtgctgggattacaggcatgagccgctggcccggctggctccgcctcctgaagtgaggggattacagcctcgttcctagttttttactgtgtaaaatgttattttagtcaatactgaataacatcaaaagtaagtaacatcttttcacataagcttcgccacattttagtattattgtctttggaattaaaattcactggattgaaagatagccacatttaaaattcttgatacatattgcaaaattgctttccaaaatatattctaattttccatcagtccaccagtgtgtgatcacacgtctgctaacagtggtattctaatgtatttattttatttttgagacagtctctctgtccccctggctggagtgcagtggtgctatctcagctcactgcaacctctgcctctcaggttcaagagatccttctgcctcagcctcccaagtagctgggactacaggcatgtgccatcacaccgggctaattttttttgtatttttagtagagagggggtttcaccatgttggccaggctagtctcgaactcctggcctcaagtgatctgcccgcctcggcctcccaaagcgctgggattagaggcgtgagccaccgcacctggcctaatgtatttcttttaaaaaattacttgaattaaacagaaaaagaactgcgctactcttgttatttataatttgttaaagatgaatatattttaaaggtatgttagccatttttcttgttctttgtgggttgccagttttctgggtggcaggcacagaatttcaatgctctattgtttgtgatggagaagaacaggttgggtggccaggaggtgaaaggataagggtatttccagcaaagaatggaggctgtaaggagctggcaaggactgagatcatttgaataggcataatgaaatagtgaaataattaggtaatttgccaaggaaaaaatcacccgttgctgcgatgatttgacttaactggctctttcccaataagtagaccccgtcttgaatctccaggacagtcatccttttttccctaccttcatcactaaagtctgggtttgtaaaatactgatgtatacttggatatttgatgattttattctttggttggtaaaaggtatagaattgtatggagcattttatttacctctccagcaaaattcccatgggctggtctctatttttcatacttttgcaaacagtacagaatgacaggccatgaagaaatgctgactcatgcgctcatgaggaagttgaattgtagatctgggcccaacacacacaatgcagcgtaagatgagggagaagataaccagtcacgaccattaaaattgttcctttccaattagaaaaaaataattcatgaccattttataaaatgtggaaaataggaaaaaaatacatagaagaaagtaaaatttaccataatcctaaaactctaaaataaatgctgttaaaacagttgggcttcttttagtcttttcaaaataggtcattttaagaattgttgatttggccaggcggggtggctcacatctgtaatcccagcactttaggaggccaaggtgggcagattacttgaggtcaggagttcgagatcagcctgaccaacatggagaaaccccgtctctactaaaaatacaaaagattagtcgggcgtggtggcaggcgtctgtaatccagctacttgggaggctgagacagaattgcttcaacccaggaggcggaggtagcagtgagccgagattgcaccactgcattccagcctgggtgacagagcaaggctccatctcaaaaaaaaaagaaaagaaaaagaaaacagacgacaggtgcagtggctcacacctgtaatcccagcactttgggaggccaaggtgggtggatcacctgaggtcgggagttcgagaccatcctgaccaacatggagaaaccccgtctttaataaaaatacaaaaaattagcagggcatggtggcgcatgcctgtaatcccagctactcggaggctgagacaggagaattgcttgaacccaggaggcagagactgcggttagccaagatcgtgccattgccctccagcctgggcaacaagagcaaaactcggtctcaaaaaaaaaaaaaacgaaaaagaaaagaaaaataatcattgatttgggccgggtgtggtggctcacgcctgtaatcctagcactttgggaggccaagaggggtggatcacttgagtccaggagttcaagatcatcctggtcaacatggtgaaaccctttctgtactaaaaatacaaaaattacccgggcatagtggtggatgcctgtagtcccagctactcaggaggctgaggcaggagaattgcttgaacctgggaggcagagggtgcagtgagctgagattgtgacactgcactgggtgacagagcaaggctctgtcacaaaaaaaaaaaaaaaaaaaaaaagttgatttgctatttcttcagtttatcctggctttatgactggaaaaaaattttttttaactcagttggattttttctttttttttttttttttttaagttgatgtctcactatgttgcccaggctggtctcagaattcctgggctcaaacaaccctcccgcctcagcctccctagtagctgaaactgcaggtgcacaccaccataccctgctttatccccactgaattttataagctgcttctgactgcaaagtgtttggcagaagagagggatatggctaaatgcacggtatgactagcttgtttcctgggacaggaatcagttcattcctgaaagggtatgtaaagagcccgtttgcctggcctaggaaaagccagaggttcagagagaggaagtgacttgctcaagatatacagcttgcattagagaggagagaacttgccttctgaaaatgcccagggcattttctactaaattctgctgccaccttaggattccccttccccagtgtgggtagcatttgagcagaacacatatctaaatctgttagaggttaccctggggcagagactataagatttcctaccaataactaaacataagagtggaaccttaaacacgaggggtctgtgagggaatccaaaacttcccctcttgaaaaagcagcctctaagggggcaaaatggagggtagtcttaggaaaacacccaaataattatcctgaggtctatcttggagtgtcctcatgaaaaacccagttacacccagggcagttacctttctgagcggtttcttataacattcctggagtggaaagtgatcaactcaaagccctccaggactctagaggcaggggatgagctggtgtcaggtagcacctggtatccagcagcttaaaaaatccagactctaggcaggctctctgtagacgtgtgttctcctgtctcagactcttagggcaggccttgggggtgggactgaaagcaaacagaccttcccactttcacattccagcctctgttattccacttaaaacgctagggttaaactgcgtttaccttaaacaggcttactgtgttcactgctggacgcctctgggcaatcttaccctcctgggaactgagagaggtaggtggaggtcagcgtgctgggaaactggtggagggaggaaactgcggggagctggtcttctcgtgttacctctgttaaatcgctgacagcagtttaaggtccaataggctggtactcaaatgggctgcgtggatgttttatatttccagaacctagcacagtgccgggcataaagtaagtacaccaaaaaatgttgaatgagtcatttggtcatgagatttctgttttcaaaggttttttttttttcaaagaatagcatgtttgtatgttgtttcattacatgatgggcctactgggcacgagggttttccatctgtctctaaatcattagtatccttctgtatctcagttacaacttttaactttgtaggaaagaacaacgttcacttcagacttaatggtttatgtttctcagttccttcaggcaagggaaaatgtttccagaatttgataaggtacttggtactgtctggcatttaaatttttttttttttttccagacatagtctcactctgtcacccaggcgagagtacggtggtgcgatctcagcttactgcaacccccacctcctgggtcctgcctcagcctcctgagtagctgggactacaggcatgcacaaccaagcccggctaatttttgtatctttagtagagatggggtttcatcatgttggccaggctggtctcaaactcctgactccatgtgatccacctgcctcagcctcctgaagtgctgggattacaggcgtgagccaccgtccacagcctgaaatgtattttatttaattagttgctgtgaggtatgaacattcctgtgaggtatgaacctcatttgataataggtaaaattgaaaatgaagctctgggccatgtagaaaagtagtagatccatattgccattctatgaaaacccatcttctgatattaaagacaggtctactaagtaaattcaggttttgccaaactcaaagctacttttctgttttccttatttttaaatgtaggcctttgagagtcgtcacttgtaaatagtctttctgcacctggtagtagattggccaaatagagggtagttacctgtaggctgtggttttccagaagaaatagggagactgtaatcccaggccctggggaccctacagcgtaaaggatctgtttctttgcactctgttctgattgaacagcatattgcaattatcggaagaagggaggctatattctttcatgtaattattcttagtgatcagaagcttgaggtctcccttgtggaagtattctacctatggcagtaatttttggttcctgtaacttcaaaatcctatcaaggactttctgagcgatagaggtcgggagggtaagagcaaaactccatccagaaaggtgaaaacaacaaacaaagcctcgggcacggagattgggctgctgttctagcttctcataatatcccatttatagaatacactcaatcctcaactccagggtaactttctgcaacagtaaaattagacttaaaacgaatgaggttctccagctctggcttctcccggagaccctggcttggaaagcctggagttgtcagatatcttttcatgtgcaaacgcaggcggaaagtgcctttaaggcctcgactccgcctagtaactgagctgctatttaactttgctcagtcttgcattgcctcaaagttatttgactgagcttgaaaagaccagctttcagccaggcgcggtgtggctcatgactgtaatcccagcactttgggaggccgagtcaggcggatcacctgagatcaggagttcgagaccagcctaccagcatggtgaaaccccatctctactaaaaagaaaatacaaaaattagccgggtgtggtggcacatgcctgtaaccccagctgctcgggaggctgaggcaggagaattgcttaaacccgggaggcagaggcttcagtgagccgggatggcgtcattacactgcagacggggcaacaagagcgaaactccgtctcaaaagaaaaaaaaaaaaaaaaagaccagctttctcttatagtttcctattactttttttcccagctattttttgttaaacgatcacaacccacttcatttccccctcgtagcctcttcttccccacagctttccatccaggtctggaattagctctgacttctctagaagccctgagctgagcacgttaggtgccctacctccagaatcctcccagcatggcctggagattgctgttgtcttgactctagacttgaaaaaccaaggccgggcgctgtggctcatgcctgtaatcccagcactttgggaggccggggtgggcggatcacgaggtcaggagatcgagaccatcctggctaacacggtgaaaccccgtctctattaaaaatacaaaaaaattagccgggcttggtggtgggcgcctgtagtcccagctactcgggaggctgaggcaggagaatggcctgaacccgggaggcggagcttgcagtgagccgagatcgcgccactgcactccagcctgggtgacagagcgagactctgtctcaaaaaaaaaaaaaaaaaaaaaccaagactaagaggtgtggtgatctggctaggaaggaagccacagttgggagttggaggctctaagtaacagcagagccccttacagcctgcgagatccatgctggatcttggtttgtttttcaacaaacgggtgttgttttctcaaattcactccaagaggaagctgtgattataaatcaaatgacttattcaacggctccaagcctgttaagagtggccttggtccacggaaactttctgacacataatccagggctttttttttttttttttagacggagtttcgctcttgttgcctgggctggagtgcgatggcacgatctcggctcaccgcaaccttcgcctcccggggttcaagcgattctcctgcctcagcctcctgagtagctggaattaacaggcatgcgccaccacgcccggctaattttgtattttcagtagagacagggtttctccatgttggtcaggctggtctctaactcaatccagggctctttttaaccatactatttaagccctgttgctggaagcctgtggttataacctatgcttaaaaagaaatagtgatgaggataaagcagggtaccgaacttgtcaagagaaaacacataaataagaaagagcaggcagagaggaggacaggaaaaggttgtctttttgaaaaaggacaaaatgatacaaaaattagccaggcatggtggtgcatacctgtaagcccagctacttgggaggctgaggcaggagaatcacttgaacctgggaggccgaggttgcaatgagctgagattgtgccgttgcactccagcctgagtcacaaaagcaaaactctgtcccccaccccccaaaaaaaagaaaaggaaagaaagaaaagaaaaaggacaaaatgtgttgcccttcagattaaaaaccagtttaatccaagctgttcttcctctgagactgcatcaggctttcacagacactgagaaagtttccatcggcccacccccccggtttctaatttgggcacacaggtgatgtcatggtaaaatgaatatgtgaaaagtgctttgggcatcatatggtccatgaataattaaggtgaggatgatgggattcttgtctgtagaaaggaacccctttttttctgcttctctttctacagtcagttattgagattaaactctaagtgcagtgtcttagtgcaatgaaaattagtttacatcctggagagtgagaatttataagagtatgtgttatggagaaataagcaattagtgattgaacataatatacaccctgccagttattgagcaaccaaactataagtctttgctggttcccaatttgttcagaactctttatttatcccacctgatcagtgcctccgacttagaattggggggtattaattttgatctgaaattcaacctgggatgaacaatctcgcgtccttttggtcactccctgattaccatctcctcccattatatcacacaaacgcaagagcctagagcccagaattgaggagagtgattactgatagattgtacaagggcattgggaaagctggagggtctggaagaccagcgtgtcccatgtgcctaccaaaataaaatgcaccagctggcactgggttgatgaaaaaggaaataggttcatattaattctttttttaaatgtctagcattgtcaaagatactattttacagaatcataaatattccagagctcaaaatcaagggaccgtcttagcattacaggtaaggtacaagtaaagacgtatgaactttgcttgtacttgcagcagagcacaaaatacaagtgttcgttaccctgcaactaaatccagtgagttgtaaattcgaagagcaggcaaataattcaagatgcttctatgtctgcaatgtctggagggatagaactaggccaagaatgaggtaagagtcaaacaaacacctgatgtaattgtctggataaattaggagaaaatatggtaaaaattacttgactagtttagataagcataattcagcattgacattttcatttaatcattcctatagtatttcatttgatatggacagggtctaaagagacgttaaaagtcaactaaaaattagagaaattttagtcatttcagaaaagattgattttgtatgcgttctgtattgaagaagtgatttgttcaaaagaattctggatagacgcatgaaagatagttaagaaaatagatatttgggttgattaaattctattttgggggccctataggcacaactgggtgtacctgagtcacgctgtagaatctgattccagaagcaactgagaactgactcactgtgttctagagaattttccctgtgtcctttcttgtcatcatttcctgtgttcctgacaccgtgaaatggggttggctgccgtctcaatgtgttcgcttttagctgggttagcggaaaaatcaacaggaataactccaggttctaaagtagtgattgtgaagataatacccaaggcacaccaagaagcactatggaaaatgttattgtataatagtaagtgcagaatgcaggatttaagcttgcatcttcctgcgttcttttttttttattagagatggggcctggctgtgttgcctaggcaggtctcaaactcctggcctcgagctcctcccgccttggcctcccaaaagtgctgagattacaggcgtgagccactgcacccagcctcccctgtgttcttgataaaataagaatgtgtatttcctataggcaagaggtaaatgaaagtacaggacgtggaaacattgtgtttagaaactatctacgatattatgtcgtctttgtgattaagaaaatgagccaggtgcagtggctcacagctgtcatcctaaagctttgggaccctgaggtaggaggatagcttgaggagttcaagaccagcctgggcaacacagtaagacccccatctctacaaaagagtaaattaattaattaattacatttaataaaagttagaagatacattggaaaaattaggtttattgactgtaccacattcacagatacaaatatatatctcctacaaatcagtattacctggaatttctcactaatgtgatcagggaagcagggaaatgaaaacttgagcattcaatcaataaatagttgattgtgcggtggctcgcgcctgtaatcccagcactttgggaggccgaggcgggtggatcacctgaggtcaggcgtttgaaaccagcctgctcaaaaatggtgaaaccccgtctctactaaaaatacaaaaattagccaggcatggtggcaggtgtctgtaattccagctacttgggaggctgaggcaggagaatcgcttgaacctgggaggcagagatttcagtgagccgagatcgtgccattgcactccagcctgggcaacgagagcgaaactccgtttcaataaataaataaaataaaataaaaagttgcttgtctactacatacagacaatgctaggagccagaaacatgaggaatacatgagctcggcgccaatggaacatgctttcacaccgggtgcagctaaccaccacatcatacaaaactcgtcgctgacgttttagatgtataatctgattggcatggactcacagaggagggagtaagggaagagtaagaagatttcaaaggagaggtaattgtgtcatttattagaagtatgagtgtggggtaagagatacgtgtgtatgcatgcgtgtgtgtgaacggacttcttgtttagtaccattttgctgctgctttaccaccccaatctgttcctggacacggcgatggactctgtatatgttatctcattttattctcacaattgacctctggtggtaaaattattctcattttttacagattaaaaaaaaagcctcctttaaagcatttgtaaatctggacataagagcctctctcctaaaattcaagactgagatgctcttctctccttcctctaagcatcagggttctctgtctgcatcctatgcggaccagggcaaaataaacttgaaattcactatgttagcctgtatgcaattttgggtgatgatgggctattggtcgttttgttgttttaaaaaaagaagttagcctttattcatccgagtgccacagtcactttgtgcagtaagttaggtggtgaggtaagcttgctaattaatgggcattttaaaggactttacccagcagcagacaaaattaagccctggaaagaatttagcccagtagccagtcatatgccatgtcgtatagcatacccagccaatggggagagcgaggtgtggctgtggaaaaagacagggttaagcaatttttttaaagcactacatatttattgatagaatatctctccaggcagtattcacatgctttaaactgaagctcgtagcttggcagtgcagtttaagcaaataaactcaggctgttgaacacaatgattaacaggaagcaggggaggggacatagttactagactctggccgggacaagaggctgaggttaaggtcttagagccgatgacttgcagaatggtcacctcacccacttgtaatttcatggtgggaacaggtggaccccctggaatcagaacctctctgaggacatctgtttttgtgtagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcttatctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctgaaaaccaacagggaaatagttcagtatctgaagggatttaaagggaaaaatatcacccccggagtgctgcctcctgaccacgctgttggacggactaaatacgtccaccaagaactgttaaaccacaaaaattcctacgtgattaaaacaacaaaattaaaaactcctcctcctcatgacatggtgatttactttggcacggcctacgtggctctcacaagggactttgctaacttcgtcctccaagaccagctcgcacttgacttactctcctggtccaaggacacctacagccccgacgaacatttctgggtgacactcaacaggattcccggtatgtacgtctcttaacttttatttttacgaataaacactgcatggtcaatactaaataagttgctttgaaaagagtggaaaaaatgggacaaacttctttacggttttaaatgtcaaattaaaaaaaaaatttcatctgtaaaatggtaaaatggagatgtgttatatcacccactcttgtgaaccgctctgttcacaggacaaaagaccgaaggaacactggccatataaataaaaacgtgaccgagcacagtggctcaagcctgtaatcacagcactttgggaggcggaggcaggtggatcacttgaggtcaggagtttgagagcagcctgaccaacatggtgaaaacctgtatctactaaaaatactaaaaaaattagccaggcgtggtggtgcatgcctgcaatcccagctactggagaggctgaggcaggagaatcgcttgaacccaaggggcggaggttgcaatgagccaagattgtgccactgcactccagcctgggtgacagatcgagactccatctctaaataaataaataaataaaatgtaaaccttattctcctttaagcgcaacgcatttaaaatcaggaatatgtattataaataaaatttgaatgacaatttgaagatttcataatatttttgtctctgttgaagctcccatccttttgaaatgggagcaagatacaactttcaaattttttatttgcaagctcttttctggtcttgaatcaaaaatctaaagcatggccaggcatggtggctcacgcctgtaatcccagcgctttggaaggctgaggcaggaggatctcttgaagccaggagtttgagaccagcctgggcaacatagtgagacactgtctctattttttttcaagaagttaaaacaaacaaacaaacaaaaaaaccttattgcaccttaaagatttctaggctgagcgcagtggctcacacctgtaatcccagcactttgggaggctgaagtgggcggatcacaaggtcaggagttcgagaccagcctggccaacatggtgaaaccccgtctctactaaaaataccaaaaattagccaggcgtggtggcgcatgcctgtaatcccagcttctcagaaggctgaggcagtagaatcgcttgaacccaggaggcggaggttgcagtgagccaagatcacgtcatcgcactccagcggagactctgtctcaaaaaaaaaaaaaaaaagatttctagactagtacctccattttatagatgaagaaacttcaatgtgattacatgatgtgctcaaatcccacagctagtaagcaaatgcaccaattataaaccaggtctcctaagcctgatgttctttttaggttgactttcaataaggtctcaattgttgctaaatcaattccatctctcctttggtccaagttccaaatgatttttgaataatctcaagttgtttatagtgaaccaatttagtcctgctagttcaattcaaaataagaattcatatttgcagttcaaaggaaaaagtaactggaacctgtatgaagatcacagtcctggtttctttggattgctggttcaaccctggatgcacattacgatcatctggggcttctaaaaataactaagccagggcctgtttccctccttggggcaagacctaactattgatatttgtacagcttccaagtgattctcatgtacagccaggggtgtaaaccattgcaggtgcttgttttagatattggcatacaaagcttcataggcttagaattctctttaagtctgtgattttctcagagccagaaggggaagtatagtgatcaaaagaaattagggctcaggaaagtctggtggggaaagcacagagctgtttaaatagaattgtagtgtccagagtaagggaagtgaaagcctcacttctctcccatgtgcttggagtaggatgtagactcttcaggtctggccaccctactatacggggagacattgacacagcagttccaaagagagcagccagggaggtaaaaaggccaatccccacttttttttttttttttttttagagaagaccaagacaaagaaaaaggataattgatttggaaaagacttgaagagggatcggtgtctttacctaattaaaagatttgctcaggaaagagaaattagaccaactctgtcgttttggaagtagaatctagggccagcgggtgggagatgagaacacatggagctgggaataaaacgggcagcttcctcaatggtgagcaaagccaagggaagcagggctggggaagtgctgctgaggaaacctcaaggattggaccggatggcctccgagtcccttcccactctcagagtctgtgatcctaatcaggggactcaacagaaacttaagggaaaccccctgacttctcgactcgatgtatctattggagctggatttttacaccccgtgttagcagtaacagattggcaaagcaatagaaaacaaatgcaccaattcatgtttttcagaaacttaacaaaagttagcccctgaagtcatttctgtgttatgtgtgtggaggaacactgccggaggaccctgaccagctctgccaactcttttttttctttttttggatctcactctgtcatccaggctggagtgcagtggcacaatcacggctcacggcctcaacctcccaaagtgctgggattacaggtgtgagccacacagcacccagcccgtgctggtcttgacctcccaggctcaagccttccaagaggctgggactacaggcatgtgcccccatgcctggctaactttaacttttgtagagacgaggtcctgctgtgttgccagtgctggtcttgaactcctgggcccaagcgatcctcctgcctcagcctcgtgagccaccacatcgggcaagccctgccaactctttcctgacctgaggcagggctgaatgtaggaggttagggaattagaaacctaagggttgtcttgtttaattattattccggctatgtggagatctgagccattttccgttgtaagggtccttctggttgatgtgtatatgttgtggtttttgcttttttttttttttttttttggcaggtgtgcgagggacattttgagattgttccaattcattgtcatgattgagggattatgattaggattctgtaaagtaactagtccaggccaggtgtggtggctcacgcctgtaatcccagcactttgggaggctgagctgggtggatcgcctgaagtcaggagttcaagaccagcctggccaacatggtgaaacctatctctactaaaaatacaaaaattagccgggtgtggtggcacgtgcctgtaatcccagctactcgggaggctgaagcaggagaatcacttcagcctgggaggcggaggttgcagtgagccaagatcctgccactgcactcgcgtctgggcgacagagtgagactccatctcagaaataaaaatttaaaaaaaaattagtccagaaaaacatctcacagctgaagtggtctcatgggaagggagaacagcactgcccaataggaatgctataatgggagccatagatctaaaatcaaattttagattttccaggagccacattaaaagaagtaaaaagaagcagataatatgaatttaaagaatgtattttatgccaggtgtggtggctctcgcctgtaatcccagcactttggggagccgaggtgggcggatcacttgaggtcaggagtttgagaccagcctggccaacatggtgaaaccccaactctactaaaaatacaaaaaactagccaggcgtggtagcttgtgcctgtaaccccagctactcgggagactgaagcaggagaatcgcttcagcgatttaggagaaccaggaggcagaggttgtggtgagttgagatcatgccactgtactccagcctgggtgacagagcaagactctgtctcaaaaaaaaaaaaaaaaaaaaaaaaaagaatgtattttatttaactcagtttgaaacatcacttttacttgtggcctgtggctgcgaccacaggcaggggaggtggaccacgcatcctcattgctggtgcagtggtcaggctctgccgccctagcagcaccgagacgttggccgtcctcatgtcgcagagtctccacctctgctggttttgctttgcctgcttctactttatttgaaattcttgcctgtgcttcagcacttcccctggtttatgggctcctccaccctgtgggttctacttcctatgtcttcccctggtatctgccagattccatgctgctcttttttttttttttttttaagatggagtctcgctctgtcacccaggctggagtgcagtgatgtcatcttggctcactgcaacctcctcctcctgggttcaagcaattctcctgtctcagcctccgcagcaccagggattacaggtgcatgacaccacgcttggctaatttttgcatttttagtagagacggggtttcaccatgttggccaggctagtcttctgacctcaggtgatccacctgccttggcctcccaaaatgctgggattacaggcgtgagccactgtgcctggcccatgctgctctcttgacagcaagtgctctctgtgtcccattcagatgtccccagagagtcctgccttgggtcatgcagccattgtattaaacaatgaggatccccgttctcattccacaccacctctcaggctgcggctgacgtctttgcaggcagctgccctttatgtagccccaagttgtccaatcagctgtgaccagggtggcagggtcatgtggtttaaaaaagcaaagcttgggtaacacagataccttgtctctacaaaaaaaaatcaaaaaatagtcaggcgtggtggcatgcactgtagtctcagctgctggagaagttgaggcaggaggatcacttgagcccaggaggtcaagggcacagtgagctgcaatagcaccactaccctcagactgggcaacagagtgagactctgtctcaaaaaatggataaataaataagcaagcaaaacaaaacatgggtccgggcacagtggctcacgcctgtaatcccagctctttgggaagctgaggtgggcggatcacctgaggtcagaagtttgaggctagcctggccaacatgatgaaaccccgtttctactaaaaatgcaaaaattaaccgggtgtggtggtgcatgcctgtaaccccagctactcaggaggctgaggcaggagaatcgcttgaacctgggaggcggaggttgcaatgagccgagatcgcgccactgcacttcagcctgggtgacagagcgagactccatctcaaaaacaaaaacagacaaaaacatggtccatccagcaggtcctctggaggcctctcagaggataagactctctgcatggcctgctcaggtgaaggtgcccatgaggagaacagtgttacagaaagggggttcacatatggctttaaagatgtccaagaagcctcactagctgttatgaaattagggcttcctgccctccctttttcctctccccacttccgtcttttacccttaatctggtccacaacaagatggcatgccttttagtttcttgtgtgattcagctgtggatgatttccatttataagcccaagatgcaagttcatccacctcccactttcctcctgagttattattgatcctctgggttggatggctctgcctgtaatagggacattcagtgagtttattccattggtcatgtgtgccttgaattttacacatttcaaaactgaccagtgatttctgtttcacttgctacaaaggagtattttgaatataactccatgggagtttgtttcaaactcacattaaaataggaatgaatgcaaaaacagcctttcctgggagcaggctttgtgggcggtgggaggaaggagtgccaaggtgtccaaaggggaaggaatagagaaaggaagatacctggtgggtgattgagggcccgaaagacagaccctccctgcttccaatttgtttttcccctggagccagcctgcggactagccctattggatattccatggcaggcatcttcccctgaaccctaaatgtgggtggctcattgtatttctatttcctgtagagtccatactggccttactctttgtcactgtttgaggctgatatatcccgttagttcctctatatgtaaaaatgcaatgctgaggttccaggtgccgagaccttgagagatgcaaatttgggagcagagaagggcagatccgaatcaaggtggtcttgggaactcatccttgagccccagggatgtggctgggatcttactgtgtgcagagggaattgatattccccaaaccaatcgagcacacagagcttctgagatgctaggcgaatggacagacttgaaggggaggaagatttggggatttttactattagctccgcttaagcaatctctgtttttttatatctgccagaaatatcggtttttgtcaacttcttcttttttttttttgagacagtcttgctctgttgcccaggctggagtgcagtggcgtgatctcagctcactgcaagttctcctcccgggttcacgccattctcctgcctcagcctcccgagtagctgggactacaggcgcccaccactgtgcccggctaattttttgtatatttagtagagacggggtttcaccatgttggccaggatggtgttgatctcttgacctcgtgatccacccacctcagcctccaaaagtgttgggattataggcgtgagctaccgtgcccggtctcttgtcaacttctagaaaaggaaatcagagagttgggacacctgtgagttcctttttttttttttttgagatggagtctcactctgtcacccaggctggagtacagtggcgcaatctcggctcactgcaacctccgtttcctgggttcaagtaattctcctgcctcagcctcccgagtacctgggactacaacctctgcttcccgggttcaggcgattctactacctcagcctcctgagtagctgggactacaggcgcccgccaccacgcctggctaatttttgcctctttagtagagatggggtttcaccatgttggccaggctggtctcgaactcctgacctggtggtctgcccacctcagcttcccaaagtgctgggattacaggtgtgagccaccactctcggccacctgtgagttcttctcagggaaacagtttcttaggaaggtggtaaatggcctgacagacttcattttttaaataggtagattatcaagaaaacaatggcattaatcacttccctagaagaagaaaggaagagtttaatctgcaagtgatcttatctttgctaaccattgtcttccctcttcactgatcactgagtttgttcttcgggcattctgtggctcacactctatccttactttcttcttcctccttcccagctaagttagactacagatgctcttcgacttacagcggggttacatcccaagaaactcatcgcaagtggaaaataccataaatcaaaaatgcatttaatggccacgtggggtggctaacgcctgtaatcccagcactttgggaggccgaggcaggtggatcactagaggtcagaagtttgagaccatcctggccaacatggtgaaaccctgtctctactaaaaatacaaaaattagccgggcgtggtggcgggcacctgtaatcccagctatttgggaggctgaagcaggggaatcgcttaaacccgggaggcggaggttgcagtgagccgagattgtgccactgcactccaacctgggcaagagggagattctgccgcaaaaaaaaaaaaaaaaaaaaaaaaaaaacaaaacaaagaaaacgaaagaaaatgcatttaatgtacctaatctaccaaatatcctagcttagcctagcctcccttaaacatgctcagaacacttacattgttagcctaccgatgggcaaaatcatcttacacaaagcctattttataataaagtggtgtctatgtcatgtgatttcttgaatacagtgcactatagagtacagtctcagttgtttaccctcatgatctcatagctgaccgggagctggggtggcctgccactgctagcatcatgagagagtatcctaccgcacctcgttagcctgggaaaagaccaacattcaaaagtcaaaatatggtttctacttaaatgctcatggctttcacacatcataaggtaaaaaaaattataagttgaggccaggcgcagtggctcacgcatgtaatcctagcactttgggcagctgaggtgggcagatcacctgaggtcagcagttcgagaccagcctggccaacgtgatgaaaccccgtctctactaaaaaggcaaaaattagccaggcatggtggtgcacgcctgtaatcccagctactcgggaggctgaggcaggagaatcgcttgaacctgggatgcagaggttgcagtgagctgagatcgcaccattgcactctggcctgggcgacaagagtgagactccgtctcaaaaaaaaaaaaaaaaaaaaaaaaaaaaaatatatatatatatatatatgttgaactctcataagtcagggaccgtctgtattctttcctgaatttatacccatgacaccttaaatataaaccctgatagatctcatggcatctatgttttgttatggaataacaggcttagttgctgaaagtcataaagtgacacagcacaactgaggactgctaatgattttgacttttttttgagtttataaaaagattgtaatttccccagatcagaaattgccccaatatgtagtttaattgatttgtatgcattttatgtatccatatatattaccatcaaaaatggcttacataataatgataatgtatataaatagttttgctttgccaattataccatcttctgggatctcagaggaataaccagagacatgaccctgttttaatattctgttgctcctttaggtagcaatttcctttttaaaaccaaaaaataatgtttcttcctatggggacctatcttaattttatactgaggaagctaaaagtagtttgatgagaaagaaaaaaataagggttgggcccagctggagtatagtcagatgacatcaattagaatgcatttaagatttaagtggactggtgaatggtttggaaaaatagtctaaagatttgtttactctctattagagttggagagtagctcacactcactggtggggtttagaaacaaacaggcctgagtttaaagcctatctctacagctcaccgtctcttttttttttttttttttttttttttgaggcagagtttcacccttgttgcccaggctggagtgcagtggtgcgatctcggcccactgcaacctctgcctcctgggttcaagcgattcccctgcctcagcctcccgagttgctgggattacaggtatgcactaccacgcctggcaaattttgtatttttagtagagacggggtttctccatgttggtcaggctggtctcgaactcctgacctcaggcgatccgcccacctcagcctcccaaagtgctggaattacagacgtgagccactgcgcccggccccgccatctctttaactttgggcaaatgcctcatttcactgagcctgattcttcatctatatcctggggataaaatatctctttgtaggactgttgaaggattagagagtacacaaactatacctggcacatcatagaaactcattaaatggagagagagagagaaaacagatgaacttctcaggtgttgatttttgaggttttaatgttacgattctaaaaattctatgtgcaactaaaacaaaaaacaaaaccttctaacatttggttttgaaagcataaggtctaatttttggttagaaatcaggtatgtgaggccgggcatgatggctcatgcctgtaatcccaacactgggaggccaaggcaggaggatcagaggattgcttgagaccagcctaggcaacatagtgaaattccatctctacaaaaaatacaaaagttaaccgggcttggaggcgcgtgccggtagtcccagctacttgggaggctgaagcaggaggatcgcttgagcacgggaggtcggggctacagtgaggggtggtcgtgacattgcactccagtcttggtgacagagtgagaccccatctcaaaaaaaaaggaaggaaaggaaggaaggaaaaggaagaaagtaaaggatggaaggaaggaaggaagagagggagagaggaagggaggaataaattaggtatgtggctgaagaggttccctagggtatagttcttcttagcaatgtcacctgtctgtagtcttgtaccaggaagtagcattctgtgactaaagcctcctacctctccaggcttctcactttagacttgtctgaagccaaatggcctccacaacctgttcatgctgtctttttgttctggaatactctttatctttgctgctcattctcctctgttcaagatccagttgaaaagtcacggcctcagctgctttacactcctgcagaagcagctcccctgccccaccttatccacacttctcttgcagcacctcttccattgcatcttaacaatttgtgtagatctcagttccctctatgcccgggccctgcccacccccaaccaccagcacaccaaatgtgagcaggcaacctaatgattggcccaggacctagacttttatccagcttcatcactgagtgggcttccaatatcactttgcatgaggaacggagaaatggaagagaaatcgtctgcatgtctaataagatgttctctacaagtggagaaaattccccttcagcattacaggaagtttattttctgatttttcaattctagctcagcttttaagcagtccacagggtgggattcctaaatctaaaccccaactcccccatcacttccaccaactttttcaaaggacaaacatcctttgctgccacctgtgctaaatccattagaaaacactcttgggagtgtggtctgcctttgggagttcttagtcatctgattgctagggtcagtatcaattaccctccatccgttttgaggactgaatttgtatattgtttttgttttctttctattttaagttcgggtacgtgtgcaggatgtgcaggtttgttacataggtaaacgtgtgccacagtggtttacccgcacagatcatcccatcacctacgtattaagcccagcgtctctattagctcttcttcctgatgctttccctctgccaacgccccccaccagccccagtatgtgttgttcccttgcatgtgtccataagttctcatcaatcagctcccacgtatgagaacatgcggtgtttgggtattctgtctctgcgttactttgctgagaataatgtcttccaactctatccatgtccctgcaaaggacatgatctcgttcctttttatggctgcataatattctatggcgtatatatacgacattttctttatccagtctatcactgatgggcatttaggttgatttcatgtctttgctattgtgaatagtgctgcagtgaacatacgcgtgcatgtatctttatgacagaatgatttatattcctttggatctatgggatcgctgggtcaaattcctatacgttttagttcaggtctagaaaagtaaaatcattaattaagggaagttagcagagttattttggccctgagaggctgtgatttaaaatattcagaaaatgtagttgaagtagttgatttggcttcaacttgaattccctatgtaattgcagggaattcaagggactctgaattcaattcagggaattcaaacagacctctttgcctttgagctagttttccccctaggcttttcttagcctgcaaaaatcctggttatctttgaggacccagttgagttggtcttgctcctaaatcattgacaagcccctaccctcaggcagagcagtttgtcctttgtgctccaaatactttttgttgtcactgtagttagggtttgcggtttaatcatctattgctgctgccagaaagcagaatcttggagggtagggagctttatatctttgcgagcctcaaccaacacaaagcttggcgtcagattgaattcaaattcaccttacgttgctagtatgaaaccaattgtgttgttgctttcatacaaatccagcagttttctgctaatgagacctgcaatgtaaaatttaaaaagaaaaaagaaaaaatatccaacaggtttctaccgtccaagtcactgatagaatctacaacagatcgacagagttacagctgtttcctgccccagttttaggcaccataaagattttctagaaggcttgccaatcatcatcatcctgtaagttcttacactgctacgcactaaactaattgcctttccccctcttaaaggtaacaggtttattgaggtataatttacatagggtgaaatttatgacatataatttacataccataaaactcacccacttttgtgtacaatgtaatgatttttagtgcctttacagttatgcaaccatgatccccggctaatgtagaatcattttattactacacaaagaaacctcatgaccacttcccatttccacacccaacccctgcttttctggctctatggatttgccttttctggacatttcatattaaccaaatcatactatatgtgttctttcatgcgtagctccttttacttattgccatgtttttaaggttcatccgtgttatcgcgtgaatcagtacttcactttttataggaatggatgctgttccattatatggatacaccacgtttattttttcatccattgatggacatttgggttgcttctacttttggcttgtgtgaagaatgttgctatgaacattcctgaacaagtcactatggggacacatgttttcatttctcctgggtagataccaagagtgaaactgctggtccctatgttaattctttttttttttttttttttttttttaattttgagacggagtttcactcttgttgcccaggctggagtgcaatgccatgatctcggctcactgcaacctccacctcccgggttcaagcgattctcctacctcagcctcccaagtagctgggattacaggcatgcgccaccacacccggctaatttttatatttttagtagagacggggtttcaccatgttggctaggctggtctcaaacgcctgacctcaagtaatccaccagcctcggcctcccaaagtgctaggattacaggagtgagccaccacgcccggcccttttttttaaattgagacagagtctcgctctgtcgcccaggctgaagttcggtggctccatctcagctcactgcaacctctgcaattctcgtgcctcagcctcccaagtagctgggactacgggagcacaccaccacacccagctaacttgtttgtatttttagtagagacagggtttcaccatgttgttcaggttggtctcaaactccttacctcaaatgatccacctgcctcggcctcccaaagttctgggattacaggcgtgaaccactgtacctagcccccaatgttaattctatgtttaacattttgaggacctgccaaactggtttccaatggattgcaacatcttgcatgcccaccatcagtgtatgagggttccaattttttcatatccttgttattgtctatcttttttagtttagcccttctagtgagtgtgaagtggtatcctcttatagttctgattagcatgtccctaattaacaatgatgttgggcatcatgtacttgttggcctttgatatatcttcttagaagaggactaagtgccctttggacgttatttctttgaattaagattgttgcaatcactgaggacactgagatatggagtctgtattacttgcccaaggacgcccagctagtaagtgtcagtgtcaagatgattacatttgaatttaaaatggagtcgattaggagatgaaattgtctgacattgaattaaggacacactatatggacaaaatgttagtttaggtctgtaactcctaaatcctgtgaccaagaaaatagctaagactcatttaaaaaataaataaatgggccaggcctggtggctcacgcctgtaatcccagaactttgggaggccgagatgggcggatcacctgagatcaggagttcgagaccagcctggccaatatggcgaaaccccgtctctagtaaaaatacaaaaattagccgggcgtggtggtgtgcgcctgtaatcccagctacttgggaggctgagacaggagaattgcatgaacccaggaggcggaggttgcagtgagccgagatcacatcactgcattccagcctgggcgacagcaagactctgtctcaaaaagtaaaataggcaacacggtggctcacgcctgtaatcccagcactttgggaggctgaggcaggtggatcacgaggtcaggagttcaagaccagtctggctaacttggtgaaaccccatctctactaaaaacgcaaaaaaattagcagggcgtggtggcaggtgcctataatcccagctactcgggaggctgaggcagagaattgcttgaacccaggaggcggaggttgcagtgagccgagatcaccacactgcactccagcctgggtgacagagcaagactccatctcaaaaataaatacataaaataaaataaaatattaaataaataaataaataaataaatggggccgggcatgatggctcatgcctgtaatagcagcattttgggatgtggaggtgggcagatcacctgagatcaggagttcgagaccagcctggccaacgtggtgaaaccccatctccactaaaaatacaaaaaattagctgggcgtggtggcaggcacctgtaatctgagctactcgggaggctgaggcaggagaatcactggaaaccgggaggcagaggttgcagtgagctgagattgtgccactgcaccccagccttggcaacagagcaaaaactctgtctcaaataaataaataaataaataaataaataaataaatgaggtggtcagagagctgctgggaaaataaataaagcaatttaatttaatcctaatatgtagttactatgattagattccttttctgcgattttatgtaaaccatcattcctctttttaagaatcaagtgggtacagccccccagccccctcctttctaataaaactgtatcttctctttctagtctatatccttttcctcccagctcttgcacggtgagctgaagggttcgtgctgaagtcctagttggtgcctttgcttttacttttttggctttttccattttgcaagagctgtgccttggctgtgatctccatttttgtgggtgctcattggtctgcgctatcgacatttgaccacctagaaactttggagttttgtttaaatccacatcaagccagctcaaacttccttagtgatttttgctgctttaaatactaccttttgtgttcctgagcttgacaaacttaggacagtttctgacagggtttcatgttcttttgtttttacctcgaaggattcataactgtgtctctttctagtattctccttattaggaataaagcgaacttcaaattcctatgatcgttgcaatcctaacctccttcgtgccttgtgaaaaatcataacagttttcatgaagggtaaatcagtcacccttgtagaattttccattcaaatcctgagccatgtgaagctgtttttagctgctttcctgagtttagtcctggtctgggagactcaagtgtcttcagctttgtgaatcaggcaaaagccagcagtggaggagggtgtaagacttccttgcttttcagctcccaggcaatacaagggatggttaagatggcagggtaaatgaaattaaagaaaaggcaaggttaagaaataaaatcagttacaatggataggtcactgttgacaagatgtggggcctgaaagtagaaacctggagttgttccaaaggttgcagggtctagttccaagggcagctagaaatgacttgatcttttccccatgtgtaatattttcccgatgtgtgtttttagcttcttaaactgattcctgtaacggcagcctcttttgctgttctttatgcctcactgctgagcttccctgccatgtctgtgcatgctgacttgctgggaatgggttacagatgggctacacgttgatctcagcagcatatacggcaggcaaaacccaggacagttgaagccgtttggccagatacctctggctgagagcagctttgtccattttatctacaggtttcagacaaatgcagttgaccagtgccaacaatgtggcggttaggcccactgaacccctgtgtagccaaaaacctatgtatagcttttgactcccctaaaactcaactactaaaaacctactgttgtccaggcacggtggctgatgactgtaatcccagcactttgggaagccgaggtgggcggatcatgaggtcaggagttcgagaccagcctggccaatatggtgaaaccctgtctctactaaaaatacaaaaaaattagccaggcgtggtggcaggtgcttgtaatcccagctactcaggaggctgaggcaggataattgcttgaacccagggggcggaggttgcagtgagccaagatctcgccattgtactctagcctgggtgacagggtgagactccgtttaaaagaaaagaaaagaaaatattactctttgaagatctataaaatatttaaagatctcagtgagttttcaaccttttattttatttattatattttaaagctgatttttatgaaagcagtatatccttattttaaaaatgtaaacagtacacaaaagattaagaaaaataaaacatgtccatacttcttcatccttctctgtattacatctttttccagagataacattaataatatgttggtaatctatggcacacccatctgtatataaaaatatactttatggaatcattacactttttttcttttatggttcatgattttatgtcctaccttaagaaattattgccatcctgagatcacaaagatttcctttgaccttttattttaaactagttcaaacttactatacttaacaagaatagtataaagagctcccgtataccttttatccatatttcccaacccataatattttgtacacttgcctaatcatatctgctctctctcttattcatatatttttcttaaactatttgcaagttatcccttaatatttcaaagcatatttcctagcaacaaagacacccacccccatgtaaccacagtacaactatcaagtgataagtagcattactatttaatccacagaccctattccagtgtgcatggttatactcattatgtccttcatgaatctgggatctgatcaagaatcttaagctaaactttggccatcatatctctttagtcccctccagtttggaacaatttctcagtctgtctttgtcttccaagatctcatttttgaagagtgcagctctgatgatttctcatgattaaatttaggttataccttttgggcaaagatatggtggaaataatgctgtagagccttataatgatgatgactttttatcacttggctaagatagtgcctgccacatttctccagtgaaaagctaggaagtgtttttatttattactaagtagatatcctgtttatcaaacaatcactctccagttttgccattcattggatcttgcctgactcagtttttactgtgatcgttaccaaatcatgaattttaaataaaattcatccttcttctgtgtttattagttgacattcaactattaggtagagccatcccttctcctgtgtgttggcttatttatttatatctctggggacttagatttatatttattcaatgggttataatccattattctttttacttactttactgctcaaattgtcccagacttggccagtgaaagcctgttcaagctggcttgtgtgttctttcaacaagtcccagtgattctttttggcacaggagatgttccaagctaatcctgcacttaacctgccccagtcttgcaatcagccattctttccaagaaggaagccctggttctactgaatagagaatggtatttaaagatcaaaatctgggaagctgaaacaggaggatcacttgagcctaggagtttgaggctgcagttagctaagatcttgccactgcactccatgcactccagcctgggcaacagaatgagaccctatctctaaaaaagttaaaaataaataaatgaaagtgaacaccacagttctccttaggtcaaaggatttttctgtgaagcagatctgggcactgacaccaagatattcctgggcctcccagaaagggcaccacaaaaggctgctgcaacaagagcaagagcttgggaacaaagccgttcacattcaggtcttgggtcagccattgctacctgagtgattaggggcaaacaccagtgaccttctgagtgtagcacctaatgccagctatcagcgtcatcactcatactttcctggtaccctcttattaccatccactccacttgccagggcagccccctcccactcctggtataatctagatatataaaatcttgtttttgtacttcatataagtggaaatatacagcatatgttattttttctatctggcttgcttttgttcaacattatgtttgtgagattcaccgttttgttgcaggcagttgtatttcattcattctcattgttgcatagagagaagaacccatatttggagacctttttttttttttgagacgaagtctcgctgtcacccagactggagtgcaatggcgtgatctcagttcacttgcaacctccacctcctgggttcaagcagttctctgcctcagcctcccaagtagctcggattacaggcgcatgccaccacacccggctaatttttgtatttttaggagagacggggtttcaccacgttggacaggctggtcttgaactcctgacctcgtgatccacacgccttggccttctaaagtgctgggattgcaggagtgtgccaccgcgcccagcgtgaagacatttttggttgtcagaggttgagggagggaagcaaaaggtgctactggcattagtgggtagaggccaggggtgcccctcagcatcctacaatgcacagggcagcacatcctacaacacacagccctcacaacacggcatttttcagcccaaaatgccaatagtgcccacgctgagaaaccctgctctatagtaactgttggtgggcatttgagtagtccccagtttggctctattatgaatatggctgcagcgaatcttgacttagatatcttttgatgaatatatttcatttctgttgagtaaatactggagaatggaattttgggtcataggatataggtatgctcaactttagtagacattgtattgttggtttttcaaagttgtcataccaattcacacttctccatcagggcatgagggttgctgttgctccatatcttcacgaattgaattggtattttctgccttacttcctttctctctcaatctctctctcttttttttttttttttttttttttttgagacagggtctcgctctgtcacccaggttggagtgtagtggcacagtctgggctcactgcaacatccgcctctcaggctcaagcaattctcctgcctcagtctccccagtagctctctgtctctcttttaatccctttcctacaccgtcttcgaattcagcttatgaccactactcaatgcagcagtgtttattgttaaataattctgttctgtattttgtataatatggattgtgcccagatgtggttgctgtgtatcgtaattagagatggtgtttgggagatgacttgtaaccaaggtttctctcatttaaatataagcaccaggtgtttgtgtattcattttctcccactactaccaccaattagttttccatagtaaattttgctctagtggttagattgtccatcatttgagttcatgtttactatgtatttccaaattatatagtagtttaccccaattttttctgtttgtttgagacggagttttgctcttgttgcctaggctggggtgcagtggcgcaatctgggctcactgaaacctctgcttcccgggttcaagtaattcttctgtctcagcctcccgagtatctgggattacaggtgcccaccaccatgcctggctaatttttgtatttttagtagaggtggggtttcgccatgttagccaggctggtcttgaactccttgccttggcctcccaaagtgctgggattataggcatgagccactgagtccggcctaacattttttttttcttacaatatattaattatagggaaagtagagatagggtcattgagaaaaaaaaatcgagtaattttgctctagtcccttgactcccaaactttggtcctaggatgagtggtttcagctttatctgggaccaaaatgcaaattattattattattattgagacagggtcttgctttgtcacccaggctagagtgcagtggcaccatcatggcttaccgcagccttaacctgccaaattaaagtgatctccccacctcagccacccaagtagatggcatgcaccactgtgcctggctaactttttaatttttttgtaatgacaaggtctcactatgttgctcaagctggtcccaaactcctgggctcaagtaatcctctccctcggcctcccaaaagtgctgggattgtaggcgtgagccaccacacttgtcagaaatgtaaattattaaactcacctggaacctactgaactcttagggcaggggccctgtaacctgtatttctacagctcctccaggtgatgagatgtaaaagtaaagtttgcaaaccactaatcagtactacccttatcctcaagctacagacacacccaatttggctgatagttgtggaaaccaatgttttggtaatacaattaatgagtcagtcaccctcccagtgttaaacaatttccacaagtaaattcagtggtaagtctcatcttgagatgttcattggccgtgacctatttttggcaacttagttttcattttccaaggccccaaatgtcaggattttcatttttccaattgttagatgtatgctaatagaagactgcccctagccacatgcgccttaacatttgcctatttaaatactttgtatactgtcttttgcaagtatttgcttggcatcattcagcatccaggaagtgtttccatcataactttgctgcatcaaaatcaggtgcagattacaccagctcacacagagatggcaagaccacctctggacttgccgcctgggtctttaaaattctgcatgttaaacttctttccccgcctctgagataatttattttttattttttaatttttattatttattattattattaatttattttttttttttgagatggagtctcgctccgttgcccaggctggagtgcaacggcacgatttcggctcacagcaacgttcgcctccctgattcaagcaattctctgcctcagcctcctgagtagctggtactaccggcgcccaccaccatgcctgactaacttttgtatttttagtagagacagggtttcaccatcttggccaggctggtcttgaactcctgacctcgtgatccacctgccttggcctcccaaagtgctgggattacgggcatgagccactgcgcctggctatttttttttattttttatttattcatcttttgagacgcagtttcgctcttgtcacccaggctggagtgcagtggcgccacctcggctcactgcaacctctgtctcccaggttcaagcgattctcctgcctcagcctcccaagtagctgagattacaggtgcccgccaccatgcccagctaatttttgtatttttagtagagatgggggttccaccatgttggccaggctggtctcaaactcctgacctcaggtgatccacccatcttggcctcccaaagtgctgggattacaggtgtgagctactgcacctggcctgagatgagaatttaaaataatgctttgggttctgtgatctagacaacaatttcttttgttgctaattagatgaaaggtatagaaagtaaaatgattgggcccccggagaagcaggattttccccagggaatccaacaaatccagagaatgtctttgttacgggaggattgttgttttagttaaagatgtgctttggaaatgtcttcttccttcatgttagtatcatgatcattatcatgttaaaaaaaaaaaaaaaatttacaaaccacctggccacccagagcagaattacagtcagcactctgtttccccaggtcctgaatccttggattcaaccaacctcagcactctgtttccccagatcctgaatccttggattcgaccttgggcgggggaaaaagagtggttgcttctgtactgaatatgtacaggctttttttttttcttggcattattccctaaggaatacagcataacaactgtttacatagcatttacattgtattcggtattataagtaatttagagatgatttaaagtacaagaaaggctgtgcataggttatatgcaaatactacatcatgttatatcagggacttatgcatttgtggactttgtatcctcagaggtcctggaactcatccctggaacagggacgactgtacttaatacgctgtccaaaatgaattggactgccagcattctctactttttcatgtattactcttaggtcaggggaaaaaacaaatctctgtattttataattaagaatgaatccctgagtcatttgacttcttcaatgacagagcaagccacgtaaaaatacccttccaaggaaagccatcagggagcctcagaatgggtacagtttcaccccatttacctaaccttttctgccagtgcagctgagcctctcaacgcgactttaacaaactctctctgagccagtcttctcagtgccatctttgctttcattcaactttacatgtctagtgttgctgctcaaacctgtgtcccctcaagtcctttcccaactaaaggatggtggttaattgacaatagacaaacaagtctcagaacaattatgagggtgtaatgaagtgtgcattcgtacatgcaattaaatagaggaaagatgcaggagggaatgtgtacacaatcctcctccagctggcacgccctgcctggaggtgctcctccactggaagcctgttgtgtgctcctctggcaaggagatgaagtcccagatttttagtgcctcatgcaaggtcttttccacctccttcactagttgacttagcctggcatgtagcaaactctcagtgtcatctgcctccaacacagttttccccaggtctttcgtaccttggccttcacatgggaagccaagagatgctgagcacatggaggagggcaatcttttccccctttgattattatttttttaattcattgagattctaagtcctctgtcatttcaaagaaaggatactctctttcctttggagctatgttctacatatcatcctaagtggaaaaaaatcattaaataggccgggcgtggtggctcacgcctgtaatcccagtactttgggaggccaaggtgggcggatcgcttgagcccaagagttcaagaccagcttggccaacgtggcgaaatcccgtctcttctacaaatacaaaaattagctgggcgtggtggcacatgcctgtaatcccagctacttgtgaggctgaggcaggaggattgcttgaccccaggaggtcaaggccgcagtgagacatgatggtgccactgcactccagcctgggtgacagagtcagacactgcctcaaaggaaaaaaaccaaacatacctcaaataatgtctgcaaaataaaagactatgaacggaatatggagaaagcctctaagatggccccaggggagtgttaacatgtctagcctgattaattggctagtttgggaataattctatccaaagtgagtgacaaggcatggctggctagtgtcaactttgtcctcagctatagttaaaggcaggcctggagggctgacttgttcagtctcagtagcaaaaaagtgcatggtgtctggataagcaggttgtacagcctattagaaaagaaaggtaacagtcttcctctaatgcaataagggattttttttaaagttctcctgtcaagattttttaataccagaatctgagagtggagaaaattggcccaaggacagacaaaagagctgggaggaaaatcgactatatttttcaacacacaatgccatttgaagtactggattgagtacggaagtattacgaacattcctaatttggttagtgtctatatttcttaatatagtaatgctattaatgtctgtctcctaagtttgtataaatccaaacccccatgttattggccagttggaaacaataatgtaaacagactctgttgcccaaattaagttatgtgcaccgaatgctttgtcaaactgtaactattttaatgttcattctaagccacaaatctttgccaaagaagatactgaattactctcttttgtttaggagtagaatacacaataacctaatatttaaaagtattattcagaagaagaaaaacttaggattgaatttttctttatcataaattttagatcattctctttgctcgattccatagaagacactaagaattagactgaactgctttctcattgtattgttttctacttgacctaaaaatccaggggtgggttatatagagagtttatttaggagactttggtaagggagagagaaaaataatgtacaagctggaaacgcatgaaaaatgtaaacaatgaaagttagaagaatggaagcgacagtgtgctcaggaaatgatgtgtcatttggtcggagttcagggtgcccctgaatcccaggagggtagcacttgctttcctgcccattgtgaaggcaaggaatccgcgtgttgtcctatcaattccattcatggcagggtagagacttttcaaatggaagaaaatgtgcattaaaggacattctttctgcatggggtggggtagtgaacgtgttggggttgaggcacggagttgtttaggtcaggtgaatagtgaggggaaatgggcaggcagtcaatggttaagttggtgttttgcaagccattttaagaggataccaaataaaatgcattaatctacatttcattaaaaattagttggtgggaaagtggaaagttgaagatgagaactttccaagtaaaacagcttcatactccttggccagaacaccactatatttacaaataggggataaaaacacccacttcctaggtggtccataagcttaactgggcaggcatatgacacttctgagcatttgatgccgttctctgggggggttaaagcctgaatgcccaccaaatcccctgtctgagcatcatttgtgaccaagattcaaattatttcccatgaagctctaaggtctcatataactcagtggatgtagctcacgacttcttcttttgaccccagtattctaagacaaacaccacagccgaagctggaagtgagaggagaggggttcgtttcagagtcaggagcccaaggcgccccagcaatttcagaccccctgggacaggaactcctcctccagtaagctcttgttttgaaaaacagtggggtggggccaaaaaagcattacaatggagctgggatggatgaggctttcttttatttgagatgtcacttgtgtcacgtttcctgaaacagcacgttggaaaacagaagctattttctatcccgtgggttgcgctggaagagctgagaggccaggctgtggatccttgccacgaacaacaagagagggcaagtccagccgcctgctaggggactagcaggaagcggcacgcctgccagagctcatcacttcaactctggctttcactgcgctcattccctgaatggcagtaaccagggggcgggggtggcatgggaaatgaaagaaagagatatgggaaactaaatctgccgggggaaagagagttaccggagttttagcaaaacagctagcagatgcaaacggggaggcagagggaggagggaaggctgggcttcagcaacctgccacggggatttaaacaaaggaggtttgagagaggcgggatctggctgtaatatcggcacagggacagagacagcagctggactctcgggatgaaacggaatcgattcccagcgtctccaacagggcaggagtgagtggagtatgttgcaaaataagaactcagagaaacgagtgagtttggaaaaaagacttacagattttgacggtctcttgacatttcacccttctttgaggcatgcctttatcaatgcgttacctcttcataatttctgtctctagtgtaattatttttatcgtcttctctgtgttcaattttgggggagatccaagcttccaaaggctaaatatctcagaccctttgaggctgactcaagtttgcacatcttttatcaatggaaaaacacgtttcctgtggaaaaacaaactaatgatccatgagaagtcttcttgcaaggaatacttgacccagagccactacatcacagcccctttatctaaggaagaagctgactttcccttggcatatataatggtcatccatcatcactttgacacctttgcaaggctcttcagggctatttacatgccccaaaatatctactgtgttcatgtggatgaaaaagcaacaactgaatttaaagatgcggtagagcaactattaagctgcttcccaaacgcttttctggcttccaagatggaacccgttgtctatggagggatctccaggctccaggctgacctgaactgcatcagagatctttctgccttcgaggtctcatggaagtacgttatcaacacctgtgggcaagacttccccctgaaaaccaacaaggaaatagttcagtatctgaaaggatttaaaggtaaaaatatcaccccaggggtgctgcccccagctcatgcaattggacggactaaatatgtccaccaagagcacctgggcaaagagctttcctatgtgataagaacaacagcgttgaaaccgcctcccccccataatctcacaatttactttggctctgcctatgtggctctatcaagagagtttgccaactttgttctgcatgacccacgggctgttgatttgctccagtggtccaaggacactttcagtcctgatgagcatttctgggtgacactcaataggattccaggtacgtacaattccatatttcatgcaaaagaaatgtgtcgtatttgaaagggctttagaataaccagccactttttattaggaagtagaagatgaaaactggaacatatatagttctcaccctagtcctttctaaatgcagaaagatgttcttttttttttttgagactggatctcactctgtggcccaggctggagtgcaggggcaacatcatggctcactgaaccctggacctcctgggctccagcaatcctcccacttcagtctcctgagtagctgggactacaggtgcacaccaccatactgggctaatttttaaaaaaaattttgtgcagacagggtctcgctatgttgcccaggctggtctccaactccacagctcaagctatcctccccatcttggcctcccaaaatgctgggattatagccatgagccaccatgcctagcccagaatgatgttctttatgtgataattcacatgttctagcactactaagtaatacctttccatgctatcacttggtggtccatcaagttctttttcacacatcatcttattacatctttaccacaatagctgttagtccacactggtgttctttctttcctctaaatttgtcaggcttgctcttaccccaggatctttgccttggccaccctcctgcctactccaggcctccacaggctccttccccttagccagatctcagctctcaggtgtcagcagctctgatactccccctcattggccagcacaccactctgtttttcttttaaagagtttattgccctgtggaattaggatatttacctatttgcatgggtttgttcttggtctcctctgcatttgttccatgaagccagggttattttctatctcattaactgctcctcagtgcttagaacagagagtaaatgctcaataagtatatattagatgaataaatcagtgagtgagtgaatgaatggtaaagcatgaagctttactatggcaccagagctgtctccctaagacattgttgagctgagaaatatttggactcatgcatgtaccatattatatgtgtaggatttttaaaaatacattttatttcaaataaaataatgagatcctagcagaaactccttgctttctcacccgaattttcctatctttactaatttaccagaccgattgttttttaaagtgtataaaacatgatgggatttcttctgaagaaaacagcgtgctttggactcaatgaaaaatacaaaatggatctctgatgaactagacagcattattatagcaagagaaaagcaatcattgttctggctgttgggggattgccaagttcgaaaggctggtaggtgctctcaggctgcagggcagggcctgctgggcgataaacacgccggcattctctggaaaataccatgcctggtgtttgaatcccagggtgactttcctggtgaatgcggctcactcgtatgctgcgcacactgtttccgcacctgcctctgcctgggttcatcctctcttcacctttgatctgttgtttccaccattcgcatatcattgaggagcattaggtacttaggagctgattttcatatttaaatatttattccctttctattttcattctttccttaaaattcataaaagttgggtcccagtcaagtggttccttaagtattgtgctgagatgagggcatttcataagttaacaaaagtctaaattgttgctttttttttttttttttagaaaaacatgggttttggtttctattaaatgtaaatatctgtggttattttgccagaagcctggtcagttttatcaatgtcaaataatataagaaaatcaagggaaaaagaattccccttttttccttacccctttctgatctcttgggagaccaaaagaatgatatctggataggtgtaggagagaatgctatctagatgggtataggagagaacgacatctacatgggtagaggagagaatgctaccttttcttctcttttttaggagagagaacaccttttttgctgtaggtttatgccatggcatgctggcttctgccttctcactgcaacagtgtggccccatgtaaatcatagaacctcatgggacctcaaatctctccagctacaaaatggggaacccaggtagaaagacccctttcattcctacacatacctttctttgcagaagacacaatgcctagaacaatgtaaagacctcccacgctgctagtgggaatctatagagagaaaggcagaagggctggtgagcctggatcatgtactgcccatcaactttggcaagcgcatcccatttcccttgcaggaattagaggcgagagctcctccagagagcaactgcctggagaggaaggccattgcggtccatgtcagtggtctgtcctgtctgattctgcaagggatgcctttcaggataacgtgccatgtcctggggctttgtttctttcctttcttagactctgggcaacatcctggttcagggagaaaggatatcctgcttctaggtaggccttcacaaattacaagtgaattacagcaaacaaatcttcaaatgctctagccctagtagtgcctctctctaccttcaaaggcagtggaaaatctaatcccacgctcgagtaactcccatggttttacacttgagcattctttgtgatttaagatttggcatgtgaatctggttcttatataaccacacagccgttaatcaatatcagctcttctattttttttgagacagagtctcactctgtagcccaggctggagtgcagtggtgcgatctcggcttactgcaacctctgcctcccgggctcaagtgattcttgtgcctcagcctcctgagtagctaggattataggcccccaccatcacgcccggttaatttttttgtattttagtagagacggggtttcaccatgttgcccaggggtagtctcgaattcctgagctcaggcgatccgcccacctcggcctcccaaagtgctgggattacaggcatgagccactgcgccgggctgagctcttctattttcaatgtcatgttttaagaggaaaaattcttctgtccgtacagggtaaacatctttttgcaaacgtgcaagtgcaggtggtgctgttcatttcttccctcaaagcgaccgcctccctttctcctaaataccttaaattaaaatgtgttagcaagaccctgtgcaggcatttcaggtttcccaaaacacccccaagagcaatgtgaccgagaaaatgattagtaccttagaattagatggtttcagaaaacaaagtgaaaatcggttcgaattggcgagactgaatagaagggatattcatagaagtagcagtaaatcacagagcttcacactgccttttttttttcttggtgcctttctactgagagtgacttctcttttggttttcaaccactaggctctctctacactgttagaaatggtgatacaacaggccagaaagaggtccttaggggccccagtctctcactccttttcaggggaaccaggtaaagtggttgtccttctcttctgtgtggcttgtgcacagatggggtgtctagccccctcccttctgcttacattctcaaaggaaattctccaggaccacagatttctctgacccacgttacagagcatcaggctgtgacagccgtaacttctgacttccggtacacccttatattttctaacatctctgagctttgtaatgattgctctaagtcactttaagaaaaacccatgtgctctagctctcccggctcttctttcagaattttcttttctttttctttttttttgagacagagtttcactcttgcccaggctagagtgcaatggcacgatcttggctcaccgcaacctccgcctcctgggttcaagcgattctcctgcctcagcctcccaagtagctgggattacaggcatgtgccaccatgcctggctaattttgtatttttagtagagacggggtttctccgtgttggtcaggctggtctcgaactcccgacctcagccgatatgcccaccttggcctcccagagtgctgggattacaggtatgaaccactgtgcctggcttttgcagcattttcatctgcctatcttccccaaggcagagcacctgaagccatttaatttttgctttacgctttgtgaaattgttcagcatctacccaagtggccgctggttgatcttcttcccagtccattcccatggctagaatgtcttcttacacttcagggtggtttcgtctctaaggaacagagctaccccactctttggcttcagctcctgtttttccctcgctgcactaagtgtgcttttggagtctttgctcattcattactctgacctttctcatgccatgatatttttcttccataagaatgttttcatttatttcgtttcctttttccattttgtatacgttttcctttttttttttcagggcccttttgtcaaattctctcaacctcagaagggatcacatgatcccatttcctcattttttaattctaaaaatatcgtgtttcctactttgatttattttgctttttaaactgtgacttttatttatatgtgcacattctttgggagggtgttaggactctttcggttgcaagtgtcagaaactcaactcaaaggagcttaaacaagcaccagaagttaccgggtcacacatctgagatgcccaagggagctcccaatcaagctggatcagcgagtcaaaccgtgtgctcaggaccctttcttgctaggtcatctccctgtggggagaccaactgtcccagtttgcccaggtctgaggggcagtcctgggcatgggaccttgatgggtacaaccaggtcgagatggtccccctatctctctgcatctctgtgctggcttccatcaggcaaattctccccagaaagccagaagtagctccaagtgtacttgcttttcacagtggttactcctgggggacaagaaatactttttcctgagagttccagcggcagcttaagggagacctcagattggccctgcttggtccaaattcccatccctggttgggcacggtggctcacaccggtagtcccagcactttttgaggcccaggcgggaggatcccttgagcccaagagtttgagaccagcctgggcaacaaagcaagaccctgtctctacaaaaaataaattattcaccaggcatggtggtgtgcgcctgtacttccagccactcaggagaccaaggcagaaggatcacttgacagagtcagaacttctctgaaaaaaaaaaaaaaaaaaaaacaaaaaaaaacccacaaaaacaaattcctatccataaacaaatcacaggggtgaagaatgctcaccaacatttcttgggtcccttttctaccctgaagccaagggctggggacaggctttggtggaggaggctgctcagggtgacgctgggcagagcaaagcacaggcccactgcaggacaccctttgtcctacactgggtggcagggtgggttaagggttgttaacaagcagcactttgggagactgaggtgggtggatcaccagaagtcgggagttcgagatcagcctggctaacatggtgaaaccctacctctactaaatatacagaattagttgggtgtggtgcacgcctgtaatcccagctactccagaggctgaggcaggagaatcacttgaacccgggaggcagaggttgcagtgaattgagatcatgccactgaactccagcctgggcaacagagtgagactcggtctccaagaaaataaacaaataagcacatccctcctgtgatattagaggggcaagatttagttttatacatatgggtgtgtgagtggatacaacattaaccatttgtacaattttaactgacctaaccgtacccttttctctcataaaaacatgttcaataataatgtcactctattatatttggacaatgcttaatttgcaagggaaatttcttacacattatctcctttaattcttataaaaccccataagaaggggactgttcccattttacagatgagaaagtttaagatgaaaatatgtgacttagctgggcgtggtggctcacgcctataatcccagtagtttgggaggctgaggcctgtggatcacctgaggtcaagagttcgagaccaccctggccaacatggtgaaatgccttctctactaaaaatacaaaaattagcctggcgtggtggcaggaccctgtaatcccagctacttgggaggctgaggcaggagaatcgcttgaacccaggaggcggagcttgcagtgagccgagattgtaccactatgttccagcctgggtgacagagtgagactccatctcaaaaaaagaaaaaagaaaaaaaaaaaaaaaaaaaaaatatatatatatatatatatatatatatatatgacttgtccaaagacaaatattgcatatgcttaacaagaaatcaaaataaaaagaaacatccaagggaaggaggtagcacatgttatccgcttattttaaattgaacccagtttaatgaattcttcattgaatgattgcaattactgcgaatattctgaagatgaaacttagctaattctaagtcttattcagcttgcggaatggttatataattagacccactcaaaaactttctctttcatcctgatattcagcccattttcctggagattttggctttttcatgtgagcagaggtgcaggaaagatgaaggcaattaatgtttactgaacatgtgcctatgggtttagagtatctcagttgaatctccacaagaatcccatccagtgggtacttaaatccacattttgcaaatatgaagacgggaccagaggggctgagtaatgtgccctgttccaaaagcaggaagcagagtagagaatgtgtgtggcgggcccctcaaattctacatgctctgaactaaactcagactctcccctttgcaagtctctgaatttgacaccattctctgttagctcagacctgcgggctggtctcccttagctctccctaccctcatccctgctgatctggctcttcctggagtgtagaagtcaagggctcaggctccagagtcagagagaaccaggttggactcctggctcctccatcaccagccatgtatcccccgacatctgtcaaccttggtcttagcattgcaatatggcacagatggcagaagcctggaccctgcagccagatggcctgaatgtgaatcccggctctgtcacttagaagttgtgtgacctcggacaaagtacctgacttttgtgtctcagtgacttcatctgtaaaatgggacaataataatagatatcaaatatgtaaggtctaaatgagttattgttattgtattttcatctataagatggatattcatttaataaatatttatggagcaaccagacactttgctgggtactgagaaatagtagtgaatgagacacataaggcccctacctcatggaggatacattttagaaggaagagacagccaataaatagtagagagagagaagccagatcattagagttgatgagaaatgctatgagggaaatacacagggagcaacctactgtagatgaaatgggacaggaaggcttcttggcaatggtagcacatgaactgcctcccaaaatgagagtgagccagccacgcacttgtgaaagaggtcccaggcagagggaatagggatcgcaaaggtcgtgggtgagcctggtgtctgcagagccagaaaagcagcccgtgtggccatagccgagcgaacgaggatgagagctggactgagcatgaggcaggcagtgcatgaaccacacaggcccttgcaggaggccagagaaaaacagatctgacagtgccctgcttgtgggcaagtgctgggcacagaataaacactcagcaaaatggatcttgccacaggcctgttttctgtggagtcctaattagggaaaaggagtcaagctggtgggatcaagggaaagcagagggaaagcagataagctgcaagtccgcctttcttcatggtccaggacacaacctcctgagccaataattcacgattttcccacgaccagctatcaccagacacctgcagattagctccccgcaaccttggcattgtcagtactgcacaaagctctcttcagcatgaacactaccctataaaatctccagcaaggctttgtttctttgcagtcagcttctgctggcctgcccgttgccttttcgcaatgtatcttcctactttcttgaagaaatctacctttctctacctacaacagtcttggtaaattcttcctggtaaattcttttccccccacaccaccggccaagatagtatcgctcccccgtgacacgttccacttctggcgccgtcgtctacccttcttctttctcttaaagttgtataatttcttcctaactagtttccctgttccgtgctttaatccatcctccacagtgacaggatggcctttgtaacatgcacccatgatcatgcgatcacatccctctcctccttagaagctgtgtatggattcccttcccctacggtgtatggatagcatcccagcaccttcaccaaacacagagagctcctcgagatctggcccccttggcctttccagtgacttctctagctgcgcccttccccagataacttgcggatccctgttctgccactcccagccttcctgccctgacgcatgcagtccctctcccgggaggctcccggatgctcttcctccctatcctgcatctgattgatgtgtgcttttttttttttttaattcagcttagagtcacactctgtaaaattcttttcctgattctcactcatctggactcccgtacaacgttgtactattattggtctttttatttttaatctttaaaaaaatttttaggagacaaggcctggctctgtgacccaggctggagtgcagtgataccatcatggctcactgaagccttgacctcctaggctcaggcagttctcctgcctctgcctcccgagtagttgggactttaggtgccaccatgcccagctaatttttaaaatctttatagagatagaatttcactgtgttgcctaagctgatcttgaactcctggcctcaagtgatcctcctgccttggcctcccaaagcgttgggattataggcatgagccactgcgcccaaccatatcagttttgcagtgctgtgttgtatattcctagtgaccttttagaataggcttcaagggcagcagctgcacgggcctatttctgtttacacttagcatacctcgggcacatgagcagtactcaagatgatggagtcccaacttatatttgtttaacctacacagacttaattaaatgcatgcacacatgtacgcttgtgcacgcacacgttttatatgggtttaaatggtgttggccatgctactctgcccttcattttacccaatgagtggggtccagagtaagccaaggagtctgctcattctcttgatggagtttgcttcccaaggctcactaatgttaaaggactgtatatgtctatctcataacatagctcgtctgctcaaacgaacttcttcatctagtgctcattagaagaaacaaccatctggaccaagattaaagagaaggctagacttatgcctataatcccagcactttgggaggccaaggcaggaggatcacttgagcccaagagttcaagataagcctgggcaacatagtgagaccacatctcaacaaaaaaataataaaatgaaattggccaagtctggtgacacacacctgtattcccagctactcaggaggctaaggtggaaagatcacttggccccaggagttggagaccagcctgggcaacacagtgactcatctctacaaaatatacaaaaatcagctgggcatggtggcacatgtctgtggtaccagctacttgggaggctgaggtgggagggtcacttgagccccagagatgaaggctgcaatgagctaggatggcgccactgcattccagccctggcaacagagcaagatgctatctcaaagaaaaagaaaaaagatgaaagggaagactgaccatgttggaatgtggtgcattcctaagggatatctctagaggaatattaacttttaggcctttttccctttactcattgactctgcaacctcacctctgtgtaagatgtatagctactgtacatatttcttggatgtattgaacagctaataattgccagagccagggcacaaattgatctcttcttacttctaatccagtcctctgtctcctgtccacaatgcaatgtatagaatcgatcttttctggaagttgttactgagaaaggcagatagggttaaaagtgctagcaagagaattatcaaagacggaagccagcaaaatttatcatggagttttgactttgccctcgaactctcagccgaaacctcaagataatgaaaaggtgatcactttgccaatgataaatggattttataatccctcactgagaaagttgaatgtaaatgaagagctctgttcttttcatcttcttgcttactgactattgaaatgagacttagctatcggtggaattttggagctactattctcagtgaaattcagaattcgagaaatgttttcaggaaacatcctcctcagttcttgcctcagtttacttcgtggctcttgcagttctttccccctttgtgatctcatttacatctgcagtttctcaccaccacctcagtactgaccattcacttccctgtagtgagctcccaggccttctgccacatctccttgttttttggatatctcttctcgaagcttccacgagtgcctgctgacatctccctactccccacacacccagctttccactcacagtctctgtggtatggccatccttcaagtcagccaacttccccacttctggtaccccaggatccagccagcacattccatacgttttgtctgtgagagttttctagcaagttctacccttcctgttttcatcattactgttcttaactctggcccatcacacctgtcaagcagactattgtcggacccactccaagtggtctctctggcccgagtctccctcttcaaaccattctaacactcttaacatattttgcttcttaagacatagctctaagaaaaacgttttctcaattccaaaagcttcagtgagtgtcaacaacttattgaattattcagtatagacatctcaacatggcaggttggatgtcaaaatctccctgttggagatcccctcagtattacctgtgttaccccaccgtcaactcccattgctgccttccctgaaaggaacccttcagaaaaattaccatgcctgtaatcctgccataggtccttttcttcatgtcaccctctctgtttgtgccattgccttccatctctccatttaaataatggccttgtttaatggtatgtcattcaatggtaacacatcatgtcattggtgtgtcatttaggaagctttttctggtcttattttttcccaattttatacctttataaacctctgttgtaatgcttttatgtcattctagaatctctgcattatcattattaatgtgaatatcgtattaccgcgactagactataatgtctttgaggtcttttgtatttttggcagtccagcatagtgagcattcagtgggctgacaggaaatatttattgaattgagtcaaatggaaataattttaggatgttggtgcccctcagcactgctgcctagtcaacttcaaatcattaccacttgcatcaccccctgccacccactccccccgccacacacacacacacacacacacacacacacacacacaccccctaggtaattttgccaaatcctgaagggtcaacttcaaacagtatctttcagccatgttttctgagacagggtctcactccatctaccaggctggattgcagtgtgtgatcttggctcaccgcagcctcaaactcctgggctcaagctgttctcccacctcagcctcccaagtagctgggattataagcatgagccactgcacctggcccatgttcaatttttctttgacgtttcctaaatgctcctctgttcttgggcaacagcaatgagacagttctcttccactcagtttttccaaagcatcctgcttattttgggaatgcttctcatgctgagcccagcctgggggcagcatctgctccagacaggctgttcttcaacccaaggtccaaccaccatcatagtggaccatttgcagtctcagctatgccctaagcaaaaatatgttaactgctcttctaactaaccatttctcagtgtagtttttccatgctaggactactcataaacctgtctttctcttaccctctgagctcatatggatttcttccttccttccttccttcctttctctttctttctctttctttctttctttctctttctttttctttctttccttccttcctttttccttccttcctttctctctctcttccttccttccttcttccttccttccttcctttctttctctctttctttcttcctgacagagttgcactctgtcacccaggctggagtgcatggcgtgatcacggctcacagcagcctcaacctaccaggctcatgcgttcctcccatgcaccaccatgcccagctaattttgtaatttttgtagatatggggttttgccatgttactcaggctggtcttgaactcctggactcaagtgattcacctgtctcagcctcccaaagtgtcgggattacaggcattagccacggcacccagcatgtggcattctttcttaagtgcttctagacaaagcaataagtggcagaaggctttccccaaatccatttaccttgtgtctccttttgacaccacatttctggagaatggatggatgggagttgggctttcgaaactttgcccttcagctctgtacttttgtgaaatgtattctcccataatcttcctcctcagccaggtttaaaagatcagaacttaactgtgaaaatattggaggatacaacttcagtctttcccgagtaagctggagatactcatgtcatactgataaatttagcttcgtgctaccatcagccctctcttctggacatttcctggttcattttctttctagccatctccttccttagacccaatcttcacataactcttccttcactgaaaatctaattctgcacttggtccaagtctgagctcctccttcaagctctttggggggcctactgaaaaaggccctcctgccttagagtccaaatcccctcttgtgtcctatgtgaaaactactgtccccaagaccctgaagtccttgctatgttttgggccatgtcctagagaggctgaacttgtctctgtctggtttcttctctcccaggattttggtctgttggagttaaccggcttcctccccacttctaagccttgtagatttatctctggtccattatcctaccactttatggactttctttgtcaggtactcagtctaaaccaagcctctcaggtacagttttcccataaaaacagcctcctctttattctatgctgaatctaaaataatgacagcgtttagaaccacaagcggccttagagaacatcctctaatcctagttatacaaatttggagattgtgagccagagagatcaagtggctggctgattgtcctgctccttaaaatgagtttacattttttagcctcactgcctatttcttataaagcttagaatgagcattccatccctacaatcccatatgtttctattaatcccaccccatacggaaagaagatctctcaagttacacgtggtatagagggaagggagtttagaaactgtaatgctatagtagaaattatgatgatgatcatgataattattattattattattttttgagacagagtcccgctcttgttacccaggctggatggagtgcaatggtgcaatctcagctcactgcaacctccgcctcccaggttcaagcaattctccctgcctcagcctcccgagtaactaggattacaggcgcctaccaatatgcccggcaaatttttgtatttttagtagagatggggtttcaccatgttggccggactggtcttgaactcctgacctcaggtgacccacccacctcagcctcccaaagtgctgggattacaggtgtgtgccaccgcaccaagccctatagtagaaattattatctcttcatgttctcccattattgtttgttactaaaaccttcctatatccactggaaaacatctgtgtagttggtataatttaaatgcgttcttttgggttcactgtaaagccatcccatgaatattaatcacttgtccccatgcctcagtggttcacggaaatgtgaagaaggatcacgcagagattttctgcactatagacttagtgatgatttgcacgcctgccccctccacaccccctgagataatgatttgaatgtttcttttcctttcacactgatagttattgtatgtccctaatcagtaataccttcagtagtaattgtctatctgggagtggttaggactgatgctatctagagtgaacaattctccctggtctgccaaagcttctctagctctagtactgaaatcccgtgttctgggaaacccctcagctctgggcaagccgggacagttggtcaccctgagcacctcccaccccattcctgctcacctttccatgtcaggatgaagaattcagtgcccaaaatatttatgttccgcagaactgcactgatcaataacctggaaaaaaaatgatccttgaaaccactcatttatgtaggttacaacatattgaagggtaaaaatcaaagctacaatattagccctgaagaccccaaccaaagtgaacctggactggacctattccatttataacgcttttcccattgtttttgaggagagagtatagagtttaaggatgtcatctaaaaggatagatggcaggccgggcgctgtggctcacgcctgtaatcccagcactttgggaggtcaaggaggccaaggcaggcggatcatgaagtcaggagatcgagaccatcctggccaacatggtgaaatcccatctctactaaaaatacaaaaaaaattagccggacctagtggcgggcgcctgtagtcccagctactcaggaggctgagtcaggagaatggcgtgaacccaggaggcggagcttgcagtgagctgagattgtgccactgcactccagcctggatgacagagcgagactccgtctcaaaaaaaaataaaaataaaaataaaaaataaaaggatagatggctaaatataaaatgtgaacttaaaactacgttacccagtgagagcatcaaatgcaaaaattgtctccagttaggtacaaacacaggatgtatcttggaggcaaatttattcctgatttaatttctaggaaagcagaagaaacgtctgctttttgggatctatccaagccctctgccctaacaaacggtctaaactcaggcaaatggccggctctgtgggaaaggagctagtataagagtggattgaataaactgaaaatgagtccagaatttaataaggctattaaaattagaagttgcaagaaatcactgcctatctctattttaagacttttgtttccatttatttgaaagtgttcggaagatataaaggatgggatgttctagatatggatctctggcagcagctggattgtcaaatagtgtctcttggaacttctcaacttctttttcctcggatgcgacattcggaatcagagaaaagttgttgtgcagaaagacaaatagttacctacgctgttccttgaaacttaacagaatatagtcaaagataaagttttcatttgtgggttttattgttgttgttatctttgcttgggcatttagtgttaacagctgggcagttaacaccagaagggaaagaaattttgtctcccagtggggttgctagggaagtagagaaaagcagtgtgtccctggaagagcaaggtaagttggggtgggggcaggtagtgtcacagacagagaagccatagcaagcttcttcgatttactttccaccacttggataggctttctactactgccttttaaaaattggaaagctaaggcacagtaatttttagaagctttctcagggacccttagcaaacagcagggccaggtttaaatgtggtcttcaactgaaaagcagtggtcttcaccaccatgccgcatattgaccccatcgttagctttttgcaggtgcaccagcaggccagctcactggagtaaccaagtcagatgcagtgtcaaagcccaggctgcaattgggaatgaaaggcagttcccccacactgggctgagactgcccgtgacaatggtggccttgagggcttctgcctatgcttcgggatatttcaggtggcagaagcacccctgcacacacagccatgctgcttcactaaacctaccctgtaaggtggtcagggtgctcaggggcccagatgagccaggtttggcaacagagagaaatgtcttgagatttgtcacgtactaattacatgcaaggcattgttctaaactctttttatatactagcctatttcaatctcttaagaaccctatggggtcagcgttcttaatgtctccattctgtagaagaagaaaggaaacgggggcacgcagaggggctctgcagcctgccataaatggtggcatctgactgccctggcatatctcggactggccaagagaagcttgtccactcatgggttccttgttacctccaccagaaaccagtttcggtgggcatcaggacaacatatatgcatgtgcttatatacctaccaacctctttaactctcaccgccttgtgaggtagtttctattaccttcattttacagaaaagaaaactgaggctatgagtgtaaattacttgcctacattctctacaaatccacccctttgcactgcaacccagatggcacatataaagggggtgtgggtagaaggatgctcaacattattattttccctcatttcacacttcctcatctggaaaaacacagaaattataggtgattgtaaagatcccaaaattgcaaaatttaggatggggggagcatgattataatctagagcagagatcagtgaactatagaccatgggctaaatctgcctattttggtactgcccttgagccaagaatgttttttgtttgtttgtttgttttacagtctagaggtcttttatttttttttaacacctatgatgccatgaattcgtagggaagaggttccagcagctcagcctccttcccactggctctcataaagtgtgctactctgggtggagcaggctggcgcttcagttgaacccaggcacctttctctttgtcttctttctttttctgatcgtttttcttcaagcgtttcaggaagctagctcggctcttagagtgcttaatgtgctcaatacacacattaattctcttggcaagaatcttgcccttaacttgtttgtttacaacaatgccaacggcatgctggggaacactgcagactcttcccatttagccatggtaacacttgggggtgttcctttttgaacagtacccattcccttgatgcctgcaatgtcacctttcttatagattcacatatacgtggccaaaggaacaactccatgttttctaaaaggcttagagaacatacattgggtgcctctcctcttttcctttgtgttcgtcatcttggcaaattaatttttatgtgatgaattaaatcctctttcttgtcaaccaaattttccgtgatagtgtatctcatacagtgtctgtttaactggaagatggtagttctggccaaaaggctgggttgacatttttttttttttttttttggagatggagtttcactcttgtcctccaggctggagtgcaatggcgcgttctcagctcactgcatcctccgactcttgggttcaagagattctcctgcctcagcctcccaagtagctaggattacaggtgcctgccaccacgcccagctaatttttttgtatttttagtggagatgggtgtcaggcctctgagcccaagccaagccatcacatcccctgtgacttgcacgtatatgcccagatggcctgaagtaactgaagaatcacaaaagaagtgaatatgccttgccccacctttaactgatgacattccaccacaaaagaagtgtaaatggccagtccttgccttaactgatgacattccaccacaaaagtgtaaatggccggtccttgccttgagtgatgacattaccttgtgaaagtccttttcctggctcgtcctggctcaaaaagctcccccactgagcaccttgcgacccccactcctgcccgccagagaacaaaccccctttgactgtaattttcctttacctacccaaatcttataaaacggccccaccccatctccctttgctgactctcttttcagactcagcccgcctgcacccaggtgaaataaacagccatgttgctcacacaaagcctgtttggtggtctcttcacacggacgtgcatgaaaacggggtttcaccatgttgtccaggctggtctcgaactcctgacctcaggtgatctgcctgccttggcctcccaaagtgctggaattacaggcgtgagccaccacgccctgccacattttcaaatgattgaaaaaatatcaaaagaaacaacttcgtgacatgaagagttgtaggaaattcagatttcaggatccataaagaaggttttattaggacacagccatgcattgttatggctattttcgcacctcaacagcagggttgagttgttgcaacagagacctagtgaatggcccacagctttaaatacctactacacagccctgtgcagaagaaacactgatgcctgaagtagaatcacatggcaaacatatttgcctcacgttatctgaggaaacagtttggtcgtaatcgtgagtttcctagataattgaagccttcccttttgtgcacagaatagttaattaaaaaaacaaaaatctattcaaggaggctggaattcaggatccagaggaagaagcatttgagagtggaatggaaagacttagggggaggtaggaggaatgggttggggagttccaggatgaaagagggcttttcaataggacagagacagaaagagatttggggagagagagagacacacacatagaaagaagaaccaggattcagagatcattgcaatcagaaaagaggaaaaagtgttgtaagcaggagctcagaagcactcaagaagccggatacagtggctcaagcctgtaatcccatcactttaggaggccgaggctggaggatcacttgaggccaagagttcaagaccagcctgggcaaaatagctagactccatgtctaaaaataataacaataataataataataataaaattagccaagtgcctgtagtctcagctacaggaggctgaagtggaagaatctcttgagctcaggagttcaaggctgcagtgagctatgctctcaccgttgcactccagcctgggtgatagagcgagatctcatctttaaaaaattaaatgaaaatgaaaaatagaaaagaagcactcaggaggctggtgagaattgggcgtgtgtgactttggcctagcaactttacctccctgaggctttcttgcacatcaaatggagagaaatcacacctcgcccaagggggctgctgtgcagtgtgaggggggaggtgacagccatgtagggcagggggtgggctctgcactcagacgcctcccgcggctcctggagttgcctcctctcatcccaggcaagtgactacattccctaccttcgggagctcagccacaaagtgagcagagtgggatctgtcaccctgggaaattggcaagatgctacctccttcctgataggtcaccgagcagtctgcccagagccccaggagcagaagtgctcatgggccaagttaaggggctcgaattccatggttccatggtttgttgaatgcgtttattttttattttattttatttttttgagatagaatttcactctttttgcccaggctggagtgcaatggcatgatctcggctccctgaaaccttcgcctcctgggttcaagtgattctcctaccacagcctcccgagtagctgggattacaggcgtctgccaccatgcccagttaatttttgcatttttagtagagacggagtttcaccatgttggccaggctggtcttgaactcctgtcctctggtgatccacctgcctcagcctcccaaagtgctggaattacaggcgtgagctgctgcacccggcctattgaatccatttaaagcaaacgccaggtcattgtttttgaacttcgtggtggtaggaggtgcaccttaaaatcagcgctttgcataacacttattccttgatttaacccaccaccaccatgaccacccctcactgattcacccaaaagtgggtttatttgttgtcttttctctaacttctgtagttgattgacctcattcaagaaatatctgttgggtacctctgctctgcactgctattttcagtggtaaagagtagatgaaactggccaggcgcattggctcacgcctgtaatcccagcactttgggaggccaaggtaggtggatcacttgaggtcaggagttcgagaccagcctagccaacgtagtgaaaccccgtgtctaataaaaacacaaaaattagctggacacatctataatcccagctactctggagtctgaggcaggagaatcgcttgaatccaggaggcgaaggttgcagtgagccgagattgagccactgcactccagcccctgggcaacagagtgagtgagactctgtctaaaagtaaaaaaaaaaaaaaaagagttgatgaagtccctgtcttcatggagcttacattctttttttttttttttttttttgagacggagtctcgctgtcgcccaggctggagtgtagtggcatgatctcggctcactgcaagctctgcctcctgggttcatgccattctcctgcctcagcctcccgcgtaggtgggactagaggcacgcgccacctcgcctggccaattttttgtatttttagtagagacggggtttcatcgtgttagccaggatggtctcaatctcctgacctcgtgatccgcctgccttggcctcccaaagtactgggattacaggcgtgagccactgcgcccggcccggagcttatattcttgtggaggagagaacatggaaaaggataagcatacaaaaatgaagttaacttagatccattttgttgttgttgttgttaagatcatcacttttgagcacttgtttaaggcagatatctggattaaccacattgaggaactgggaggaggcggagaactggaaactgtgttaagtaggggttgactaaaccctgcttctggtatgagaaagttaagcttatcttcagaatggatgctgaggcaacatcaaactataggaattcaccacactgcataattttgttttaatatgaatttctctgatctctagtgtgagaagagtgtgtttctatatgttcattggccattagttttttctgctttgtgattgtcatgtactctgcctgcttttctctttggttatttaccttttcttattaatttataggctacctcttcacaagaggaatattaacctctagtcttacaaaactgttgtcccaatctattatttctgtattctgtgctattaaaaacaatgactcaatgaaaaaacccactatattaaataaatatatttcagaaatgcatttttaaatagaatgtgcagaatatatgtataacatgtctattaatccatttctatttgtttcactaaatgtttgtattctgcttatattcaaagaaagctaggttggcctgttttcttcacagctttcaagtcctttcatagacattaacttgtttgatctctataagtactagagatattgatctagtaaagtaataaaatggggccaggcatggtagctcatgcctataatcccagcactttgtgaggctgaggcgggtggatcacttgaggtcaggagcttgagaccagcctggcctacagagtgaaatcccgtctctactaaaaatacaaaaatcagctggctgtggtggctggcacctgtaatcccagctactcgggaggttgaggcaagagaatggcttgaacccggaaggcggaggttgcagtgagctgagatcgtgccactgcgctccagcctgggccacagagcgagactccatctcaaaaaacaaacaaaaaaaaaaaaaaaaaaaaaacaagtaataaaatgggcatggagctgtataaatgccggtatccttacaccaaatgatctcacacagctctgcgtttgtagttgaacttacttcacctactgctgtcggcaggggacctgagcctgccagttttgtttccctgttctaatttgtgactttgcatctgcttagctataagaacattttatgatcgtgtctaaactaagatttaacaggctaagcctcagagggatttaaaggatgtaagctttgatgcttaaaccaaagaagacaaaactggcatcctgagggccaaatgccatccttaggggtaagtttgagagtttttctgataaaattcaggtttctcacttctctgaatacactggaaaagctggcagccctgggctcatgatcccctgtggcattaattgccaggggtcaggggggtggggagggatgcaggctctctcattcccagcagcccccacccaatcctcctcaatgtctgctgccctctgtgaactcaccggccctgctcgtctgacccttcaccagcttcccgcactgtgccttacctgcctgtaggcatttgagtgcctgaatccgtcctacaatgtgtgatgattattttggttgcttggagatctgtttttgcttaattcctgcatctcgcttgtggccaaagagtttgaggttgccagccaggcacaactaaagccttagacacagatgaagatggagtggtcttggtggagatgagaggactcatcaaaaagcattgccttaaaaaaaaaaaagattcaatagccactcattctgcagagggtgatgaagaacggcaaggatttgagagtaggtccgactcgggttccagtcctgcccctcccctgaccggcatctgcctcagcctttgtaaactcacctgcagtggaagcagagctcgtggaagattaatgagaactaactcattgtgagggaagagaaatcccagcactgctcagagggccccgcaggcagcccagccctggttttcatgttgagttgagatgatgatgtgttgttagccatagtccttgtgctgtcttcttgtttgtgaccgtaaaagttatcctggggcagagagaggtgggactgatacagaatgaccacttaacaattttcagtctgttgagccaactagagtgggcagagcagaaataatgccctggttggaagttaatagctttgcctgcccaattatttactggaaggaaatgcctgttcaatataccatttgatatattcaaagataccaaacaaaacaaacctactgctagggccagccactcagaaggcatcacatgctagtctcagtctgttcatctaaaccactgtaaataagtcaggacaaatgatgtacatggttttggggttttgttttatgtatgtatttatttattttttattttttattttttgagatggagttttgctcttgttgcccaggctggagtgcaatggcgtgatctgggctcactgcaacctctgcctcctaggttcaagtgattctcctgcctcatcctccctcgtagctgggattacaggcatgcaccaccccacctggctaattttgtatttttagtagagacagggtttctccatgatggtcaggctggtctcgaactcccaacctcaggtgatctgccctccttggcctcccaaaatgctgggattaccggcatgaaccactgcacccggcctcatttatttatttttggatactgctgttttgaactataaatcatgctgccactcccatctgcagactgctttggctacatcatgttgaaagatttcttgagtttgttttgcattggcacttatcagagctccttattgtaggatcaaggcttgaggcaaagagaagggaaaaaaccgactgaacctgcaatagaagacctttgcctctcttttctcactccaactttccccttctgttctccacaagacctgccaaggacaaattttacagaaaagggtgtggttctagtaagaatgaagagacatgaaggcatcaaaatgggttattggattgttcccttcatacagtcacatttctagagtgtgtgtgaatatacataataaaatagtaatatatatatatacacacacttatatgtatatataaatatatttatgtgtatatatgtatatatcatatgtattatatgtatatatttaaaaatacacatgtaatatatattttaaatatgcatacaaaaatatatctcttaaagtacatataaaaaacatttataaatgcatatatgatatattcatatatgtatgtgtataaaatattttatataaaatatatttttatataatatataaaatttattatatatataattatatatatttaaatatataaaatatatataatatatactatatattaaatatataaatatatataatattactatatatttaatatatagtaatattaaatataatatatactatataatatatagtaatattaaatataatatatactataatttaatatttattatatactataataaatagtataatatttattatatactataatttaatatttattatataatatatataataaatataatatatactataatatatactataatatataatataatacatcatatattatattatacatcatatattatatatcatgtataatatatatcatatatatttaaatatatataaactatatataaaatatttatatatttatataaatatatatattttttttcccatgggctaaaggggaggcagtgatggggaagaaaagagtggaatttaacctccgggaataaagcatttgaaaaccttaaggtaaatgctttttttttccattactaagaacagaaatcaaaatatcagttcattatgagggtcagaagtgttggatattttccaaaagagaaacaacaacaacaacaatcatagctaatgcttatggaacatctaccaggtgcccggattcttgccaaaccctcaacaagaggtatctcatttagtcttgacaaccatttgaaataagagccactgttctttatcttttcacagtgggaggacctggttgtgtaaagaggttaagtaactttacccaggcactgtgagcagctgggatttagccaaacagactggcttcagcacctggaccagggagctgtggaattaaggctctggtttctatccagctgaatgacattggggagaatatttttaaaggcctcaatgtgctcatctgtaaaaataacggggttgtgatgggtgatctcaaagatccccgccaactctctagcagctcaccaaattaatatccaaatcaatatccatcgcatccacggcactgttgccattcattcctacagttcactgtaggaagttaaggggtggagtggagcagagagggggcagggaaatggctgcattgtgaatcaaatgttttcctaacaggagcagctgttccaactggcacaagccccggcaggtacgattgctaggtgactacaggagtgagatgggagcagggcccactcttaacatgcctcgtgtggctgccacagttgatcctttagttgaccagttaatttctcccttggaagtgtccttaccgtccgcatcaatccccagtgcacttcacattggctgcgagatcgcttgcagcactgcaagcaggtgaactctgagaaccctctgtaatgcgaccagacctgtgcttttcctggttcccctgaattacactggctgatacttccaggaattctgcagcagccctggtggttttgttctttcttcagaaaaggaagttggagagggggttgggtgggaaggagaatgagaatcctttaagttctttgaaatgacctcaaatctgaggttgtcaggcttttaaagagagccagtaggtagtcactccacatattgtagataatactgtgtcaacagctcaagttatctgaagctctctttgtgaaatgggacccaacttttgctctctgggaacactatcacatttctctctggcatgcaaacttaggtgtgtttgatgaagggagcctgcctctccactcctgtgggtatttcttgcaaggtggagatgagagactgagaaaagaaataagacacagagacaaagtacagaggaagaaaagtgggccctgggggaccggcgcttagtaagtgaggaccaacaccggtgctcacttactctgagtctctgagttctctcagtatttattgatcactatttttcctatcttggcgaggggaatgtggtggggctatagggtgaaggtggggagagggtcagcagaaaaacatgtgagtaaaggaatctgtgtcataaataagtttaaggaaaagtgctgggcctaaatgtacacgtaggctagatttatatttaactttacataaacatctcagtgcagtaaagagtagtattgctgccatgatgtctcacctgtatccataaggcgattttctcttagagtagaatgtatggttggttttacatttgtcattccattcccagggacgtgcgggagacagacgccttcctcttatctcaaccgcattgaggccttcttctttcactaatcctcctcagcacagaccctttacggatgtcgggctggggggctgtaaggtctttcccttcccacgaggccgtatctcaggttgtctcagtggggggaaacctggacaatacccaggctttcttgggcaggggttcctgcggccttccgcagtgcattgtgtctctagttaatagagaatggagaatggcgatgacttttacaaagcatactgcctgcaaacacatttttaccaaggcacatcctgcacagccctagatccattaaaccttgattcaatacagcacatgtttttgtgagcacaaggttgggacaaaagttacagattaacagcatctcaaagcagaacaaaatggagtttcttatgtcttctgttttctacatagacacagtaacaatctgatctctctttcttttccccacatttacttcatcatatgatatcaacactgactctttcatgtaaaatgtcagtcctaggttccttccacccttgtgtcctgcctgtgcccccaagggtgtaattctttgttccctcttcccatagtcagtgtgtgtgtgtgtgtgtgtgtgtgtgtgtgtgtgtgtgtgtgtgtgcgcgctatattctgacacatcattagaatctaaattaatctaccttgttatatttttctgccactgataatcttctacttagtcatgttacaaatgtattttttaaagtaagtgtttgaagagacagggtctcactgtcgcccaggctggagtgcagtgctgccatcatagctcactgcagccttgatctccttggctcaagcaatcctcccgcctcaacctcctgagtagctgagactacacgtgcgtgccaccatgcctggcacacattcatttttcattatctgtgtctgtatgtgcccagaggtacagataacactaaaatgaaaagaggtggcagagaacaggaagagaaagaaaccagaggagccgatatccttaaatgctgtggctcctaaggactgccagcaggttgtggggctagccagaaaaaacagagcctctgattctagaaggcttggagaaagcgtgagaagggagatcagatcagaatagattgatggaagggaaaggcggtgagggtgaagcaagagaaactcggctccagtgaaaaggacccatcattgcattccagaacgtaatttgcatttcatatgtaaatgaggaggcttcctagaggctggactgggctgggcttagctgagcctttgcaaacagcagggattcaaccctggggaactgcagaccaaagtgagagagggacgcaccgcatctccaggcacatccaaaaaggatggacgagacaccgaagcagaggatacaggaggattaaaggattcaggaaagcaagcagccctccggagaagctgtcgaaattcaagactggcaagagaagcaaattcaacctctcacaccgatcatttctcattccctgaaaagaagagattgtttccccagggaagtgaaaataatgaacttttggaggtactgcttttttgctttcactctgctcagcgtggtcatttttgtgagattttacagtagccaattgagcccgccaaaaagttatgagaagctgaacagttccagtgaaaggtattttaggaaaactgcctgtaatcacgccttagagaaaatgccagtctttttgtgggaaaatatattaccatcacctttgcgaagtgtcccttgcaaggattacctgacccagaatcactacatcacaagtcccctgtcggaagaagaggctgcattccctttggcctatgtcatggtcatccataaggactttgacacctttgaaaggctctttagggctatctatatgccccaaaatgtctactgtgttcacgtggatgagaaagccccagctgagtataaggaatctgtgaggcagttactgagttgcttccaaaatgctttcattgcttcaaagacagagtctgtggtttatgcaggcatttccagactccaggctgacctgaactgtctgaaagaccttgtcgcctctgaggttccctggaagtacgtcatcaacacctgtggacaagacttccccctgaaaaccaaccgggagatagttcagcatctgaaaggatttaaagggaaaaatatcaccccaggggtgctgcctcctgaccatgcaattaagcgaactaaatatgtccaccaagagcatacagataaaggtggcttttttgtgaaaaatactaatattttgaaaacttcacctccacatcagctgaccatctactttggcactgcctatgtggcgcttaccagagactttgtcgactttgttctacgtgaccaaagggccattgatctactacaatggtcaaaagatacctatagtcctgatgagcatttctgggtgacacttaatagggtttcaggtaggtactaatttccattctgattgatagattgagtttgctaacattctgctcgcctagagaactgactcatttgaaattattatgaaataaatttaaatacttagaaaactattagtttggttgcttgtagcaacagtgtattgctgactgttgtcttatcaatatgtgtgatatagtgatctaagaaatgctggctgcagtcgccccagcaaaactaactttgattacatagttgctgaattttaactgttgtttgaattaatacttttcgtagtccttgataaacacagctgtaacaaacaaaattgacttttaaaataagcattctagaatttaggagttgaaataggtgatgtttctttcggacggatgttagacatcgctttcattgatgcagtctcattgctcaaagttcatggagctgttacaggggtacttactggttttagaatcttggaagctgcttcggatattcacaaatcaccattctggctgaaacatctctggtttaagatctgaacaagtagccaggtctcagctcttcttgtttctacaaatctaacctgatattttagcctggaggagtgggtaacaaagagttggaacatacggagagagaatctagctacagatgatccaaagagaattctcaatttttaagtcataggtttttattggacattccaatttgcagcttcttgtttttatatactgtgcagtctttggttgtttatgataatttgggaaagcgtccaaggtatgccaggcagctgaggcagaagatagcaccaagctccctcgttggttcaggactgggtttcttttctaaactctgtttcccataggtggtctgtgacctgcgttacgtctttcctgtgtgtccccacgtgcttgttttcaacagtgacccagcatggttgtgggtgactggtggttctcatgagcacagtgaccccgacaagcctcacatacttcctgtctacacacacacactgcacaaccacaccacacatacatacacacctgcctgccattcttgaaataactcccagctcttatgtctagtgtcattatcattggcatactttcaagtgctgtttgaagccacctcttgcctgaaagtagactcaatgcagaaaggtccccaataacacggcattcctaagagctaaactagagtggtggtcacaaaaatctacttagagagggacagaaagaggatgggcaaggtggctggagacgagagaattatgctgtctcatgcgcaatttattttcagagatgctaaactgtcaggtcacaaagacttgtaggaggggtggtgaaccaacatttatcacagtggtgagagcgttaaccctttctttacaatcacctattttaaacgcatgtaaatactgcatgcgtggcatttaatcttatttttgttggtatagttggtgatagcctacatcgttccttttaatgataggaagtcatcgtgttagcctcacgtacagatgaaaaacatgaggcttagagagactgaagcaatagtatgttcacgttgttcacatagcttttcataggcaaagctggaatctgaccctgcatttgtgtggcctgaagtgtgagccgtttctcttgcactaggaaaagaaggaatgagcatttcttttttcctgtatatctaaagcaaatttcctgcagaatcccgaaaaagggaaaggattgagggtgtttggaaaaaatgaggagggctgtggaaggaagtttcacctgatcacttagagctggagatgaggttagcagggatatggtgtgtgtgtgtgtggtgtcccaatatgcttgtgtggtgtgtgtgtggtgtgtttgtagtgtgtgtgtgatgtgtgtgtgtgtgtgtgtgtgtggtgtatgtgtgtttgcagtgtatgtgtgtggtgtgtgtgtggtgtgtatgtgtatgtgtgtggggtatgtgtgtttgtagcgtgtgtgttgtgtggtgtgtgtgtagtgtgtggtgtgtttgtagtgcggtgtgtgtgtttgtagtgtgtgtggtgtgtgtgtatgtatggtgtggttgtgtggtgtgggtgtgtgtgtggtgtgtatatgtggtgtatgtgcgtggtatgtgtatggtgtgtgtgtggtgtgtgtgtagtgtgtggcgtgtttgtagtgtggtgtgtgtgtagtgtgtgtgtggtgtgtgtgtatgtgtggtgtggttatgtggtgtgggtgtgtgtgcgtgtggtgtgtgtgtggtgtatgtgcgtcatgtgtgtatggtgtgtgtggtgtgtgtgtttgcagtgtatgtatctggtgtgtgtgtggtgtgtatgtacatgtgtggggtgtgtgtgtttctagtgtgtgtggtgtgtagtgtgtggtgtgtttgtagtgtggtgtgtttgtagtgtgtgtgtagtgtgtggtgtgtttctagtgtgtgtttgtagtgtggtgtgtgtttgtagtgtgtggtgtgggtgtatgtgtggtgtgggtgtgtgcgtgtctgtgtagacagcaactatgtgaggcttgtcagggtcactgtgctcatgagagtcaccaggtgtcctttctggaaaggatccaccatccctcaaaggcttctgtgctgtctccggggtccatctggagcaggctttggtctgggccagtggcaatgggaagtggcccttggttcatgttctcagagaagctggggagtaagaagcaaccaggcagatttgaaaggtcccaaatttttaaagttttcactccatcagctaccaatgttaatacttccttgtacatctttccagaggtactttattatgtttataggtaataaaactgattaaacgtggagaacattacatatggactttaagttcactacagatatactcagaaaaggaaaaatggtccttattttaggtgccatattgtctgtgagaaacaaaatacagcaaaatgtgtcttttatttaaatacatcatatgcagacatttaagaagctcttttttcattactttgtagtatttttaaagctaggtacaaggaattttctggaccaaagttaccagggacctttgccccacagcatccaaccgcgatgaagtgcagaactcttgctgatagaacacctactattcccttgctccaggctttataatggcttctcctgatcttaagggacccttaaggcttggccgggcaaggtggctcccacccataattccaatactttgggaggccaaggcaggaggattgcttgaggtcaggagtttcagtccagcctgggcaacatagtgagatccctgtctctacaaaaaatttaaaaattagctgggcatagtggtgcatgcctgtagtcccagttactcaggaggctgaggaaggaggattgcttaagcctgaaaaatcaaggctgcagtgagcatgactgcaccactgcactccagcctgggtgacagagtgagactctgtctcaaaaaaaaaaaaaaaatgctaggcttaagctcttcatgtggcatgacttccaggacctggccccccacaccctctgtctctaccctcatttctctttatttgatgcctcatactttatgttccagcaactacttggccccacacttctgcaattttcacctatttttttttttttgagatggagtcttgctctgtcgccaggctgaagtgcagtggcgcgatctcagctcactgcaacctccgcctctcaggttcaagcgattctcctgcctcagcctcccgagtacatgggattacaggtgcccaccaccaagcccggctaatttttgtatttttagtagagacatggtttcaccatgttgaccaagatggtctcgatctcctgacctcatgatctgcccgcctcggcctcccaaagtgctgggattacaggcatgagccaccgcgcccggcctaattttgacctatctttttatggctttttaatgacatcctctcataaagaatgtccttcgtgtttgatgcccttcctgtctaactcttcatcctttatgtctaactctgtctaactcttcatcctatatggcccaccttggaagtcacttcctctggatgccatgtctgatcaccttcctcccagatcgtgtttcaactctgggttctcctggacctaatgccactgctgccagcattgaattgtagtcacctattaactgaatagctcttctaccagacctcctcagtatttgagctccttaagcataagaaaagtgacatctgtctttgtgttctccaccactactcctacgctgcatgcatcactatgcacctgcctgatctgatgatatgcagggtgctagatggatgtggaagggtcgggaggggcaggaatgtgctggagagttctgagaagatgggcagaacctatgaaagtgtaccctgtacctaggatgggggataatttttggtagtagggattggagaaacagtaggtaaaactccacaatggccaggccaacaaatgatatcagtaaatatgagagagtcctgaaagaattagcgagccccactttattccagataaaatgttaatgggatagagtctttccttagaaaatgtggctcccacacagccaacctgggcccatgatgcagtcggattctgatgccaagagaaagtcacagcaggcggcgtatgcagacgcctccacttagtttctgccttccttgcacctggtgtgagtttcttccacacctgccacccactccctcctcctgctagtaccactcccgggctactcacattcatgcactgggcttcttctcacttaatttaatgtagacttctcctgaattgttggcttaggaaaaaaaccaagactataagaatatgagaggctaagaagagacaacaatagaaagaaactcaaaacgtctctccagctctcaacaactgtaaacactgagctatttagaaggtatatgttctctgcaggaaggtcactgggaccttacgtctgggtgtggctgaatcagtcccagtctttttcaaagtatgcattgtgttctctctacatcagcccagactttgaattcagtttctaggaccacaaaggattcattcactcatgctgattggacccgtgactgagaattaattacaaacgttgaatgatggggtagaatcatgtcttaacaaacgtcaccaggacgttcgagtctaaaataacgctacttgggggggctggaggacaatccacactgacatttgtcttgtcaatatggagataaattctggctgaaggagaaattccacaaaacagatacttccataggttcgtatccattgaacagactcttaaaataatatttttggatagccagatgatattaagtatgcataataaatgagaacatgattttcaaaatattgcgttagtgatgtggaccagtctggcttatttaacctcttcagtaaagggctctaggctcttcccaggtcagtaattcaggtaggatcacaggggaagattttaatttacaatgtatcccagctcttgtgagcacctagattgatgggtctacatcataagatgctgggctcctggtagagaaaccttaggcaggttataaagtatttacacagtaaattatgctgacgctatagccatttgtagaatcatttgtgacgtttccagccactggctccattgtactatttgggaaggatcatctccttcattggagaatctgtaccctaacatttctgttcgccacccctaaaaaggaaataattgggaaacgctactcttaatgagctcttttatttttatttgtttgtttgtttgtttgtttatttatttgagacagagtaccactctgtcgccaggatggagtgcagtggtgtggtctcggctcacacaacctctgcctcccaggttcaagcaattctcctgcctcagcctcccaagtagctgggactacaggtgtgtgccaccatgcccagctaattttttcatatttttagtagagatggggtttcaccatgttggccaaggtggtctcgatctcttgacctcgtgatccacccacctcagggtcccaaagtgttgggattacaggcgtgagccaccacgcccagccttaattagctgttaattcctaatctctagaacaacattttataaaacaagacaaattggattaaagtatatattagtataaagtatatataaagtgaatattgaattaagtataagtacaatcatgattggtaaacatctactaagctgaactgaacatgaatttaattctagcggaaaggatgagcattctttctactgctttagaaccggcaagatcatttctccaactcattcatcctcctgtcattccttatcgattgtataagacagttttttctagaagcaggagttgtttttgtctttgttttgttttgagatagggtctccctctgtcacctagactggagtgcagtggcattaatttagctcactgcagcctcagccttctgggctcaagtaatcctcctgcctcaggctgccaagtagcaaggactacaggtatgcaccactacacctggctcatttttaaattttgtgtagagatgggatctcgatatgttgcccaggctggtctcaaactccagggctcaattgattctctcctcagcctcctacaagtgctgagattacaggtgtgagccattgcacctagacagttgtctttgttttaaatgaagtattgcattttgatggcttctaaaaacaataaaatattagtggtatatcaaagctatatataattgatatatgtatatatcaatgtccatagtacaatgatcaatatatactcgacgtctaaattatctcttgaaaatacatatctcttccctatttctctttacacaatacaaaagcatctccttccatcctcctttgtttgagcccacatgctatcaggtaaacgactttggagacagacgtagtgtaagtctgtcctcccaatacttgccaactgtgtgacactggtgttagtttacactgagccttagtttactcatctgtgatgatggagataataaatagtacttagttcccagagaagttgtgagtattaaataagctaatgcatatagtacaggggttcctagacttggccatgcctcagaaccttctgcaggtcctgttaaagcacagatttctgggccctaccccgaagtttctgattcagcaggtctggagcagtccccagaatttgcatttctaacagtttcctgggttatcctgcagcttctcatctgggggccacactttgagaactgctgacacggaccatcttttacagagactggcacatgtatagatttgcagcaaatgccgattctgttcatttccaaccaccagtaaaaataaaaactagttgatataaggaaaagctttatggtgttgattgcatatggcagacttcatgaaagtggtatgcaaataactgatatttgggatgtactcatattaaggatatattatgggctctggagtgagacaaatgcaatattgaattttagctttatctccgttagtttgatgaccttgtgtactctgacctaaaactcttcattttgtagtcacaataatgatggctacttagtaaggctgttttgagaattaaattttaaaaatggggtaaaatgacaggttaggtgtttatccacttattaatgtgaacatttattaagaaaaacctacatgtggtcttgtgttcctacactaatgagatcctcaaggtgttgaataaaagcaatttaaatctcactatagaaggatgtctatgccatggctcaccaaccatataaaactagatgtagatgtacccaaagatggataggaggaaatgtgtaaagtaaattgacatgttcaggtggataccagttccttttttttttgagataaggtccctgctctgttccccaggctggagtgcagtggtgtgatcacggctcactgtagcctcgacttcccaggctcaagcaattctcccacctcagcctccccagtagctagaactataagcctgcctcaccatgccctgctaatttttaatttcttgtcgagtcggggttttactatgttgcccagactgggatatctgttcttgatcattttgatttccattagtgttattgatgtactttttatgaccaccaaaaagcttcacttaccccttacataacactatgaaatgtgtattatccattagaagagtgtttccttaaaaacatgaaggatgtcaatgctatctatttttgaaatcagtcatatcacaggaaaggagcaggaattgtgttgctttattttctttctttttttttaattttttgagacggagtcttgctctgtccccaggctggagtgcagtggcgcgatcttggctcactgcaagctctacctcctgggttcacgccattctcctgcctcagcctcccaagtagctgggactataggtgcccgccaccacacccagctaattttttgtatttttagtagagatggggtttcatcgtgttggccaggatggtctcgatctcctgacctcgtgatctgcccatctcggcctcccaaagtgctgggattacaggcgtgccactctgcccggccggttggttgggttgctttcttttcttaagccgtaccatgttccagaaaggacttaagatgtcataatataatttcttgggaaaggaaatcaacatagccaagatctgaaaaaaaatgagagccttttcacaattattctatgtaggttttgactggcttggccacatcttcccattttgagtgtttggcttcctcagtgttaaaacaaattttgcccatcctctttgcagaggagtaatttttaaactctaatagaaaaacttataaacacacacaacagtgcagagaacagtactgtaatcctcacatgcccatcagccagtttcgacaatcatcaacttgttatgcaaactcaaagcaaaaaaaccgaaaatgtatgacaaatctttgagttgacactataattctcataaataagtagcttcctcttttcaaagaaaatgcaaaattctgatattccagactaaggctttctcctcatcccataataacagttcactgaaaagtaaaaatatttttatccaacttcaccttttaggctatactacatgaaccggactgagttttctttttctttgtttttcagcaacaaagctgaatctacaagcacaagctctttaggcattcaaagtaggaggcagaatgcggtttgttaagatttccattcagctgggtgcagtgactcacacctgtaatcctagcactttgggaggcctaggcgggtggatcactaggtcaggcattcaagaccagcctggccaacgtggtgaaaccccgtctctactaaaatacaaaaagtagccaggcgtggtggtgcatgcctgtaatcccagccactcaggaggctgaggcaggagaatcacttgaacccaggaggcggaggttgcagtgagctgagattgcgccactgcactccaggctgggcaagagagtgagactccatctcaaaaaaaaaaaagatttccattctcttggcctccgtttttctggaggaaaaatgggaaggagtatggtactaagagtagaagattggttagtggggtacactggtatcccactgtatggttagtggggtacactgtttcctgtgtatccctctaaccattaaagttcccttgttttcatctcttctccagactgaatattctgtttcctctattaaaaaaaaaaaagacaatgagtccaaagtatgtttgaatatagaattgacacgatgatattttgccttcagccaaatctgaatgtattttccattactgcgtattctcacagaggcttctctatgagattcattgttgttaatttttcacatctgtaatttaatttgagatgcctcagttattaagttattaagcctcgttactttgcatgaggtctttgatcttgcagcgtgatgtggatgaaagaatacaaactttggaataggacagatcttttgaatcctaggcctcactacttaacagcttgtcagtcactgaacaagttatttaaccaaactgagcctcagttaattttggttttaggacattaaagaaagtttttaaggtgtttgagaatttattagaaagtaggaattgccttttttttttttttttttttgagacacgatcttactctatcacccaggctggagtgcagtggcatgatctcggctcactgcaacctctgcctcctgggctcaagcaattctcgtgcctcagccttccgagtagctgggactacaggtgtgccctaccatgccaggcgaattttttgtatttttagtagagacggttttgccatgttgcccaggctggtgtcaaactcccgagctcaagcaatctgcttgcctcagccccccagagtgctgggattataggtactagccaccacgcccggccaggaattgtcttaattcaacttccaccccataaaatatatctggaattggtctggagacagtcttatagcagtgactacgacttgctaacatttcttttcaaagatatttgtaaaagggctagaagaatctctgggtgtctccaaggctatgagggtttttgttgttgttgttgttttgctttttttgttagagatggggtctcactctgttgcccaggctggtcttgaactcctgggctcaagcaatcctctcaccttgtcctcccagagtgctgggattataggcgtgagccaccacgcctggccaggatgtgagtgttgatgaccccagaagacactaaggattggaacagtagctcatgaactttgactttttaaacacttcacactgcacagttaaaaacagtagaatactaagcaaatggaaagtaaggattatgagccatgcgtgaatgtttaattttctttttttaaaaaagtgctttcgagtactgtgtaagagaggctagtgacttagatacccacactatacaattctgttctaaattttaacctttgtctgtagataactgtttggccttgggcatgtcacttaacctctctgggcctcagtttcctcatgtgtaaaatgaggaaattgggctaggtcatctccgaagagattcctgtattattttgctttaactctggagcatgcagtgaaaaaagcagaagtatttgaggcaggcagacttaggttttgtttccctgctgtcagatcttgagcaattaacgtatcttaacatgggcttccggtgacttatctgtaaattgaggacaataccaatttcatgagattgttgtgagagttacagactatgggggtatatctcccctctcagccattgttaattcagttatcacctccatctctcccccttctccctctccacggtatattaatgtcatgacattcctatttatattacaccgtggacagtaggattaatgaaacaatggcctctgggcattgaatttctctctttgtcacggtcactgtgtccacatctggatgccaaccaccactactgctacaatgtagaactcaggccagccaccctaggcagtgtgtgggggtgatttttgtgctgtaaaattctgaccaaaggaggaaactgagtaccaagtacttacacaatatcttcacctctctgattgttcttaatgtagcacatttccccttgtttccaagagtattttctcgatgtgcccagggacgctgagctggacaaggctagtgtagtgtattcagtgctggggagggaaggggccctctggagccggatcatttggcttccaatccagctttgcagattcctagtgtgtgtgacgtgaggctaattatgttctctctctgattctcagtttctgtatatgtaaaatggagatactaacattacctaccactgtgcaaatgaaatgtatgaatacatatcaagtgcctggaatggcgcatggtgcctagtaagtgtaaataagtgttgtatttattccacccaattgccctcgttaaggggaaaattagcaatgaacaatttccccttgttaaggtgctagaaaaaatgcagtcccccaaagtgccattacaaagggtctggaagattttctgaaactcagacaaaagcagcttgaattccctccgtccctcagcttcccatagtaccagagctcatcctgcacaaggaatgagaggagcagagtaactaagaatctggcattggtgagtgggatcgattgtaccaggtgcgctgttcacaggcgcgtcagtccacgtactgcaacgctaggaaacacagggagccaacagcaatcccaggccagtgttaactgactcttgaaaagagaaaacctaacaattcccaaataacctgaatcttctctgtgtctacctcagtaaaatatgtggtgttgtttccaccagaatgagggagcacctgaaccagactgaaaccgggtgtttcagtgagaggcatcttgcccatctccctatcagcttccatctattgtatcccagcggaggtaagagcaggagacagtgtgccgtatgaattagacatgaggccatgtaccttcagagtccgccagtggtccccagagaattgagagctatggtagaatgaagacggtagcttcccctctctccaagagtagggggctcacatcatggcttcttgtagcttacgatcttggacagatcttttcaattctccacactgggttttctcagccaaggaatgataataactgctaatctcatggtggcaaaggaggagaaggcacatgctgtgagccatgaattatgaactctttaataacttataactcattaattctaaagccaagagcatcactcctggcacatagaaagaggaaggttgtggtgatgaagtttttttgagtggaagatatgaaagaagcagaaactcaggctccttcaggaataacagaatgattttgtgaagtggaatgtgtaatcctgtgctggggttggaagggatactctcatcatttaaagtggagaaaccaggcacagggagacgaaatgatttgtctgtgttgcatgatttagcagctgaacctggccacaaagataagacttttaagtccttcaagacaataatctttctatatttagtgcttcttataatttctttctgaaatgtcatagatatctgagcaaaggggcagtatgaatattttggtgtctatactaatactgaaatttgggtttcaatgacaggattcttaaaaagtgttcagaatttatgggaaaagagtgcatatcaatattacatcaaagtcttataggtatactatataatacagtttttgaaatgtatacatttaccataaaggagatccgttctgttttacattgttgttgattttgaagcagcttctttgtattctttaatttatatacatacagttcactctctttagtgtgcagttccgtgtgttttgatagtggtatagagtcacgcatccactaccgccatcaagaacaattccgccagttcccaaaattccctcatgctgcccctgggagccaacccctacccccagtgtccccttgccaaatcctgacctgttctccatccctgctgcttgccttttccggaaagtcatatttttatcatagcgtatgtagccattgagggctgagaaagcgctgctgcttcttctttcttttctattaatgaatgccttttgtatgttacaaggtgctcgtgagggtctctcttagatcctcaggcagttttatttttatttatttatttatttatttagagacagcatctcattctgttgcccaggctggagtgcagtgatgcgatcttggcttattgcagtggtgcaatcttggcttattgcagcctccacctcccaggcttaagcaatcctcccacctcagcctcttgagtacgtgggactacaggcgcatgccaccacacccagcaaattttttgtattttttgtagagatggggtttcgccattttgcccaggctggtcttgaactcctggacccaagcaattcacctgccttggcctccctaagtgctgggattacaggcatgaaccaccgctcccagccctctggtagttttaatatctattgagtattggttccttttgccctgcttttctttttccatgttatttgttttgcccataaataacagaagcagctgggcccgttatttttttgaaaaagtagggctattcttagtaatattattcatttggggcaataaactaaaagtaagtacagcatttaattatgtaattaaacttgtacttttattacctttgatttttcaatatcagtgattcagaatgaatagtagaaacaccgtgaacttaattggaagaacaagaacaaccaaaagtgtgtcccacttttattctgaaaacacatgtgacagactcataaaagttgccatcaatcaatcagatcatacaagagcatcatggtgagcatgccacaacgccccagtatggtttcttatcagaattcttacaggaaaaactctgcttaggtttgcagatggctcaatggtttattttttcctataaattgaatatattagtcattggtcttgatctgaagatgtccataattctgtttctaaaatattcaagtatttaaaagtaaagcccttggccaggcgcagtggctcacgcctgtaatctcagcactttggaaggctgaggcaggtggatcacaaggtcaggaattcaagaccagcctggccaagatgatgaaacccccgtctctactaaaaatacaaaaattagccgggcgtggtggcgggtgcctgtagtcccagctactcaggaggctgaggcaggagaatggcgtgaacccgagaggcggagcttgcagtgagctgagatcatgccactgcactccagcctgggcaacagagcgagactccatctcaagaaaaaaaaaaaaaaaaacaaaaaaaacactaaagcccttgatgccggaaaactggatactggaaactgccactgcagtccctaaatcagccctaggcagaggagagggtacgagggcaaaccactgaagaggccaacatttctttgcagtctcattgctttattttacaaagttatttaaatattacatttctgtctactctataacttttgtaaactttttattgcaatataatcctatatacagaaaattgcacataccagaattgaacagatcactgaagttttacattgctcttacctgtatgcacagctcaagaaaccatgttcctggtactcctaggaccccctaccccacaagggctccttcccagacacgtccaagattaacagtggtcctgactgcattaattatgtgtgtgtttttgtgtcgctgtgtaacttctaacggaagcccagggcttttcatccaaatgtccaggttaaatgggtatttcaggaagaagtgccaggcctaggttatttgtagaataagactgtaaacagaactgccctgctgttctttataaaacattaggcttgcaatagatagggacttagttcccagacttagcaatctatatatactgtagtacatgcagcaacaaatggaatttaccattgaccttaaacaacttttgacctgtctcggtttgcaaataggggttaaaattaaacaagagtcgtaagtgagcataatttcttacttggctgctcgtacatggaattggagggaaggttttacaagttgtgaatgaattctgcatttatatctagctgggtgcagcctggtgccttgttttgaaggtgaagaaggcactgtgtgcagggcaagatgaaaatttgtctggtggagtcattaagaacttttcccccggttacaaacaaaacagttcagggcaaactgtgttctattgatttcagacagagagacgaccctgctgtgagaggcaaatcaatgctgtacttttatttgaaagagtcagtaaaacctaggaaatgccacctgaaatgcaaaatacctaggtcaagctgtgaacaaacacatctgaataaatagatggcagaaaaagcttattacttgatgttcaagtgctgcaaacaacagaatctctcatttctggaatccaataaaacttaagtcctaaagaggcagtttttgaactcaaaaacccatcaaagtgataaacgtgtacatgagtgacgcctcacctcatttaatgtaaggaaacctcatacatctcaatggtacaggtcccttgtaaaaggttgttttcaatctatgttcaatgtaggttagtcagctatttaatagttacgttattgtcataagctcacatggaagtatttctttgtctggaagatgttttatgaaatggtattttcttccctttttttctgccattggaagaaaactttaatgttattcacagttgccctagaaacaagaggcactgcgcaccacacagcgccacggtgggaagcacccgtgtcagtccagatgcagacaggggagggaaagacataagccacagtctttttttatttttttgagacagagtctctctctgttgcccaggctggagtgcagtggtgcaatctcagctcactgcaacctccgcctcctgggttcaagtgatcgttgtgcctcagcctcctgagtagctgggactgcaggcgcctgccaccacacctagctaatttttgtattttagtagagacggggtttcaccatgttggccaggctggtcttgaactcctggtgtcaagtgatccacctgcctcagcttcccaaagtgctgggattacaggtgtgagccactgtgcctgacagtcttttttttttttttttttttttaataatgctatcttaaggtttttgtttgcttgtttgttttttggtttgttgtttgtttgtttgtttgtttgttttgagatggagtcttgctctatcaccaggctggagtgcagtggtgcaatcttggctcactgcaacctccgccgccccggttcaaacgattctcttgcctcagcctcccatgtagctgggattacaggcgcacgccaccacgcccggctaatttttttgtattttagtagagatgaggtttcacaatgttggccagcatggtctcgatctcctgacctcatgtgatccgcccgcttcggcctcccaaagtgctgggattacagacgtgagccaccgcgcccagcctatgctttcttaatgattgttacttgtaggtattagatttcataatgtgtttttttatttgatctttgttttttgtactttaatgtattatttgaaattattctaataaccactgtcctatttggcagaagttacagaataatagttttaagagaaaataagtaaagactcacaaggtaaatatgccaaaatgctaacactagctaatttgagggagttggaaaataaacaattggctacttctttgaacttttctgtactttgaaaatctccaagacttaaagaaagttgctgtatttggtgaaaaataaactctctccttactgagacataatacttggtgctttagtgctatagataatactatgaagtattatctctgggccaggtgtgctggctcacgcttgtaattccagcactttgagaggccaaggcaggtgggtgtctcaaacccaggagtttgagaccagcctgggcaacatggtgaaaccccatttctacgaaaaatacaaaaattagccaggcacggtggcacatccagctagtcccagctacttgggaggctgaggtgggatcacttgagtctggggaggttgaggctgtggtgacctgtgattgcaccactgcagttcagcctgggtgacagagtgagaccttgtctcaaaaaaaagaaaaagaaaaagaaagaaaaatgtattatctttataaaaaagatgttcaataaaagacttctatgaagaacaggtattcctagcccaggcaacatagcaagaccctgtctctataaaaaaatttaaaaattagctgggcatggtggtgcatacctgtggtcccagctacttgggatgctgaggtgggaggatcacttgagcttaggaggtgaaggctgcagtgatccatgattgcgccatgtgctccagcctgggagacagagtgagatcctatctctttaaaacaaaaaacaaaaaacaggtgttctcaaccttaaccacatattgctttcatgtaggaatttttttttttttttttttttttttgagacagagtctcactctgccacccaggctggagtgcagtggcaaaatcttggctcactgcaacctctgcctcccaggctcaagccatccccctacctcagcctctcaagtagctgggacgcacagtaccacgcctggcttttttttttttttctttgtagagacagaatttcatcatgttgcccaggctggtcttgaactcctgggctcaggcgattcatctgccttggcctcccaaagtgctgggattacaagcgtgagccactgcacctgaccatctaggatattttaaaaaaataccaatgtctgggccccacctccacccaggtattcaaaatgcctgggagatggggccctgtcattggtacttttaaaaagttccatagatgattctaaaatggcagccacagtgaggaaacgctggtacacatgaaagctagcgtcagggataaaaaccgaagaatggaatttactagtttgttgacttggccctcatttattccctaccatttgcacctgctatctactttgtaaaagaaaaaaaaatcagttaagattttcctgggaaaaaaagaacttcctaaacttggtggcttgaaaaaagtttttttgtgattctttgagttcttctgatcaaggccagctccactagggctagatggtctcggatggtatcactcacctgacctggcgttctccccaatgatctctccttctctgatgggcttgcctcagctgcttcacttgatggcctcaaggagaggacaagccctggtcaacaaatgttttttaagtctttggccaggtgcggtggctcacgcctgtaatcctagcactttgggaggccaaggcaagcagatcacctgaggtcaggagtttgagaccagcctggccaacttggcgaaaccctgtctctactaaaaatacaaaaattagccgggtgtggtggtgcatgcctgtaatcccgactactcgggaggctgaggcaggagaatcgcttgaacccaggaggcagaggttgcagtgagccaagatcacgctattgcactccagcctgggtgacagagtgaggctccttcttgtcaggtttgctaatgtcccattggccaaaagcaagtcacatggccaaaactagatccaagaggtagagaaacattttccccctcttaatggaaaagctgcaaagtcatactgaacaatgactgcatatagcagtgagacagacacatttgtgaccatcttttgcagcctgccacaacaaatcaaaatatatccttgtttagcagaaacatatgataaagcaagatatttattgggatctcttttaaaaatgagttttttctagttaattttgagaatgtacctttaacttccattaaagaaatttaatggaaatttccattaaagaaatttaatggaaatttccattaaagaaatttaatagtggttgagaaatttttaaaatcgccacctgcccagcagtggtcataaaagtaacattttaaaaataaaatgcagaaaacgataaagactaaaataaaaatcatcactaaactcaatactcagagataatagttcagtatatgttttttatataaaagcatagttttacatgtctttactggtttttataaccagctctcctcatgtattagtccattcccattgcaataaagaaatacctgagactaggtaatttatttattatttatttttattatttatttttttgagacagagtctcactctgtcacccaggctggagtgcaatggcgtgacctcggctcactgcaaccaccgccttccgggttcaagcgattctcctgcctcagcctcccaaatagctgggattacaggggtgcaccaccacacccagctaattttttgtatttttagtagagacggggtttcaccatgttggccgggctggttttgaactcttgacctcaggtgatctgccgagactgggtattttataaagagaagaggcttaattgcctcacagttccacaggctgtacagcaagcaaaatcctggcatctgctcagcatctggggaatcctcaggaaactttcaaacattgtggaaggcaaaaagggagcaagcatctcacatggctggagcaggaggaagagcagaacggggagatgccacacacttttaaacagccagatctcacgagaattctatcacgagacagcgctaggaggacggtgctaaaccactggaaaacgcccccacgatccaatcacctcccacccagaccccagctccaacgctgaggattacaattcaacatgagatttgcgcagggacacagatccagaccatttcacctcacctaacagtatgtcatggctttccatgtcatgaagagtttgtcaccataatttttaatagctctgtagagtgctatcatttgaatgcaatataatttatttagaaaagccctaacttacagacatttggggggtcttattggtaatcagttgttttgttaataaaattgataattaatgatgatagatactttaacagcactatgtaccgagcgccattcagagggttttaagtatattatgtacttcacaataagttcacatggtaaacatgctgcttttactctaattttgagatagggaaactgaggaacagagagattagataacctgtcagtggtctcacagttagtaattgacagagcaggcacttgaatcctgcttaggttcgagaacttgcttaggtttcagaatctctcctctgcctcaaataataatttataaataacttccttgagacagattccaatagattgaaatgctgagtcaaatggtatgcactttttttttttttttttttttgagatggagtttcactcttgttgcccaggctggagtgcagtggcacgatctcggctcactgcaatctctgcctcccgggttcaagtgattctcctgcctcagtctcctgagtagctgggattacaggcatgcgccactacgcctggctaattttgtatttttagtagagacggggtttctccatgttggtcaggctggtctcaaactcccgacctcaggtgatccaccttgcctcagcctcacaaagtgctgggattacaggcgtgagccaccacgcctggcgatatgcacatttttaaggcttttaatccagaatgtcatattgctcttccaaaaattgtaccaatttatactcccacttgcgggtttgagggctccatttcactctaccttttccactatggggcattattattttctaaatctttgcgagcttgataagtataaaaagaggaattactaggtgcagtggtacatgtctgtaatcctagccactcaggagggtgacatgggatgatcccttgaaaccaggagttcaaatccagcctgcgcaatagagcagagacattgtctctaataaacaaacacaaaaagagaggctaccttagggttttaactttagtaacttagttcctaacaaggttgagcatgttttcttatgttagacatttgcataagccaaggtgcaaagagctgtgtgaaaatggaagaccaattcaggaattcccagatgtgtggcaggacatttgggtgtgtgtggacattgttgaaagatgaggcctggaacccagtgttgcaaactacatgtcaacagggccagacaatgtaggtgaatgaaacacgttggggccagggtggccagagagctcctggatgcctaaaaccccggtgaattgttgtcaagggacaataggaattcagacttccatagaaaatctggtttttccatgttggctcaattccaccctactgcaggggtcaaaccaaacaggcctaccaatcaaatgtggtttatgggctcccagtctgctgtttgtagtctggaggtgtcttagtttattttctgctgtgtaacagaatccctgagactgggtaatttataagaaaagaggtttatctggctcctgattctggaggctgggaagctcaagagcacagcagtggcatctggtgaaggcgttcatgctgcatcatctcatggcataaagtggaagggcaagagagcacataagagtgagaaccaagagagggtcaagcttgcttttacaataaatccactcctgtgataatgagcccaatcctgcaattatgaacccatactcaaaataatgacattagtccattcatgatgtcagagccctcatgacctggtcagttcttaaggtcccacctctcaaaactgttgcactggggatcaagtttccaacacatgaattttgggggacacattcaaaccatagcagagggcaagattgtaaaagctcttatgtgttgtggtcagcattttgggatcttcctggccggaatgtgatctatagaactgaagtgatgggtctggccagggttataattctgaggagctggctggggcagtctgcttggttagtgacagtatgaagcaaaggaaagaaatgacagttcagaatctagctcttgagggaggagataagcatgaagctgggtccaggggaacaaatgtagaaatgtaaaatgagaaatgaagtgaggagttggaattctggtaagggtggtaagaggcggcagaagaggtctaggatgagaccaagtctgagtttgcttgtttgttggagggtgagtggtggtggggcatctcaagctggcttgaaaaatcagacacagggtcaaccattcaaatagaagggtgacaggatcagtgctgattataggaagagccatctggtggtattgactgcatctggtggaaatactgcagacagagagacccactggcaggcaattacagtcttcttgatgagagatgttgagcacctgagtgaggactgtggcatcaaaggaaagcaaaaggtatgtgtttgagcaatgctattatcaaccagcttggagaactgctggtagattggaaatccattggcgactcctgtactgtgcaaaatttcaacagtcgtagctggaagggaataactagtgcattaggttaatcgtgaaggtgaaagattttgaagtatggcagggtttagtggagcaaagaagggaacattctcaggctacatgtctgggaatatggaagctgaaggccttcaccacctcaggaaaatctgctataattagaagagtgtttgacaagagctaaaaattataaacagcagagatgcataggcaggcggccaatggaccatgtcagcattgtaatgaaatctgaactgctctgagccaaggattgcctatgtttctcaactttttactgacattgcctagtcttcaccagaagactgtccaagaatgactctggcttgaaggcatttaggctgctactgaagatattaataaatataaattctctagatacattaagctgaaaaccccaagaatatcccattcatggctttacctccaccatctactctggaatgttggaggcatgcaagaaagtatttgaataagtgagtaaattatctggaaacaaaatcaacaagttctttagcacatctgcactcctaaactagagcctagaaaattcacttaaattttctaggctgtagttcacatagcttggtaacgagggggaggcattaggaaatttttgaaatccattcaattctaaaattcaggggttttcctcctttcttcatttcatcttttccttttaaactaaggagtgaatttgttggcagttatgcgagatgagtgcagagatgtcatattaagaatgctataccactgtctcagggactacaaaactagaaacatccacatcaaacaaaacagggtctcttttagtaagtttctcgtgttaaaaatcctaaataggccaaatgtgatggctcatgcctgtaatcccagcactttgggaggccaaggtgggaggattgcttgagtccaggagtttgacagcctgggcaacatagtgagaggagagccatgtctatttgaaaaaaaaaaaaaatcctaagtgatcaattgatcacttgaactggttcaattgatcaattgaaccagtactgggtggaaacaaatatatacttttaatttctttctttctttttttttttttttgagacggagtctcgctctattggcaggctggagtgcagtgacgcgatctcagctcactgaaacctccgcctcccggattcaagcaattctcctgcctcaggctcccaagtagctgggactacaggtgtgcgccaccacgcccggctaatttttgtatttttagtagagacggggtttcaccatgttggccaggatggtctcgatctcttgatctcgtggtctgcccgcctcggcctcccaaagtgctgggattacaggcgtgagccaccatgcccggcctatgtactttgaatttccaaaaatgacccaaattagcaatcagaataagaggctacaagttatttaacactacaattccctgccatttggtaattttccattttttttgttgttaaagttaattgaattattagaattagtcacaagcacaattactaaattaatgaagcaaataaagcttagatgtatatcaataaacttttgtaaaaaatataaaagcaatacaacattaaagaaagttttataagtaaggaaaacactggtatttcctccactcacatttcacatgcaaatatttgtgcatggtttattaatagtatacaatttcatattctggtgtttttgtggggttttttttttgtttgcttgtttttttgattcagagcctcactctgttgcccaggctgaagtgcagtggtgcaatctcggctcactgcaacctctgcctcctgggttggagcaattctcctgcctcagcctcccaaggagctgggattacaggtgtgtgccaccacgcccggctaatttttgtatttttagtagagacaggctttcaccatgttggccaggctggtcttgaactcctgacctcaggtaatccactcctctcagcctcccagagtgctgagattacaggcgtgagccaccgcgcccggcctttgtttttgttttaactttagatcaatcattcttaaccaggggtgattttgcacctgaggggacatttggcaatgtctggagagattttggtctgtcacatctgtggttggggacctgctactggcatctagtgggaagagactgggaacactgctaaacatcctaaacgacataggtcagcccccacgacaaagaattacctggtccaaatgtcgataatgctgaggttgagaaaactgctttagattatagtaaaaaaagcggtcttttccacagaaacattatccccatgattttattaaagggattatattttcaaccatgtatttagtggttatgtatgccaggcattgcaaagcactgtacacagatttttctcatttagccctcccaaaaccctgtgaggttttaaagacgagtacaccatgtcttaaagagattcaatagttgttcagagtcatacagttagtggtagcaatgcttgtctctccgacttcaaagctggtgctgtcagttatcgtgtgtaatgtcataatgaacatcttcatatacggatttctgcattttaaaagtcccttccgtagcttattttgaagatattaaagggtcaaagggaattggcagttatggtggcttttcctacatgtttctaaattgattttctacagctgaaccaatttcagcactaccattgaattgtgagaaagccctttcaatatattctcatcagcattgactatttaacatttaaaaacaaaattccttgttttcttaagaaattaaaaagtatatatgtgagcttaaataataagcaatttctggaacttgttaccacagatagttctcccaaaatgaggaccaaactgtgtaagaataatgagaacgtcaagtcaatataaataaagcttgcatttcaaagaatcatgtttaacaaacgcagttatttgactaagaaaggctgagccccaagaaaaacattcctggttactctgtaaactttgcctcaaatgctctgtttatataagcctatgaagagcaaatgagagaattggattttatagtttaaaatgttttctcagataatattgacttttttttttgccctgtcctagaaataatgaaaaataggcctttgctaggattcttgtgaatgaagggtacggtcctacccatactccccataactaccctcccagagtcctgacaaagaatagtgatagtgatcctaacagcaaatataataataatagaatcgagtccagtatttttccaatactagttgtgtcccattagaggatacagaaatcactttagtagtttttgatcagaatttttaagatgaaactagaccagaaaacaacataaaattaacaagtgcatcgcatgtaataagcacaagtattgttttatgaaacttgtttgctttatatacgtgtgtgtgtgtgatggtatacagtgttttttctgtgggttgcagtctaaaaggttgaaaagccactgatcagatttacctacttcatttgagaggtgaggtttggagacgttggatgatgtccagggatacccagctggttagtggcaaagctggaatgagaacggaagttccctaatccctaggccagtgtctactccatcagggtgctcagcctgggatcagtctctggcagcaggcaggaaacaggcttaatagagaggcttttagggagtagagaaggagcaactggacattggcaagagtgatgggactggtagctttgggatctccatgtatctttcagcccaagccaaattaaattacttactgaacagtgagcacattgtacattcagggtcttcaatcttaagcttgccattatctcctcaaaataataaccaagtgatgcttactaggtattcaaattgagctgtcaccagaagtcttgttgaatattttctcacttccctaagcaagttgaaccaagcaggacagatatggagaatggatgattgctgatcacccaggtcattattgaagggcaaattgaaatgggttggtgcttgctaagaaggtagaagaggccgggcacagtggctcacggctgtaatcccagcattttgggaggccagggcgagtggagcacttgagttcagctcaagaccagcatggccaacatggtgaaaccctatctctactaaaaatacaaaaaattagctggacgttagtggcacgcccctctagtcccagctacttggaaggctgaagcaggagaatcacttgaagctgggaagcggaggttgcagtgagctgagattatgccactggactccagcctgggcaacagagcaagactctgtctcaaaaaaaaaaaaaaaaaaaagagaaaaagaagaaaggtagaagaaatgctttttggtactgagaagtagagattattacaccttaagttgccatgtcctattgggaaatcaagacagcatccaggcccgtctgatcctcacaaaacctaaacggtcctccccatcagcactaaagactgactgagtcaatggggccacccttgcattgggaatggacgcgcgttcattcctttaacattggttgagagtctcctggtggccaagtgctatgaagtcaaaggcactgtgagaactggtcctctgctcagtgcagctttttcctataacaggtgggctgatgccttcaaggaggtgatgtgagagatccgttaaaatgcatatattcctagcagtgggaacaagttagttacaattaacccaaggatatagggaccagattcactcacaagagaagattttgagtgagaatagttagtaagagactaacctacaaacctgatgaagactgagggagagaggtcaaggaggggaggaaaaaaggacagtgctgttgctccccaggacaagctgcatcctcctcccagtgttgcttacagctgagagctactcacacttgatcacacacaagaatcttctggggattttgtgaagatgctgacgttggatgttgatacaagaggcctggcgtgggtctcaatttcttttttgagacaggatctcactgtgttacccaggctaaagtgcagtggcctgattttggctcactgcagccttgacctcccatgctcagatgatccttccacctcagtctcccgaacacctggggccccaggcgcacatcacaacacccagctaatttttgtattttcatagagatgggatttctgtatgttgcccaggctggtctgaaactcctggattcaagagatctacctgcctgttacaggaaagggatcccgatccagaccccaagagagggttcttggatcttgcaaaagaatgaattcagggtgagtcttcagtgcaaagtgaaagcaagtttattaagaaagtaaaggaataaaagaatggccactccatagacagagcaaccccgagggctgctggttgcccatttttatggttatttcttgaagatacactaaacaaggagtggattattacccccgtttagaccatagagggcaacttcctgacattgctatggcagtggtgggagtgtagcaggacgaccagagattgctctcatcgccactttggttttggtgggttttgggcggctcctttactgcaaactgtttatatcagcaaggtctttatgacctgtattttgtgctgactcctgtctcatcctgctatgtctggaattggtgggttcttggtctcactgacttcaagaatgaagctgcggactctcgcagtgagtgttacagttcttaaaagcagcgggtctggagtttgttccctctaatgtttggatgtgttcagagttttttccttctggtgggttcgtggtctcgctagctcaggagtgaagctgtagacctttgcagtgagcgttatatctttcaaggcggtgcgtttggaattgtttgttcctaccagtgggttcgtggttttgctggcttcaggagtaaagttgcagaccttcgtggtgagtgttaccactcatataggctgtatggacccaaacagtaagcagtacaaagatttattgcaaaggacaaaagaacagcacttccacagtgtggaaagcaacctaaacagggtaccgctgttagttttgtcagcctgcttttattctcttatctggccccacccacatcctgctgattggtctgttttacagagagctgattggtgcatttacaatccctgagctagacacaaaagttctccacctccccactagattagctagacacagagtgctgattggtgcatttacaaaccctgagctagatacagagtgccgattgctgcattcacaatcccttagacataaaggttctccaagtcctcaccagagtaactagatacagagtgccgattggtgcactcacaaaccctgagctagacacagggtgctgattggtgtgtttacaaaccttgaggtagatacagagtgctgattgctgtatttacaatcccttagctagacataaagtttctccaagacccaaccagagtaactagacacagagtgccaattggtgcattcacaaaacctgagctagacacagggtgctgattggtgtgtttacaaaccttgagctagagacagagtgctgattggtgtatttacaatcccttagctagacataaaggttctccacgtccccaccagactcaggagcccagctggctttacccagtggatcccgcaccagggccgcaggtggagctgcctgccagtcccactccgtgcgcctgcactccttagcctttgggcggtcgatgggactgggcaccatggagcagggaggggtgctcgttggggaggctctggccgcgcaggagcccatggcggtcggggggaggctcagacatggccggctgcaggtgctgagccctgccccgctgggaggcagctaaggcccagcgagaaatccagcacagcagctgctggcgcaggtgctaagcccctcactgccccgggcggcggggccggccggcttctccgagtgctgggcgcccccagcccacgcccacccggaactcacgctggccggcaagcgctgcgcgcagccctggttcccgccggcgcctctctctccacacctcccagcaagctgagggagctggctctggccttggccagcccagaaaggggctcccacagtgcagccgcgggctgaagggctcctcaagtggggccagagtgggtgccaaggccgaggaggtgccgagagcgagcgagggctgctagcatgctgtcatcgctcaccgtgacttagaatgcgtaaccatctgggaatgcggtccagtaggtttcagccttattttacccagctcctatttaagatggagttgctctggttcacaggcctctgacacctcagcctcccaaagtgctgggaccacaggcatgggccactgcacctggccagagtctgcatttcttcttttttttttttttttttttttgacacagggtctcactctgttgcccaggctggagtgcagtgctgcaacctcggctcactgcaacctccacctcccaggttcaaacaattcttctgcctcagcctactgtgtagcagagactacaggtgcgtgccatcacacccggctaatttttgtatctttagtagagacagggtttcaccacgttggacaggctggtcttgaactcctgacctcaggtgatccgcccgcctcggcctcccaaagtgctgggattacaggtgtgagccaccacgcctggccagattctgcatttctaacaagcttccaggtgctgctgatgcccctactcttaagagccacactcaaaaagcaaggctttgtgcccactcctgccactttctgcgcctcagaattctttgcaaaaagagtagaattcaacttgttctgtttgcccttctttccccttctgcttttaaaaatgtaatgttttaatgcacaaacatgcataatatgtaagcacatacgtgtttgacacctgtcatcaaacagaaagtattgaagttgaggtttggaatttcagtaacacgaggttagtaggtgttatgtgttcattttataaagacagcaggtaattaattataaatgtcacgatcttacctctgcaataatggaatctgtttctgagtaagagtcagtttgggattatcagtattaaagagaatgaaaaaggaagaaaaatgtcttgtgctttcaaaaatagtcatttcaacattaaatgactttttgtcatgggaatgtactcttcatacttttatgatgtagttatttaatagacattggctcataataacacgtcagctaagcacacaaatgtcggtaaataagccagattctctctttgctttccagactctccttctccatcccacagcttcaccggacaagttttactccaaattcttttaaaatgtgtgttaagaacaaaacaaggtagcttcctttagataggcaagcatcaaaataattgtaaagtattaaaatgcaagttaaagaaatagaaatattgcttaatagtgtttttcttgaatacttgaatacttttattaaataaattcaagtttaggtagcaagaagaaaagactcttgccttatagagagcccttaggatttaagactcatgctgtttacaggaaaagctgtaacaaaatttaattttagttaggaaacctggttacaaatcagatcatcatataatcatcatatgacatcagggcaaaagaacagaccttttttcttctgatcttctgaaaatgcacatttttattaatatttttaaaagcctaattcaattaaatttcttcaaaatattggtcttgtccaattttttctttattaaaaactattaaaaatattcattgtcttaagtagcttttttcttcttttattttaggaatgatccctctcttgtcacccaggctggaatacagtagtactcaaactcactgcagcctttagctcctaggctcaagcaatcctcccacttcagcctccccagtagctgggactacaagagtgcatcaccatgcttggctaatttaaaaaaaaaaattgtggagatggtgtctttctgtgttgcctaggctggagtgcagatgtgcaatcattgttcactgcagtctcaaactcctgggctcaagtgatcctcctgcctcagcctcctgagtagctgggaccacaggtgggagtcacaaagcctgcctaatttttaaaaaaatttttagtagagatagggtctcactatgttgcccaggctggtctcggactccagacctcaagcaatcctcccacctcggcctcccaaagcactaggattacaggtatgagccactgtacacagcccttgagtcgttctttttctcattagcatgtgtattagctttttacctggctctgcaacaaattaccacaaattcagcagcttcaacaacataaatatattgtcttacaattctgcaggacaaaagcctgaccaggctgaaatccaggcattggctgggtcaggttcctgtctgtaggctctgaatacaatccatttccttgccttttctagcttctagaggccactcacattcctggctggtggcttcttcccccatcttcaaacagcaaaggcagagtcagagtggagccttcttacatcgtgtcactctgtccagctcttctgtttccttcttccaatgttgaggacccttgtgattacatttggctcacccagataattcaggataacctccctattttaaggtcagctgatcagcaactttaatctccctttgctgtgtaaaataacatattctcaggttccagggattaggatgtaggcatctttgtctgttctgcatgtgtgtgtttgagggagtgagtgggtggaggccattattctgcctaccacaatatatcttatcagtaattaaaaagaatcttctaagagaggactattgaaatttgggtacagatagcatttgcacagtgccattgcatcaaaattcagattgcattactcactggtggaaaatgctgtaactctaaagcaaagtatttctcttttagttgcatttatgttgactcccatgttttccttttctttttttaattttttttttttattttgagacaggggcctgctctgtaacccaggctggagtacagtggcacaatcatggctcattgcagccttgaccttcctaggctcacatgatcctcccacctcagcctcctaagtagatgggactacaagcacgtgccaccgcactcagctaattttttattttttgtagagacagggtttcattaggttgcccagggatcttcttacctcggcctcctaaagtgctgggattacaggcatgaaccactatgtctggcaacttcttctctagtaatgatttatatattataatcttggagtctaactatgattaaatagacccttcaatctctatgacctatccaaaatttatttcatagacagggttattgaaaaacacttagcacagtgtttctcaaatggggtgattttgctcacccacaggacatttggcaatatctgcagacatttttggttgtcacaattgaggagagggtgctatcggcatctattgggtagaggccaaggatgctgctaaacatcttacaaaacacaggacagcccccacaacaaagaatcatccagcccaaactgtcaatcgcgctgaagtggagaaaccctggcttagcaagatgccaacctacagcaccccacccctcaaccgaattaggtattagtaaatggatcagaattgtattagtatattgatttgtatattgattgaattagatgttatactaattagatgatgagtcaacaactaaaattctggtcaaaagatcaactggaggaaacagaagatgggtagatcagtacataccaatctgtgtgaaatgcgaaaggtaataaactgaaagaaagtaagcctgacttagaggcttaattgatgaaattgatgcccttctctcatgactctcatctctacgcttcttctttatcaacattgcaggtgttcctggctctatgccaaatgcatcctggactggaaacctcagagctataaagtggagtgacatggaagacagacacggaggctgccacggtgaggctctcgttccatgcttctaggccactgcctgttggtgttagcaggaaggtagctgtggaatccagggttctcatggagagagaattgctgctatatttagaccaatctgttagttattggagaagccagaggcttcaagacacagtccttcaaaaataagtttaaacatctcattgatgttctctaacttataattacctagggagatggaaaaatgggttcaaatcagggcggcatgtttttcttcctgctagttttcagctttctttctttctttagagacagggtttcactctgtcattcaagctggagtgcagtggcatgaatgcagctcactgcagcctcaacatcctgggttcaggcctcacacctcagcctcccaagaagctgggaccacaggcgtgcaccaccacacctggctaatttttttttttcttgtagagtcagctttcttgtttattcctcttgctgtgccttctgggagtccagctgttcagaggcgaaagccatcaggaggagaagtgatgtcatgttggcaccgcagagaaagctgggcccccaaccctcaggccagtccctgctccccctacaggcagccttcccagtggcttggagagctgtcggggtttgcacagctctggcatgatggatggcaggttacactagcaagaagggttcccctccaaatggaaaagaactagaaatcctaagtcatttccatttctatagaattttgtgaaggagagtttttatcagtcctggcacacactgcattcagaatattgcccagcatatactgggcatgagtattagtttgctagggctgccataacaaagtggcacagactgggtgcttaatagaaatttatttagttctagaggctggaagtccaagatccaggtgtcagcagggctggtttattaaggcctctctgcttggcttgtagatagcattttctccctgtgttcccacatggtcttccctctgtgcgtgtctgtgtcctaatcgcctcttcttctaaggagaccagtcatattggattatggcccaccctaaaggtctcattttaatttaattacctctttaaagaccctgtctccactctgagacactcagtgttaggattcaacatatgaatttagagagacaaacaattcagtccataatatgcaataaatatttatttagtaagtgattgtttgaacaaatgaatcaatgaatgaatgacaatatggtggtttggccttttctctctatggcaacgagactttgcctctactcctcagtccatcttttttttttttttttttttttttttttgagatggattctcgctctatcaccaggctggagagcagtggcgccatctcagctcactgctgcaacctccaccacccaggttcaagtgattcttctgcctcagcctcccaagtagctgggataacaggtgcatgtcaccacgctcagctaatttttgtatttttagtagagacggggcttcaccatgttggccaggatggtctcagtctcttgacctcgtgatctgccccccttggtcccccaaagtgctgggattacaggcgtgagctactgcgcccggccccatcttacctgcacctaaatgttaaatgtttcaggtgaaaatctccaagttgctccatctctacaactctccattacaccaacctctttctcatgtgtctcttgatggtctcatcccactgtggacagcaatgttttcatgcaactgtaaagaaattttggtccattctgaagcatgttaatatatttaatcagcctgtattttctccaggggacagtgcatgccacctgcctacattatttttttttttttttgagatggagtttcactcttgtcacccaggctggagtacaagtggcacaatctcggctcactggaacctccgtctcccgggttcaagtgattctcatgcctcagcctcctgagtagctgagattacaggcacccaccaccacacccagctaatttttgtatttttagtagagacggggtttcaccatgttggccagactggtctcaaactcctgaccttatgatccacctgcgtcggcctcccaaagtgctgggattacaggcatgagccaccgcacccggcctgtactaccttcatcagccctcttagcacttagaatgatcttcaacttggagtgcccatctctgattacagtgtctttgtcacctctactagtttccttcacctactcacatcctacttattttactgtctttcttcccagagcagaagctccaagacagctaggatttttgaccagtttgttcactgttgtgtgtccacacctaaaccatgttgtttttggtttgaattgggatttccagaggttcaacatttcaagctttttccttctatgagcttccttctgaggactccccgtctgacccgtgtattgtaagccactacaagatgtcctcaccaacatttttggtccttttgccattttgaccctacaaggctgattcctaaccctaatcattaccaccatctgccttttttgccgtttgtacttccctaggcagagtattggtggggagtgttgcggaactctcttaagacaaacccaccattgggtcctgtcatctaccttcagctaggcctcctggctacctacttatccttttgtttacctcattattttcctagtgcccttcctaagggacaccttttcagctttcctgctcacctttaagctcccaaggtgtattagtccgttttcacactgctgataaagacatacccaagactgggtaatttataaagaaaaagaagtttaatggactcacagttccacgtgactggggaggcctcacaatcctggcagagggcaaaaggcacatcttacatggtggcaggaaaaacagaatgagagccaagaatgagagccaagcaaaagaggaaaccccttataaaaccatcagatcttgtgagacttactcactaccacaagaacaatcatgggggaaactgccccccacgattcaactatctcccactgcatccctcccacaacacatgggaattatgggagctgcaattcaagatgagatttgggtggggacacagccaaaccatatcacaaggttatgctaaaacagcctttctattctcaaaagcgaccatttcaacttgaaaaagaacattcaagatatgtgatcaaaattcatcatctagtcccttgtcaggtcatcctgccccaccatcttagagctgtgtggacaccttctttcattgttccctcctgtttcaagaggacaagtcacccatcctcccaacaaaagccgccagctatggtctcagctatctgtgggccccctctctcagacccttgctcttttgcattctcagcctctccctttctgctgcctcttttccttttctctgaaagcctgtactcattgcccctatcttgaagacatcgagttgtctatgaaccttctgctttctccaggccgaaatattctttccttgttcacttccatttctttaagcgtgtgcttaaggcctgtgtttttggttctcgccgcctggtcattctttcacttcctacaattctggcttctttccccaatgacttctactctctattatgcttcttcccagcccactgaattaatcaccatgttctatctgtccttctgtactagtgtcttcaacatcctccctttcccactcatcacagacattaactttgaacaagctctccagtttgtgttattactgcagcctcttggtttctaatgtaccttgcaaaacacttcaaaattaatcttgctaaaatgagtttcatcacttgattcttctcttcaaaaatctttaaggactgtccatacttgtgagacacaaggcccaacccttcagtctgtgaagtcagtcaaccagcaattgtcctgtgtgcccagaagaatctctggaaaatggttgcaacttcctaccattcttgtttctaacctattcccaacaaaaccccctctcccagcaggaagtccccaccccaaaagctattgaggttaaaaaaaaaaaaaatttcaatattgacgtgttacatcactgaggtttatcacacatctaggcagaggtgcaaagtaggcacttggatagaccagagctcaggaaaaagacttactcaacgcaacccataaagatctctcccacctgtaccactgtaggacttctcatctgtaactctcatttagtaataccgtaggccccccttatccacggggggatacatttcaagacccccagtggatgcctgaaaccacagacagtaccgaactctaaatatactttgtttttccctgtacatgcatatctatgataaagtttaatttttgaagtaggcatagtaagaggttaacaataataactaattataaaatagaacaattataacaatatgctgtaataaaagttatgtgaataaaagttctgtgaataaaaaagttatgtgtaataaaagatatatgctctctttctttctcaaaatatcttaatatttttggatcgtggttgacttcgggtagctgaaacctcagaaagcaaaactgcagataaggggggattactgtacatgaatgaccttgtaacacctattatgttactaacacaattttcatattaattttgatatacacaataattaacataattaaaatattaacacctgttactttatgccttgtatgatttaactctcatttttttcaaataacatatttgtacctcttgttcttctaaatagagttccagttctttgtgggctgagactgcacaatcatatttcatttgaatcctgtaccattggcacagttgtagttagtcggagagtacctctagtattctgtaagttcatcacccttttgaaagcaagcatgttttgactctgtttcttgttctttcttttgcaggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagacagaattcactgtctgttgcttcagtaaaaggacctcggggaataaaacatttctctcttatatgccagaatgtaggctggtccctatgtcatgtcttccattaagaacactaaaaagtccttgcaagaatggagatatgcattcaagagaggtgctatcacatagatctagtctgaagtctggaacactttcctcttctatgacccctctctccccagtattatcttacttgcaaaatggagaccaaattctatcctgtgaggcttttaattgcaccatagtatgctctgagtagctttacactgcctggtactgatagtagtggctcgatttttaagagccttcaattgtagatgaacatctctgttatttatccctcattcatccatccgttcattcattcagccttcaatcaacatctcttgagtgtctattatgtacaggacatgtactgagacaaaaaggaaacataagagctttttcactctaaaaatcttggcaataatgtcaacaccagaaagcctcctctggagaatcttacagagtgattgtagtttaatacaggaacacacagggctgtgtagcatgataccaggcccaggagatcagtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaaaatgtgaagtctactttagtattcctgtaatactaaaccgttgagtttctaaatatttatttattctaacaaaaagcaattactacaaatggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatggggcctttggtaagggaagtttagatgaggtcacgagggtaggaccctcatgatgggatgagtccccttacaagacctctggcttgggccgggcgtggtggctcacacctgtaatcccaacactttgggaggccaaggcaggtagatcacttgatgccaggagttccagaccaggctggccgacatggtgaaaccccatctctactaaaaaatataaaaattagccgggctttgtggcatgtgcctgtaatcccagctatttggcaggctgaggcatgagaatcgcttgaacccaggaggtggaggttacagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttccacttcggggatactgtgtatttttatatgacaattggttaaaaatccactaaaggatatgtctaacaaggcaattctcctggtgttaaacaaaatttacattcattcatacatacatgcatacctgtctaagaaacatccatccactgaaaaatcattaaactttcccattgtggggtgttggagagagtaactgggagtgatagagagaagagggcgcaatagaagatcagtgtcatttgaattgggtataactttttttttttggtaagagtacaagtatttttaaaatttgagacaggaataagttaacttattatttacctgcctctattgttcatttaaaaaaatcaagatatacattaggaaaaagttttatgttaatattaccataattactgatcaagtgccaatgtttttgagcagcatttcaattgtaagtttgataaatattgcctctaacagacacatggaaaatgatcaatactaaaaaaaaaaaaaaaatcatttaaaggacatcttatccatcatattttttcaaataaaaatattttaaagctaaagcgaaaaacattttaaactataataaatacatacatgctcataaacatggaaataatgaagaatatagaataaaaagtgcactactttctccagacataatcacttatttgctttttttggtttttgtttttctgagacagagtctcactctgttaaccaggctggagtgcagtggcacagtcatggctcactgcaacctcaacctcctgggctcaggtgatcctcccacctcagcctcccaagtagctggaaccacaggcatgttccactgcacatggctaatttttgtattttttgtagagacaggattttgccatgttatcctgtctggtctcaaactcctgggctcaagcgatccacctgcctcagcctcccaaagtgctggactacaggcttgagctaccacacctggtcaagtgctttctcagtgtactgatataatctatagcagtgctgtccagtagaatttctgcaatgataaaaatgttctacatctgcactgcccaatataattgccactcacataagctaatgagctcttgaaatgcagctagtatgattgggaaatattctttaacattttatttggctttaatttttttttttttttttttgagatggaggggactcatccaggctggagtgcaatggcacaatctcggctcactgcaacctccaccttccagttcaagcgattttcctgcctcagtctcctgagtagctgggactacaggtgcatgccaccacgcccagctaatttttgtgtttttagtagagaggggattttgccatgttggccaggctggtctcaaactcctgatctcaggtgatctgcctgcctcagcctcccaaagtgctgggattacaggtgtgagccaccgtgcctggccagctttaattaatttaaatagccacatatgactagtggctaccattggacagcagagttatagaggcaaacaatagttatatgtatgtgcttgtatatacagtgtatatacagtgggcatactaaaaacagatatactggcatatttgaattgattatataaataaaaaataatatatctttacaacttgctgttttagttcgacctttctttttttctttttcttttctttttttttttttttttaagagagactaagtcttgctctgtcacccacgatggagtgcagtggcatgatcatggctcacttcagcctcaaactcctgggctcaagtgatccttgcatatcagcctcccaagcgtgtaccaccatgcccggctaattttttattaatttttgtagagatgggagtctcacgatattttccaggctggtctcaaactcctggcctccagtgatcctcccaccttggactcctaaagtgctgggattataggcgtgcacctgcccataatgcaattttaaatagtagcagtggtagcagctttccttgtgttgtttccaacattaaaaagcacgttgaattactgttgttggagattttatatagctttttagtagataccttttattgagttaagaattacaatagcagaaaataaatataagtgttatgattctgattttttaaatcccagttgctatctcttttttgttggctgatataattatgtgtgacaatgtgttgttgtttttaatttttttccccacatattaattcaaaagataagaaaaaagttttctacccctgcttttttttttttttttttttttgaacacctagacttgagtacagtggcgtatgccaagcaagagattggagcagggatccatttaaacagagagctacacagttggagtttgggaacacaaatgcctgagctggaaggtgtctattataactcctccctctactgggtgggttggtttagggattcaggggtcaagccaattggaaaacacataagtggacaacctctgagggctgacttctgaccttggaacaagaatgtctttgagaggaggaggacatgggcaaacctgactctggtcacctttccatgaggaacacctacaagctctgaaagtggtgagaatccacagtggccgaatggaaggtcaaccttgacaatcctgtttgagcccgggaagcctaacctgcatcttgggaaggatctataggagatgggctggcagaacaatccaaaagggttcctgacaaagaaatacaggactcagaaactgacattcaacatcaagtatcagactgcagaaataagcccagggcataatgtgatggaggactcaagatattaggagaaatcattgaaaaagttaacgccaggttagttaaagtgaattatttcaagttcaggccattggctgcaacctccacctcctggtttcaagcgattctcctgcctcagcctcccaagtagctgggattacaggtgcccgccaccatgcctggctaacttttgtatttttagtagagacggggtttcatcatgttggccaggctggtcccgaactcctaacttcaagtgatctgcccacctcaaccttccaaagtgctgggattataggcgtgagccactgcgcctggcctagaatattttttaatgtatgtagtaaatcctacggcagccattaaaaattacatcagtagatgaaatacaatacaatcataaaaatgctcaattaaaatcagagaaggcggcggggcgcggtggctcacgcctgtaatcccagcactttgggaggccaaggcaggcagatcaccaggtcaggagaccgataccatcatggccaacagggtgaaaccctgtctctactaaaatacaaaaaattagctgggcatggtggtgcgcgcctgtaatctcagctactagggaggctgaggcaggagaatcacttgaacccaggaggcagaggttgcagtaagccaagatcacgccactgcactccagcctgggcgacagagcgagactccgtctcagaaaaaaaaaaaagcaatagtttgaaattgtatgaataatcaaaattattaatatatatgagtaatgggtcatgttaaaacttagtccctaatcttccacagtctacagcagtttatatggaaacactgtctcctctaaaatccacagccagttgtggggagattttgccatccaatgttgctgggacccttcaaaactaaatgaataagggaaatgagttactcattcaattattcattggaagaatcagctgagtgcccaaatgtgccaggcactatgctgagcactttggataaaaactcttaagacctggccatgcctaatgaagtactcttacttgaacggacagaaatctggaaggatcctcctgcttaaaaggttaggaatgataagcaagatgggaaattacttgaatatacccagatatgcatacccagggagaagttagccacaaaaggagaggtagatacagacaggtatataactggacacaattacaacaaattagatgactcaacaacagaaacaggaaatgggaactaaccctttaccccatctccccagttacagccacacaggacagaaaggagggtgagtcacactgagtagtcttggtagcccagcctggatgaggatgcattgactaaaagatcagaacatttgcagaacaagaagtaagaaataccacagaattgacactcaactgaggaatggccaggcatcaaaataagcaaatgggatctggaaaagtgagtgcaactgataaagtggccaaatgtagagactggtagagaagtaaaatgttttagaaattgatttatttcttaaagaagaattctttctctccacccttctacccccaggtgtcaaaaactaaaatgaaggtttggagctgttatctttgtatcattactcttcaaattataatcatagtcacagtattatacaatgtgcatgtaagtcaaccagacagtggtcaaatagatgacgtaggtggtgaatatcaagccctttcccgactgcacatctgtgacgcagccctaaatgggaagacggtgcaagtattgccaagcgctttatccacaatgtttggaatagattcttgcccttactatgtgctagagaaccactatatcacaactcctttgtccacagaagaagctgcattccctttggcatatgtaatgaccatcagtcaagatttcgatacgtttgaatggcttttctgggctatttacatgcctcaaaatgtctactgtattcacgttgataaggcggccacgattgactttaaaattgctgtgagtgaattattggagtgcttctcaaatgcatttatatcctcacagtctgagtatattatttatggtggaaaatccaggctccaggcggacctggcctgcatgagagatcttatagcatcaactgttcagtggagatatgtcactaacactggtgatcacgatttccccctaaaaaccaacagggagatagttcagtatttgaaaacaatgaattggacaaacattacacctaatttagtgtctgttctgaaatctactgaaaggatcaaatatacccatagagagtacagaaccagagcacacgcttttgtcctaaagaagcataaaaagaagagcccacctccacgtcaactcaaaatccactttggctcaagttacgttgcccttacaagggaatttgtccattttgctctttataataaaatagccattgagttactccagcggtctcaagatacctacagtccagataaacatttctggattacactcaacaatattccagttgagtgtggtttcctttctcatttcttttttgttaattttttttttttttttgagataaagtctccctccatcacccaggctggagtgcagtggaatgatctcagctcactgcaacctccgcctcccgggttcaagtgattcttctgcctcaccctcccaagtagctggcattcaagcgtgtgccatcacaccaggctaatttttgcaattttagtagagatggggtttcttcacgttggccaggctggtctcaaacttctgggctcacatgatccacctgcctcgtcctcccaaagtgctgggattacaggcatgagcctgtaatttttatttttcaatcaaggtgatgtataattatgatttttaaaatcaaatattattaaaagccttcttataataaagatttatggccttatgccctgctcctccccatgtgcagtcccaattcacaaaaaaaactgtcatattttagctgttcctcctaatggtgacttctatgcaaagaacatgcttatgctgccatttcttgatacattaattttaatatcaagtagcaatatcctgttatagtggttaagaatgcttatatcctctacccacaaattttccttatctcttttaatattgtgattttaaatcaattgtcaatatttacatgatcataactatgaagctattgttcatagctgccaaggactctacattttgtttttcctgaggtttatgattgcctcaggtttttttcttccgttacttcttatatatacttatcactaattatttcaaaatgcttaatctcatcggtaaagtaactatgattattttccaattgttcacctctttttgttgttgttgttttttgagacagagtctcattttgtcacccaggctgcagtgcagtggtgcaatctctgctcattgcaacctctgcctcccaggctcaagcgagtctcgtgcctcagcctcctgagtagctgggactacaggcatgtgccaccatgcctggctgatttttgtacttttagtagagatagggtttcaccatgtcatccaggctgatctcgaacttctgggctcaagtcatccaccggcctcagcctcatgaaggtgtgagccactgcacccagccatgttccactccttatgccctcccagtctggcttcctctgacctcccaatctggacattgtctctatgggcctgttgtctgcgtttatcttacctggaaactctcttccttgttatgatgttgaatcttacattccatagaatctacattatctatcttttatatctatctttatctatctttgaatatttaagaattaaataatacgaactcacacatgtgcttcaaaataatctgagggtagatggggaagtgaatcatgattagtttataattattgatactggatgataggtatgtcagagttaattattgctctacaattttcgtgtgtttaaaatcttctatagtaaaaagaatttaaaaccttaatagctgtttcattttttgaagttattgtaaataggatagtaatttctgttatgtttttctgattattttactttgtttattgatttttgtatattatttttaaattcagccatattgctaaattctcttatccttttttttttttttctttttttgagacggagtctagctctgttgcccaggctggagtgcaatggcacaatctcggctcactgcaacctccgcctcccaggttcaagcaattctcctgcctcagcctcccaagtagttgtgattacaggtgcacgccaccacacccagttaatttttgtatttttagtagagacgagattttaccatgttggtcaggctgatctcaaactcctgacctcaggtgatccgcccaccttggcctcccagactgctgggattatagctgtgagaccggcctgtcttatcctttttaacagttttctagttgattctcttggatttttcatgtattcaattatataatgtgcaaataaatgataaattaacctaacttccaaaggtgaggtacatttgtttatctaatttgttaacaactactttcagaataatagtattgataatggtaatcctcttattcttaactgtaataagaaactttctaggtgtgtgtttggtgagtgcatacttgtttgttggggatgggaagggagcctttagcatctttctctactttttccaagtcaattgtctacttagagttttcatctcttctggagttggtttttgatgaattatatttccctggaaaattattcatttcatgtagattttcacatttattttcagagttgaacatatgcatctcttataaatcttttaaattctttatatatctaccgttaatttcctacttatcaattcttattttgtgtaactgtgatttttctctttttctttaaaaaattagctcagctaacagtttcttgctgtttgtttcaattcaaagacccaacactcagatttcacttattcattctgccatttttttctttgcaaatgtattaatttccagttattattaattcttcattttgcttttatgaactttgttttggtattctttttctaacatttgctggtagatgtttgtttctttttcttttattcctccttgtttattaattatttaaagctgtaattttcttctggtcactgcattaggtacgagattctcataagttctaagtaggcttttcatcactattttctagatattgtacaattttaatttcagcttcctctttgaccaaagagttgtgtgagaaaaaaaggtgttttttgttttgttttgttttttggtttttggtttttttaagacagagtcttgctctatcgcccaggctagagtacaatggtgcgatctcagctcactgcaacctccacctcccaggttcaagcgatttcctgcctcagcctcccaagtagcttgggattacaggcacccggcaccacgctcggctaatttttgtatttttggtagagatggggtttcaccatattggccagggtggtctcaaactcctggcgtcaggtgatctgcctgcttcagcctcccaaagtgctaggattataggcatgacccactgcacccagccaaaaaaaaaaaaaagtttttttaaagtgtcaggtggcatttaaaaaatttctggtgtgtgtgtgtgtgtgtgtgtgtgtgtgtgtgtgtgtgtgtttaaattagtatttaatttttctcttttattccatttgatcacagaatgttatccgtattatttctacttcgcggaagttgtttgctctgtggctgcatctatgatcagttttagcaaatgttttatggacacttgaaaaaaacatgtattcttggttttcaaggtataaaattctacatatattcatataaattaacatgccttatttggtatgttttaggtattataacttttttgtaatctgtttattggctctgtcaatgcttaattaaagggaagttaagcctactagaactttgtttctcttcctcttgcagcatccttcccctgggttgttgttgttgttgttttgagacagagtctcgctctgtcactcaggctggagagtgcggtggtgcgatctagactcactgcaacccctacctcccgagttcaagcgattctcctgcctcagcctcccgagtagctgggatacaggtgcccaccaccatgcccagctaatttttgtatttttagtagagacagggttttgccatgttggccaggctggtctcaaactcctgacctcaggtgatccgcctgcctcggcctcccaaagtgctgggattacaggcgtgagccaccacgcctggcccttctcctgcctttctaacaacaattatgagctggcaaagaagaatttcaggatccagctccgatcacaaaggaggatacatttacagctgaaaggatttttacaggatccagctccatgatcacaaaggaggatacatttacagctgaaaggcaacaagttagtaactggcacagtccacccctttggctattgtttccatttgtatccctacaggaatttggacttccatataacaacaaaacaactctgtttccacctgggacacatctaccctttgtgcaagtgggaaagttgtcatactttctcttaaactaggagacactcaatctcaaaagtcattctatccattgctggctatatgaatgaattactcctccaatgtagtccagtccaacagaatattctgttacctaaagaataaataatagagttaacctcccataaccagtatataaaataacaatgggaagaaggaaaattagaaatggttagcatatataaatatatacaagcaaagctactatagtcctcacttttataattggccacaagatcaattataaaatcatatctatgactttcttcttccacttcccattccagatttcccttgcctcagccagacctcagctggtcaagtttctttacccggtggggtgacccaaattatcttccctgaagtgtatgagtcttcaatagccttgcctctttctggttgctgtagttttccattaacctttactattaagcatggaagtactaagagatgcccccaccagagaattccatagtccaccttgcctccgctcagtatgcattttcctcttgaagatttggatcaatcactccagccagtagagtgaaacttatttcttctccctgttggttaagtggtgcgagcacttcagaatggccaagtggcaacatcatctttgcattcgatggctccactgttgtgcctcctggtgaccacacttccctccttggaaactaagatcttcagatcagcagagcccagagttgtaagaataggaagcaaaattctgtgcatgggttttatgagccactcctactttcagtccttcattcccagacccttgtgttctagctatagagaagatagcaccataggtgtggtctctggttcaaagcatgtactgtatccttagacaaagtatatgtggcacccaaggacagtggtgaaggaaaatcctccaataagcagtacttcaagtcatatatttggtagtctactttggaaagagaaagatccattcttttagggagttgtctcccaactcgttctagaactgagccttcagtaagccattacggatttcaacaaggccagacacttccagctgatgagatatgtgtggagaattgttaattctatggacgtgagtcaactgacatgctttctttgtatcaaatgagtttccttgataagaaggatcagaatgagttttcttatcatggtacagagtgacttgatcacaaataagtcattttgtgaggccaggcacggtgtctcaggcctgtaatcccagcactttgggaggctgaggcaggcagatcacctgaggtcaggaggtcgagaccagcctagcctggccaatatggtgaaaccctgtctctactaaaaatatgaaaattagccaggcatggtggcaggcacctgtaatcccagctactcaggaggctgaggcaggagaatcgcttgaacccgggaggtgaaggttgcagtgagctgagatctcaccactgtgctccagcctggatgacagagcgagactctgtctcaagaaaagaaaacaaaaaacaagtcattttgtgagtccgtggatagtggtgctagcaggacgactgtgggtagggaagtcagatccatattcagaatgcgtgtctattctagtgaaggcaaatctctattccttcgatgatgaatgaggtcagcataatgaacctgccacctgatagctgactgatccccttagaaaactgccatttcagtgctcagtgttggtctctgctgtcagcagattaggcacgcagtgacactggcccggtcagccttggtaatggaaagtccatactatcaagctcatacatagcttccatctctgccaccatagccactttgttcacgggcccgttgaggaagcactgggttttctggggaaagtgcctggctgatatacacagagtgtgtcatttgtttcaactgatagtcaaaagctttctcgtcttcctctgtagtgtgtgctatctggtgagaattcacatgggacacaaatatcttcatcgtttgtgctttttcttccccaggtttcctgttcaccaatctttcgatcctgttttttctaagtctaacatttgagaccaactatgcaactgctcatgtaatgagtatagagccatatgtctggccaactgtctctccaaagtagacagactaccaatgaattactcaaagatctgactactagagaattttcttttttgtcttttttcttttttcttttttctttttttgagatggagtctcactctgtcaccttggctggagtgttgtgttgtgttcttggctcactgcaacctctgcctcctgggttcaagcgattcttgtgcctcaacctcctgagtagctgggaccacaagcgtgtgccaccacgcccagctaatttttgtatttgtagtaaagactgagttttgccatgttggccaggctggtctcgaactcctggcctcaagtgatctgcctgcctcagcttcccagggtgctgggattacaggcgtgagccaccgcacccagcttcagaattttctttcaccactgcccttcagtgtcaccctgatgggttacaactgatcttaccacttcagcctcccaactagctggggctacaggtgcacaccaccatgcttggctaatttttttacttttgtaaagatggggtctcactatgtttcccaggccggtcttgaactctggacctcaagtgatccacctgccctcagcctcccaaagtgttgggattacaggaatgagccacacccagcccagaggcatttctttcaactgccccctgaacaggaaaattcactcgctagctctcaaccttctcaccctcctctattcatctgtcttcattcaaggcagaatcttctgaaacatcctgcattcttcccttttcaatgactcccacattccttttagtttctaaaccaggaggatttattggatccgatccttcctttccattcatgccacactgccctggctaggaaggagccattgagatatttgagtaggcttaaaataaacagatctaaggacagagattcatttatctgactgtcccaggcagaattaatccttcttcccctctactcccttatcacttttatttctcctctgtgattggatttctgacattttatctaatgtctatttctcttcatatccagtttgggaatccttttagaaaaggctcagtcatattcagtgcccttaattccttatacacggtcgaattaaatgttcactgttgagtactgtatgtagtactcccttacaggcaacagtaaacatttgaataacaatatgaataagtagtatcttttccagctcgttttgtcagtatattaaattatatttaaatgtttaaaatattaaattcagttttgtgctagcaatcttgtaagaaaaaatttacaatccaatatttcacagactacagcaacgctggtcacaaggctttggggccgtgtttgtagtaactattaactacaagatccatgtgactcccatagaattcatgtttatattccaagagaaatcagagttactcaggatcagctggatatgtacaaaagagtcacttttgaggcccacgattgttgttagattaaaggacttgcttagctgggcatggaggtgtgtgcctgtagtccctaggctactcaggaggctgagagagggggatggcttgagcctgggaggcagaggttgcagtgagctaagatcgtgcccctgcgtgccagcctgggtgatagagtgactcctccatctcacacacacacaaaaaaacttgagataatgattcggttccatgtataggttgagcaccccaaatccaaaattctgaaatccaaaatgctccaaaatctgaaattttttgagcactaacatgatgttcaaaggaaatactcactggaacatttaggacttcagattttggatttgggatgctcatccagtaagcacaatgcaaatattccaatatctgaaaaaatccaaaatatgaaacacttctggtgccaagcattacagattcaacctgtaatacatcagcaacatcaataattaacatttattgaattcttagtatgtgccaggcactgtgctaagtgctttctaaagactgtctcagttattcatcctgacattcccatgatacaggtcctgtgttgatttttccttttacagaagcagacattgccacacagctaacaagtagtgaaatgaagattcaaaccaaactatttaatatgaaacaagtacttctcccctatctcatgatggcatagacgatttttccatttctaaaacaatctgacatttcttttctagtgtaaggacgttatcatgttaaaataaacttttacaaacacccccaaacctgcccattgccccagtctgatttaatctaaccacttccttcatccccttgcagcttgcataactaaacaccatcacttccccttttttacacattttactcccttgaccttccccttctccattcatctcttcctagcttatttttctttgccattcataatacctactgtcaatctgtctttttgcaaacattctttttgcccctttgtcttttggttgtacccatctggaaatccacagtcctataacaaattcagatatccattatctctacgtttagacagctgagcattagcgcagaaattgcacaaccaagcagaacattatctctgtatgttctcaacctactgcttcaactggatcctcaattccagccaggcagttgctatgatgatctgatcgtcacacatttccactaccagcaacgactacttcagactttctcctctcttctcaaacttcatataattaacgcatgtcagaaaatattattcttttgatttttttcccgtaaccattcaaacatataaagacaattcttagcttgcgggctatacagaaacatatggccagcccaagggccagagtttatgccttgttctaggtgttctcgtcacccttacaaccttaattactatctacacatgataattccaaatttaaacctggagctcaaatacatttttaaagttcgaaacgcacatgctcaactggtttctcaacctctcctcttgggtgtctcactgggtccttaaaatcagcatatcccaagatgaccccaactcctccctcactccacaaatccaaacaagcaccaggttctgctgagtctacatcctgtctatttcttgtaaccattctattcttaccattcactctgcaatcattccaatccatgccatcttcatcatttgctctattgcaactgcttcctgattggtctcctaatatctccccgtccccttgcaacccattgcagccagtctaatatttaaaaacacaaatttgataggattactttcctgcttcaagcacttttgccactttgccaaaaagtctttaactcattaaagcctgcaggttgccacagggtctacccaactcttgttcctccctcctcaccttgggcctctcaccttcttttctctctctctttttctttctttctctctctttttctttctttctttctctttctttttttttctttctctttccttccttccttccttctgtctgtccttccttccttcctgcctgcctgcctgccttcctttctttctttctttgtggggcagcatggtggacaccttcttactctgttgctcaggctggagtgcagtggcgcaatcacagctcactgctgcctcaacctcctgggctaaagcaattctcctgcctcagcctcctgagtagctaagaccacaggtgtgtgccaccacacttggctaattttatttttattttttgtaaagacaggttctccctatgtagctcagggtggtcttgaactcctggcctcaagcaatcctcctgccttggcctcccaaagtgctgggattataggcatgagccaccacacccagcttgcacctcctcccttgttactccagccatcctggtactataacggtctatacattttaagccttctctaagaaatccttccctaccctgagaccataaaaatattctcccatattttctattaattgtttttctggttttgatttaccattttaacatatctgaaaattatttgtggggagcggcataagcaatacatctaatattatctttatccatttggatagctaatgtttccagtaccatttattgaatagtgctgatttttagtgctatttccttctcagtccaagttccttgggtcagtttctaagctattattttccattagtctatttttttaatagcaatagcatcatttcagttattatgctcaaaatgttcttggctatttttggtccttgcacttgccaattagtactaggtttagcttgtaaggttctgataagaattcggctgtgatttttactggatgatgtcaataaaaagttagcactccccttcagtggataatatcaaaaagccataagaagaatgagaagtagaaactctaactttattgaaactagaagaaatagaaactgtaaaccacaaagtatgtgaaggagcttccaaagcagcaaagatcaaacagtgttgcatgtgggaagaagcaggcaggggatattgatttccacaaatctcagaaagagccagcaaagtcgacttctccaaggtgagaggacactcttagaggaacaaaagcacaagtcctggcttatttttatagcagtgcgatcagaatgcctgaactgacagaaagaatgtctatggacctggtttggttccaaagaagcaaaggcaaagaggctaaatgagcaaactcacggataagttggatgtataactcccaaccaaaaatctactgcaaacatgttattctttttctttttgagacggagtcttgccctgttgccaaggctggagtgcagtggcgtgatcttggttggctcactgcaagtcccgcctcccgggttcacgccgttctcctgcctcagcctcctgagtagctgggactacaggcacctgccaccacgcccacctaatttcttttttcttttttcttttttttttgtatttttagtagagatggggtttcactgtgttagccaggatggtctcaatctcctgacctcgtgatccgcccatctcggcctcccaaagtgctgggattacaggcatgagccaccatgcctggcccaaacatgttattcttaaagatgaaatctcagaagtattttatttaaagtaataaggatgacattaccactttcatattcaacattttaaaggaaactgtagccagctcgataaggcaagaaaaagaaaaaagctataagagttgaaagagaaagaccttttctgtcaaaagtagaaattaggacaggaggagaggatacaccagatttatcaaatctttgcctctactttttaggcagttcttaggcaatttcttcacaattaccatgagcaccaaaataatgttatcaacaactacttacacttaactatgagtttaacttatttctctgcttgctatgttttcttatattccatttatctctttcttaaattaatattttataaaattagagtacatatttgggtaattattaataaatgttctgaaagtagtatacactatttgagctcttatatttgttttcactcttgaatgatagatttgttgggtacataattctgaatttaagataatctcccttggaactttgctctgatcactttttgtatcaaatgtcactaatgaggactctgttactaattagatctttttcctttctagataatctatttgctatataatcttttaggatttttttttctttgactttgaagacttgaaattttatcagaaagtatctaatgtgtggatttcttttaaaaattaactgtctgacactcaatagttactttaaaagacaagctcaatggcacatgcctataataccagctgctcaggaggctgaggtgggtggataatttgagcccagaagttcaagaccagcctgggcaacatagaaagactccacctcaagttaaaaaaaaaaaggcacttttaatcagaagattcaaatttttctttagctcttgaaaacggttttctaaatttttttgataggtcctctttcattcaaatagaggtactgggccttggatattggcagtgaactctggctcctgccagaatagacacatctgtccacgtggccttgagtttcagcaacaatatccagttaacagctttggtggcaacaactgtagcatcgcagctggcactgcagcaccaagggaggccctggggcctttccacctgaaggcagcttgttctgctcatcagaacaagtggggattctggaactgctatttgcacctcaaatagtaaagccagatccccaccctctagcccaccaagctacagtatataaaaaccaaaaaacaatacctaaaatgttcatttatctcaggatgtgtattagtttcatatggctgttgtaatagattaccaaaaattcggtggctggttttgattgtttgtttgtttgtttttgagatggagtctcgctcttgtcacccaggctggagtgcgatggcgcgatcttggctcactgaaacttccgcctcctgggttcaagccattctcctgccttagcctccagagtagctgggattacaggtgcacaccaccacactcggctaatttttgtactttttttagtagagacgaagtttcaccgcatcggccaggctgacctcgaactcctgacctcaggtgatctgcccgcctcggcctctgaaagtgctaggattacaggcgtgagccacggcacccagcctcagtggctgttttaacacaaatttatgatcttaccgttctatgggtcagaagtctgacgtgggtctcactggactaaattcaaggcattggcagggctgcagtcctaactggagggtctagggagcatgtttcctcatcttttctagcttctagaggctgcccacatactttggcacctggtcatctttctccatcttcaaacccaacaacatcgcatctctctgactgttcttccctcatcccatcttcctctgaccacggcaggaaagtttctgtttttaaggaacaatgtgataagactcggcccaactttacttcttattcccaaattagtcaacaaagaatttgagaaatggattctgaaactcatgttaccaacattcatgaatgacttttgtttttgtttgtttgtttgttttttgagatggcctcactctgttgcccaggctggagtgcagtggtgcgatctcggctcactgaaacctctgtctcccaggttcaagcaattctcctgccttagcctccagagtagctgggattacaggtgcccgccaccacgccaggctaatttttttttttgtatttttagtattttctagtagagatgtggttttaccatgttggctaggctggtctcgaactcctggcctcaggtgatccatccacctcggcctcccaaagtgctgggatgacagacgtgagccaccacacccagccttgaatgacttatttttttatggccttatgtgtagggattttgtaagggaccacagggtcaagattagggtgagacatgtgaaacacctggggtatacaactcaagaaggtgttcacgttcagggtcagcactcacataaccctgagagtgaatgcctcatcacttgaccctagtcctgccctgatacacaataaacctgcacataaatcgttaatacagaaatagtgttactctaagagtgtgatgcaagttattcaaatagcagattcaggcatcacatatcaccaatgaagtggcactgtacaagtaagttttaggaaaatatgtgctttaccttaagtgatagatgccttacattgaaacattacagacccaaatattgttaagccaaacatacacctctgcagtctggggttagcgttagcaaagcaggctataacaaattaaattgtaagactaataataatgatttaaaaacaagaaaagcaattgaaaacaaaaccaactcagcatcacactgataaaaaagtgcccttatggagttccaatgagatccattcatgtgtgtatgcagtaggagcttcatgagattggcaagtttaataagaagccagactcagcaatgggatattgaatataaaccctagtaatgcattgattttaatttttgaaaacgaaattatactttcctttactatttagtaattagttactaaataataattagttactaaatagtaaagactattactgttagtaatagtaatagtaaatagtgaagactcctcagttgccataaaaattagtctattcagttccacattatatcaccataagaaaagaggaatatgtggatcgctttgctgccaaaaaggatcctcaaggtatactaggctgggcatagtggctcatgtctgtaatcccagcactttgggaggccgaggagggcggatcacctgaggtgaggagttcaagaccagcctggccaacatggcaaaaacacatctctactaaaaaatacacaaattagctgggcatggtggcaggcacctgtaattccagctactcaggaggctgaggcaggagaatcactggaacccgggaggcagaggttgcactgagccgagattgtgccactgcattccagcctgggtgacaagacgaaactccgtctcaaaaaaaacaaaaaaaaaaaaggtatattagttgactactgaccaccctttgacaagatgaggtaaaggtgaaaatggaaaaggtgaatactgtttggagtgctcagttcagtggtgtctggcatattcacacataagggcaaccagcacaatgtgtttagaacattttcatcacctgaaaaagaaactcgtgccccttagctatcattctattcttctctcccctctcctctttccccattcccatccctaccacccagccctaaataagcactaaattaatttctgttccagagagttctctattctgaattttcatataaataggattatataatatgtgacctttaaaaactggcttctttcacttagcataatattttcaaggtacatccatgttgtaacatgtatcagtactacttttttttttttttttgagacggagtctcgctctgtcccccaagctggagtgcagtggcgcgatctctgctcactgcaagctccgcttcccgggttcacgccattctcctgcctcagcctcctgagtagctgggactacaggcgcctgccaccacgcctggctaatttttgtatttttagtagagatggggtttcaccgtgttagccaagatgatctcgatctcctgaccttgtgatccgcctgcctcagcctcccaaagtgctgggattacaggcgtgagccaccgcgcctggcctatcagtactacatttttaatggctaaataatatttcattgtatatcacgttttgtttgtccattcaatagttgatagacatttgaattgtttccacttttaagctagtatgaataatgctactataaacattcatgtaaaaatgtttgtgtggacatttgctttcatttcttttaggtatacaactaggaacagaatttctgggtcatgttcttgcttaactgaggaactgccagactgttttccaaaggggctgtaccattttacattccaaccagcaatgcacgaggatttcaatttctctacatccctgtcagcacttgttattatctaactttttaattctagccatcctagtggatgtaaattggtatctcactgtggctttgatttaaatttccctgataactaactatgtcaaacatctatctatttatgcgtttatttgccatttgtgtatctactcagcagaaatgctttgcccacttttcaatcgggttacttgtctcattattgaattgtaagagttctttatatattctggatacaagccccttattagatacatgatactatgatatgcaaatactttctttcattctgtgggttgtcttcttttcatttttttttttttggagacagagtctcgctctgtgtcccaggctggagtacagcggcacgatctcggctcactgcaacctctgcctcctgggttcaagcaattctcttgcctcagcctcccaagtagctgacattacaggcacgggccaccacgcccagctaattttgtgtatttttagtagagatggggtttcaccatgttggccagactggtctcaaactcctgacctcaggtgattcacccatctcagcctcccaaaattctgggattacaggcatgaaccactgtacccagccttattttttattttttttgaggcagagtcttgctctgttgcccaggctggagtgcagtggcacgttcttggctcattgcaacctctgcctcccgggttcaagcaattctcctacctcaacctcccaagtagctgggactataggcatgcaccaccaacaccgggctaatttttgtattttttggtagagacagagtttcaccatgttggccaggctggtctcaaactcctgacctcaagtaatccgcccacctcagcctcccaaagtgctgggattacagtcatgagtcaccgcacctggtttgtcttttcttaattgtatcttttgaagcacaacagttgttaattttgatgaagtcaaatcttttattttgtcacttgcatttttggtgtcctatctaagaaactattgcttaacccaaggtcatgaagatttattgactcctatgttttcttctgtaagttttactgttagctctcgtatttagatctttgatccattttgacttaatttttgttaaagatacgaggtagagatcccaattcattcttttttatgtggatattccattatttctgtgttatttgttgaaaagactattctttcctgcatcaaattgtcatggaaaccttgttgaaaatcaattgaccatagttatctatatcggggtgtctaatcttttggcttcctgggccacattggaagaagaattgtcttgggccacacagaaaatacactaacactaatgatagctgatgagctaaaaaaaaaaaaaaaaatttgcaaaaaaactcatgatgttttaagaaagtttacaaatttgtgttgggctgcattcaaagtcaccatgggccacgggttggacaggcttgatctatgtcattggtactgttatgtcaataccacattgtcttgattactgtagctttatggtaggttttaagatcagtaagtgtgagttcttcatttttgtcctttttaaagattgtttggctattttggagtcactggctttttaaactttatctattcctttctttctattaaacataactgaagcgccctttctgttttcctttcaatttccacaagccttagttcatttaggaccataatttgctcccaatacttacatgggttcatgctatttatttttatttttatgccatctgtctctaccattttggaacagagatgatcaaatagcccctgtgtctaatttctttttggagtcattggtctcgatgttgtttgattcttgttctttagaacctcccattcctcttgggccatctttcttaaaatcataccctaggctttttgtcttcattgttatgggcacttgtttgctaatggaccctgactctgcatgcacctgttgagggaagaggtgccaggaccacatgcttaagagcactctctctctcatataacctgtggcctggaaaagagacacggtgtggttagctacaaagaccagattatgtgatctatctaggctcctccattctgaaaatgttggccagaagctgtaagagaatcctataaaaacgaactgcattttccctaaatctgtgggctatctattctagacagaatccattcactgatagtgcaaagaagtacaaagatgccctccaatcagccttccttctagttgtaattatggcaagacaccagaatattatgatacaaattccctctcttcttcaaggtctggggctcctttgcacacagtctgctgaatactcacatttttagcagagtccgagactgaccaaagtgttgtctgagagctggtcagaggtctgggcaatctctgagtcacctgggaccccagtgacttcttatttcttcccatccttctgtgacttcctaaaaagataggaaggaactaaaacataagacattcaacagctttcttataataatctccaagaaatataataagaaaagatcccactaacataaaatacatctaaacaatttaaacaagaaatgttcaagataaaagtcaaggtggggaaaaaatgttcagcttatgtaactgataaaggtttaatcacctttttatataaagtggccaattacaaatcaataagagaggactgtctttataaaaaattgtgggatgaggaggagttggatgctagtccagactatttcacagttgccaccaagggaaactcgaggaaagaagaaggagacggtgaagtggcagatttagtatttatgtgaaactatacagtcgtccttcagtatatggggggattgtttccaggacccccacatataccaaaatccatgcacactcaagtccttccctaaggaactcagcataggaaaagtcagcccttcctatatgtggatttcacatcccacaaatactgtattttccatcgacctttggttgaaaaaatttccggtataagtggatccactcaattcaaatccacactatcgaagggtgaattataattaaaagaaaaccctataggaccaatctcctcaactccacctatgttttgggaagaagtggaagaatgttgggatctcttctcttcctctacaaaataagtataaaacatgctttttttttttgagacggagttttgctcctgttgcccaggctggagcgcaatggcacaatctgggctcactgcaacctccacctcccaggcttaagtgattctcctgcctcagcctcccaggtagctgggattatacgcatgcgccaccacgcccagctaattttttgtatttagtggagacggggtttctccatgttggccaggctgttattgaacaccagcgaacaccaaaacaaaccactggggaaccacttattccttgatccacctccatgaatcttttacttaatgaggcatggaaattgaatgcattaaagacacaatttttagaatgtaacgtattagccttaaaatatgatttaatatccataataagaattcaaacacacaaaccactcagctgaatttctaaaacacattacaggaaaattattggctacccctccctgcagagtacacgcctataatcccagctactcaagggctgagacagaattgcttgaacctgggaggtggaggttgcagtgagctgagattgcatcactgcactccagactgggcgacagagtgagactctgtcttaaaaaataaaataaaataaaataaaaatagagatgggatcttgctatattgcccaggctgatctcctactcctaggctcaaatgatcctcccacctaggtctcccaaaatactgggattacaggtgtgagccaccctgctcagcccaaaacgtgcattctaagatcatcatcaaaaggtatagtttcttgtacctctgcagttctcagagtatggttcctagagcagtcagcactgggaacttggaaatgaaattatctggcccctccccagacccgcagaatcagaaactctgcagggaggggtagccatctgcgttctcaagcctaggtgattctgaggtatgctagcctttgagaacacctgtcatagggaaataattttcctgtaatgtgttttagaaattcagctaagtagtttgtgtgtttgaatccttattatagacattaaatcatatttaaaggctaatatattacattctaaaaattaagtctttaatgcattcgatttccatgactcattaagtaaaagattcacagaggtggatcaaggaataggtggttccctaatggtttgttttgttggttcgttggtgtctaaagaaaaacagtccatggaagagccaacagcaaagagaacaaatacacaaattcccatgtcctgcaggaagaactcggcttgtttagggaccctccacaattccccgactgattccaaccacttctgtctctctcctcatgaaccctgtagatgcccctggatccacaaaccaagaaatctcagttaggagtcttagagctgtgaagtggatttttcaggaaaatattcacaaaggctgccacggtaacactttctccttttttttttctctctccattggaacttccattttcaccattagaataaagagagggaatgaaagaatgacagtatctgtctggaatgatcacggaaatgattgcgcctgggtcataaagcaaatgatcaagaattaatagctctgaatacatgccagtagatttgcagtaattatttcatcttatagatttagagccttagaatcctcctcattttatagatagggaaactgaggctctgagaaagaaaatgacaagcccgtgaggtgctagtgagaggcaggaccaggaacagaacgtggccatctgactcggagcccagggctttgtcaccgcaacctgcctcccttaagtctctgcctcctgcagtaatagctagatggaacgcagaaagccctccaagtcctaggaacacactatacatggtagcatttgactagccttccctgctcacacacacacacacacaaacatatttgcttgatgtggaacaagttacaaaattctttggtgtacttctcagttcatgcgtcatcttaatgtatagacgggcgtgaaaataacctcctgtttgtgaaccacaagagagatttcctctggttttgccctcggtgccttcagagaaagagtctatgggaaagcccctcctcgcttcccctctctcttccttttggacctagaagctgagaactcatttttcttagtcagtcattttcacagcccagtctatgaagaatgctactgcgtgataaaatcctcactgaacttcggcaaaatgagaaaaagggacgatgtagcaagtttttcataaagccatgtttccgaagtttaaaggactgtcctttgtttgaaatgaagtccttcctcttttgtctgtatgttaaaataccatatttagaaatgaaatgatagaaatagatgatggaagtcacttaattaaatggaaaaaccaaaaagttggccattatatatttgttaatcttcttaatatttctaatccatgagattcaaatgtctatgagaacagggccaggtatagtggctcacgcctgtaatgccagcactttgggaggctgaggagggcgaaccatctgaggttgggagtttgagaccagcctggccaacatggtaaaacctcatctctactaaaaatacaaaaattagctgggcatagtggcatatgtctgtaatcccagccactcgggaggctgaggcaggagaatcgcttgaacctgggaggcagaggttacagtgagccaagatcatgccactgcactccagcctggccaacggagcgagactctgtctccaaaaaaaaaaaaagtctatgagaaatgtctttaagccattgcttttttaaaaagtgcttcttacccatatgtgaagagcaagttttttctttccaatcagttgtacagtaacattattataaaatataatgaaaaggattaattttaaaaaaaccaaaatgctgcctggatgttgcagtaatgtcagattgttataaaagttccccaatctgcccaatttcttcattttcttactgcagactatcggttaaatagttgggaaaacagcccccatctgtaggacacacctgcagtacatgaagttagaacatcacactctttgtaacaccagactctgcaaggatgtgatgagaaaagatatggcccaatccatttggaaaatgctgagaaaataatgcagaaatttcagagccattcatctggtgatacagggagcaacatgcaatcttttttgaacttatttgaacatagaacaaccacccctatttttagtagttcatctcgttcatgtctttctcttaactctcgtgtttcatagatcgcagtttgggaaaccatgctctgaaacataacagctgcctgttttctaggagagaacattgatggcacaccccctaagccagctttgcatttagaacactgggatgggccacactgcagaatgtggatgtgtctgtgtgcccacatctcttcctataactttacttcatcaagaagcaaaactggcaggcgcggtgactcacgcctgtaatcccagcactttgggaggccgaggcgggtggatcacgaggtcaggagatcaagaccatcctggccaccatagtaaacctcgtttctactaaaaatacaaaaattagctggacatggtggcacgtgcctgtaatcccagctactcgggaggctgaggcaggagaatcacttgaaccagggagtcagaggttgcactgagctgagatcgcactactgcactccagcctggtgacagagcaggactccatctcaataaataaataaataaataaataaataaataaataaataaatttgaagggtttttttagaccaaggatttgcaaactatagctcatggtccaaatccaacctgccacctgttcttgtaaataaagtttaattgggaggcagccaagctcactggtttcctttttggctgcttctacaggatggccttcagagtcagaaatatttatctggtcaacccctgctcttgcttcatttagacacattttttaaaaatcatactttactttttatttacacacaagattgatataaatgaaataaattggtcatttcttcacaacaaatatgcaagaaaacatggatttgtggtcatttctctaaaaacaaatatttgctctactaaattcaaattttggccctgctgatttgttttctgtgcccttttcatttcactgccaaatcatagtgtcatctttttgaaaatattttaaataggctcagcaataaagaccggcttctcacatgggatcactgctagggctggagtcctctgacaattctataggggaggaaagacatttttttcctatacccttcataatttttaggtgccctccccagcataatgaaagatggattaacaacagaagagctgacatttattaacatgtatacatacccacacccagaagatacccagggaaaaatgaatgactctcagagagatggcttagaactcaggctttaacaccatcttcatctcaaaggaaattgacggaggcaagttatggagaggttgagcaggaaaagcacagtaagcaatggtaaatttcatcatgcaaatttaaaagtcagcgccttctccattgatgggcatctttattgatttaatcctcctctttctggtgcagagggaaacatccttataaatggagatttccttacgtgtaaaattctcttacaaaaaggtaacttcagcagggcgcggtggctcatgcctataatctcagcactttgggagaccgaggctggtggatcatgaggtcaggaattcgagaccagccagaccaacatggtgaaaccccgtctctactaaaaatacaaaaattagccgggcgtggtggcgggcgcctgtaatcccagctactcaggaggctgagacagaagaatcgcttgaactcgggaggcggaggttgcagtgagctgagattgcgccactgcactccagcccgggtgacagagcaagactccatctcaaaaaaaaaaaaaaagggggggggggtaacttctactctgttttcagagcttgtcctgtgtctcctgtttctcactcaatccttatgccaaggaggcatattttggggtggcatattctggtctcctgtggtcacaagatggcctcgtgacagtctgtcagttggcactggctgtctactggggcctgtcagttctccacaaggcctctcatcctctaggcttgagtgggcttcctcacaccaatgttccaagagagcaggcgccacgtgtaagaaagggcttaccaagcctctgcttgcaacctatttgccgatggctcattggctaaagcgagtcacgcagtcaaggccagcagtgatgcaagaggggtctcctcaggacatagctacttggaggcgattcacctgttcaccatgatattggaggtgttcactatgataatgttaccatctatcataagaagggaaggaggggccgggcgaggtggctaatgcctgtaatcccagcacttcgggaggccgaagtgggcggatcacggggtcaggaaatcgagaccatcctggcgaacacggtgaaaccccgtgtctactaaaaatacaaaaaaagtagccggacgtggtggtaggagcctgtaatcccagctactccgcaggctgaggcaggagaattgcttgaatctgggaggcggagcttgcagtaagcaaagatcgcaccactgcactccagcctaggcgacagagctagactgcagaagaaaaagagaaagagaggggagaaggtgaggagggggagaggagagggagagagggagagagggggagaggaagagagaggggaagagggggagacggggagagggggaggtggctcatgcctgtaatcccagagagaggtgacagctgctggcagccctcgcttgctcttggtgcctcctcggcctcggcgtccgctctggccatgctcagggagcccttcagcccgcctctgcgctgtcggggcccctctctgggctggttgaggccggagccggctccctcagcctgctgggaggtgtggagggagaggcacggaaaggaactggagctgcgcgcggcgcttgccggccagctagagttccgggtgggcgtgggcttggctggccccgcactcggagcggccgggcgaccccgccggccttgggcagtgaggggcttagcccccaggccagtagatgtggagggtgcacggggtcccccagcagtgccggcccaccgaggctgcgctcgatttctcgccaggccttagctgcctccccgcggggcagggctcaggacctgcagcccgccatgcgtgagcctcccctgccccacgctgtcggctcctgcaaggcccgagcctccccgacgagcgtggctctctgctccgaggcgcccagtcccattgaggacccaagagcagaggagtgcgggcgcagggagcgagactggcaggcagctccacctgcggccccagtgcgggatccactgggtgaagctagctgggctacccagtctagtggggacttggagaacctctatgtctagtcaagggagggtaaacacaccaatcagcactctgtgtctagctcggggtttgtggatgcaccagtgggcactctgtatttagctaatctggtggggacttggagaatctttatgtctagctaagggattgtgaatacagcaattggcactctgtatctagctcaaggtttgtaaatgcaccaatcagcaccctgtgtctatttcaaggtttgtaaatgcaccaatctgcactctgtgtctagctgatctggtggggacttggagaacctttatgcctagctaagggattgtgaatgcaccaatcagcactctgtgtctagctcggggtttgtaaatgcaccactcagcaccctgtgtctagctcaaggtttgtaaatgcaccagtcagtgctctgtgtctagctaatctagtggggacttagagaacttttgtgtctagctcaaggtttgtaaacgcaccaatcagcaccctgtcaaaacggaccaatcagttgtctgtaaaacagaccaattggctctctgtaaaatggaccaatcagtaggatgtgggtggggccagataagagaataaaagcaggccgccggagcaggcggtggccatttggtgaggttgtgttatgtggtgtgggtggtttgtttttactttgtaatgaattttactgttgctcaatgtttgggtcaacactgcctttgtgagttataacactcactgcgaaggtttgcagtttcaataatgaagccagtgagactgtaaacccactgggagcaactaataatgcgtcgccctaacagctgggacgcccaccacaaaggtctgtagcttcagtcctgagctagagaccacgaacccactaaaagcaaaaaaactgaacgcagctgagctatcagtagggagaaacgctggtggacacgctgcctttaagaactgtaacactcactgtgaggttccatagcttcattttggaagtctagaccaagaacacgctaattctggtcacgctagcactttgagaggccaaggtgtgtggattacttgaggccaggagttcaagaccagcttggccagcatggtaaaaccctgtctctaccaaatatacaaaaattagcctggcgcatggcagcacgttcctgtaatcctaactagtggggagactggcaggagaatcatttgaaccggggaggtagagactacagtgaggcgagattatgccactgcactccagcctgggagacaataagactccatctcaaaaaaaaaaaaaaaaaaaatcccaacccttttcttgttacagcaatctcaagggagtttagattcccccataagataacataaaaacctttttataggaacagcatatagttctgatataacaatcttggtgcatccactagttctttgtctagtattaaaatccatttttaaagtttctttgagcttcaagaataaaggtgcaaagcccattctgttcctttttcaacttctccagaagttttcccttttgcctatttcttgctattagagaagattctggttaagacgactctggttaaacaaagcattcatataacaagtttccctttaggttggtctaacaatgcaggcatctccatcatggtccacattctgaaaaggtagcaaggggtgaatccttaccccttttggcagcggtgggatcaagaatggttgtggagtagatatatttcaggaagctcaagcagtctatgcctaaggtctggcaggcatcttgattctgccagacccatgacctaaccacacacaatgatgctatcccagtttcttccttttcagtgaatagaacaactaaccatgctattactcaagccaaaaaatcctaggggtaactctggattctgcctatctccctcatcacaatcaaaaagctgacattttgtcaagagtcatttgaaccagagcgactccatcttgaataggggctgggtaaaacaagacagactactgggctgcattcctaggaggtcaggcattcttagttacaggataagacaggaggtccgcaggactgatatcacaagatacgggtcataaacactggtgataaaacaggaggtggtggttgggcgcggtggctcgcttgctagtgatcccagcactttgggaggccgaggtgggccgatcactttaggtcagaagtttgagaccagccagaccaacatggtgaaacccttacctctactgaaaatacaaaaaagtagccgggcatggtagcacgcatttgcagtcccagctactcggaaggctgaggaaggagaattgcttgaacctgggaggcggaggttgcagtgagctgagattgcaccactgcactccaatttgggcaagagtgagacagtgtctcaaaaaaacaaaaaaaaccgggaggtgctaaagaagccaaccaaaaccaatatggcaagaaagtgacctctggtcatcctcattactcattatgcactaattataatgcgttagcatgataagaaactcccaccagcaccatgacagtttacaaatgccatggcaacatcaggaagttaccctatatggtctaaaaggaggaggaacccttagttccaggaaatccctaccccttttctggaaaactcattaataatccatccttgttgagcatatattcaagaaataagcataaagatagcttatctctatgctatttttatgtctatggtgtagctattcttttgttcctttcttaataagcctgcttccactttactgtatgggcttgccccaaattcttttcttgcgttaagatccaagaaccctctcttggggtctactctgggacccctttttagtaataattttatctctaaaatgcaccttaaagttctccacctctctccgtatacaccacatccaccctggaattaaactccagtctctaggccaggacagctgcagtagtttcctaacggctctctgtctctcctcccatctccctccacactatgttccatagaacagctggagtgagttttccttcaagttcaggggtacatatgcaggatatgcaggtttgttacagagctaaatgagtgccgtggtggtttgctgcaaagatcatcccatcacctaggtattaagctattcttcctgatgcactccccaacccctccaacaggccccagtgtgtgtgttgttccccatgtgttctcatttttcatttcccacttataagcaagaacacgtggtatttggttttctgttcttgcattagtttgctgtggataatggcttccaaccccatccatgtccctgcaaaggacatgatctccttcctttttatggctgcagagtattccatggtgtatatgtactacattttctttatccagtctatcatcgatgagcatttaggttaattccatgtctttgctattgtgaatagtgctgcaatgacatgtgcatatgtcttttcaataggatgatttgtattcctttaggtacatacccagtaatgggattgctgggtcaaatggtatttctgcctctaagtcttttttttttttttttttttgagacagaatatgggctctgtcgcccagtctggagtgcagtggtgcgatctcggctcactgcaagctccgcctcccaggttcatgccattctcctgcctcagcctcccaagtactgggactacaggcgcccgccaccacacccggctaatttaagtctttgaggaatcaccaccacactgtcttccacaatggttgaactaatttacactgccaccaacagtgtaaaagcgttcctttttctccacaaccttgccagcatctgttgtttattgactttctaataatagccactctgactggtgtgagatggcatctcgttgtgggtttgatttgcatttctctaatgatcagtgatgttgagcttttttgcatatgtttgttggccgcgtctatgtcttcttttcagaagtgtctgttcatgtcctttgcccactttttatgggttttgtgtgtgtgtgtgtgtgtgtatttgtttaagttccttgtagactctggatattagacctttgtgagatggatagattgcaaaacttttctcccattctgtaggttgtctgtttattttgacgatagtttcttctgctgtttcttttgcattttagtttaattagatcccatctgtcagtttttgcttttgttgcaattgcttttggcatttttgttatgaaatcattgcctgtgcctatgtactgaacgatattgcctagattttctagggtgtttatagttttgggttttatgtttaagtatttaatccatcctaagttaatctttgtatacggcgtaaggaaggggaccagtttcaattttctgcatgtggctagctagttcttccagcaccttttattgaatagggaatcctttccccattgcttgtttttgtcaagtttgttgaagatcagatggttgtagatgtgtggtcttatttctgagttgtctattctgttccattggtctatgtgtcttttcttgtacaagccatgctgttttggttagtgtagccttgcagtatagtttgaagtcaggtagtatgatgcctccaactttgttctttttgcttaggattgtcttggctatacgtgctcttttttggttccatatgaactttaaaatagtttttctaattctatgaagaatgtcaatggcagtttaagcgaaatagcattgaatctataaattactttgggcagtatggccatttgcatgatattaattattcctattcatgagcatggaatgtttttccatttgtttgtgtcctgatttctttttttttttttttgagacagagtttcacttttgtcacccaggctgaagtgcagtggcgtgatctcggctcactgcaacctccacctcccaggttcaagtgattctcctgcctcagcctcccgagtagctgggattacaggcacccgccaccacacctgcctaattttttgtatttttagtaaagatggggttttgctgtgttgggcaggctggtctcaaactcctgacctcaggtgatccacccacctcagcctccaaagtgctgggattacaagcctgagccattgcgcccagcccctctctgatttctttgagcagtggtttgtagttctagaaaagctccttcacttcccttgtaaattgtattcctaggtattttttcctttctgcagcaattgtgaatgggagttgattcatgatttgactctctgcttggatgttgttggtatataggaatgctagcaatttttatacattgattttgtatcctgagactttgctgaagttgctcatcagcttaagtaacttttgggccgagatgatgggattttcttgatatagaatcatgtcatctgcaaacaaagataatttgacttcctcttttcctatttgaataccctttatttctttctcttgcctgattgtcctggacagaacttccaatattatgttgaataggagtgagagagggtattcttgtcttgtgccagttttcaagaggaatgcttccagcttttgcccattcagtattatattggctgtgggtttgtcatatatggctcttcttattttgaggtacgttccttcaatacttagtttattgagagtttttagcatgaagggatgttgaattttatcaaaagccttttttgtatctattgagataatcctgtggttttcatctttagttctgtttatgtgatgaatcacattaattgatttgtgtatgttgaagcaaccttgcatcccagggatgaaaccaatttgattgtcatggataagttttttgatgtgctgctggaattggtttgctagtattttattgaggatatttgcatcaatgttcatcaaggatattggcctgaagttttctttttttgttgtatctctgccacgttttggtatcaggatgctagcctcatggaatgagttagggaggagtccctgtccctccttttcaatttttggaaataatttcagtagaaatgataccagctcttctttgtacctctgggagaattcagctgtgaatccatttgatcctgggctttttttttgcttttggttggttggtaggctattattaattgctgcttcaatttcaaaactaattattgttctattcagggattcaatttcttcctggtttggtcttgggagggtgtatgtgtccagtaatttatccatttcttctaggttttctagtatatatgcatagaggcatttataatattctctgatgattgtatttctgtggggtcagtggtgatatcccccttattatttctgactttatttcattcttcttttattctttattagtccagctaacagtctattttttcaaaaaaccaacccctggatttgttgatttttgaagggtttttcatgtttctatctacttcagttcagctctgatcttggttatttcttgttttctgctacctttggggtttgcttgctgttggttctctagttcttttagttgagatgttagattgttaacttgagatgtttctagctttttgatgtggtcatttagtgctataaatttctctcttaatactgctttagctgtgtcccagggattctggtacattttctctttgttctccttagtttcaaagaacttcttgatttctgtcttaatttcattatttacccaatagttgttcagaagcagattgttcaatttccatgtagttgtgtggttttgagtggaaattcttaatcttgagttctaatttgatagcactatggtcagagagactgttatgatttcagttctttttcatttgctgaggagtgttttacttctaattatgtggtcaattttagagtaagtgctgcgtggtgatgagaagaatgtaaattctgttgttttggggtggagagttctgtagttatctcccaggtccacttgatccagagctgagttcaggtcctgaatatctttattttctgtatcaattatctaatattatcaatggggtgttgaagtctcccactattattgtgtgggagtccaagtctcttcgtaggtctccaagaacttgctttattaatctaggtgctcctgtattgggtgaatatatatttaggataattagctcttgttgttgaactgaaccctcagctccatcaggttggttatgttcctctctaaactggctattctagttatcagctcctgtattgtttagattcctagcttctttgcattgagttacagcatgctcctttagctcagtgaagttcaatattacccaccttctgaagcctacttctgtcaattcagccatctcagtctcagcccagttctgtgcccttgctggagaggtgttgtagtcatttggaggagatgaggcactctggttttttgagttttcagcatttttgcattgattctctcccatctttgtgggtttttctaccgctgatctttgaagttgctgacctttgaatggggtttttgtggggtttttgttgatgttgttttaacagtcaggagattcttccatagggcttctgcggtttgctgggggtccactccagacccttagttgcctcagtttttcccatacctggaggtatcaccagtgaagactgcaaaacagcaaagatgacagcctgctccttcctatagaagctttgtcctggggggtaactgacctgttgccggcccaaatgcacctgtaggagatggctggaaacccctattggggggccttattacccagtgaggaggaatgggatcagggacgcacttatagaagcactctggctgctttttgtagagcaggtgtgcttcactagggagaacccttccttgtctagactgtttgtattctccaaagctgacaggctggaacagctgagtctaccaaaccacagagatggcagccaatgctccccttaggaactcagtcccatctctggcagactgttgccattggctggctggaattctaagccagtgtgtcttaatctgtgaggtgccatggatgtggggcccacagaacaacgctgcttggctccctggattcagcccccttcccaggattatttacagatggatatcctaccttgccagggatccgagggtcagagaatgtaaaactcctgggtctctttgtgtctgagaagctgctctgccaagactgcgtgtagctttgtgtatcggactcaaggccctggtggcacaggctcacaaagggatctcctgatctgcaggttgcaaagatccatgggggaattgtggtttcctgagtgggcttgcacaatcactcaccactttccttggctaggggcaggggttcctttggctccatgctgttcccagttgggccatcaccccacccttcttttctttgttctcttcgggtcaagttgtttgcctagtcagccccaatgcaagaacctggatatttcagttgaaggtgctaaattcactccccactttcattcctctccatgagtactgcagctgcttctaataggctatcttggcccctctgcctttggaatcactttctaaaggcaaaactgaccatgccaatcccatccttaaaattagttcattgcctcctaaatacaattttaataaaatccaaattctttacagtgacctaaaatccctgcctgagcttactcacgattaccacacgagccatgtatctgcaacaggggacaatatcaacctccagggaggtgaatattggttctggaggggaagagaggggataaagtaaatctttctttttccaacgtataaagaacaggtatagatagagcatatataatacctatgaaattaaaatcttatggaaggggaacaattagaaaaagagtttaaagaaaaattgagagatccgcctaatctaatctcaggttcctcttccccttacctataagaccagcgctacacaatatagtagcccctactgacatgtggctactgaacacttgaaacatacctagtacaaaaggaaaagcaaagttttaattttgcttaaataaaatttcaatagccatatgtggctagtggctaccatagcagacaacacagctctagacactctgacagacctcgttttggttcaaggatatcaagccctttgcacatgctatctgtatctatccatgctagagtcaggatacttttgctacaaataacaaaaattcagagtggattaaacataagtccagatgagagaatccagggttggctaattcaacagcttcaatgccattatcatggatccaggttccttccatcttccttcactgccatccctggtgcatgagcactaccctaagattgttcccctaagagtcacagtatgtctgccacagcaccaggcatcacatctaaacctaatgctcagtatgagactgtagctgtctcttttttgttccttttaaaaatgagataaaacatcacctcacatctcgttagccagaattttatcatatgtctcttatcaatcactggcaagaggaatgggatcactacacatggctcagatgctacaagagccattccctggagctgaatatagtgctggtccccaaaacatatggctagaggaggatgatggatacttgatcaagccagggccctgtaggaaagtagggacttgcacaccttgtattaaggaggtgagtgtgaaagtagaacttcaccctctgttctaggtagaactaagttgagctagttgagaatatccctgtgccactggttttcagagtgttgttatccataaactttttagagaactgaaaattgtcaggtcccaccccaaacctattgaatcaaactcaggatggtgcccaagaatctgtgtttcagaaagtcttctaggagattctgatacaccctagagtttgaaaacattgccttattccagtggttttcaattgggtggtggtggtggggattttgcctgtaggggacatttgacaatgtctagagacatttcggttgtcacaactggagtgcagggtgctactggcatctagcagtagaggtcaggacaacgtgcaagacagtctcccacagcaaagaagtgtccagccccaaatggcaatagtgccaaggctgagaaaccatggggcagaggaagctcctttacaatggctgcagcccgcctggctctccatgtaggattcggtctttgaacctgtttagcgcaaggattagcatctgtcaagcaccttcagagcaaaagagatgtcagactgcccttgcccacagtctaatcgacttgtttctaagcaatcagtcttctagcagtcaactcacatcagtcccaggggtcattaaagtatccatccatagcaaagcaataaaacaggacacaatgatcatcttcgggacaaaaaaaaaaagacattttttaaggagcacagtcaatatacacattggctggcttttatgagggcctaattcctctatcttagaaagttgacatgctgtttggatcaagcaaatttttttccctgcttaggaatctttctgttcaattgagtctctactgccacatctagctctcttatggggccaggaaatggagatcaaacatccagttctaactaacattctctagacaagacacaagcaagaaaccatgcattgtctgtggatacaatttctctccatgagagtttgaagttagagaaagcagcaaatcctatcagagtagccaatgccacaatcagttcagctcaagctcacctcatattaaacctatttccaagggttttatggcacagcttgttctaccatgatcatcacgtgagctcttctggcccttacttaatgtaacacttccaggaacacatgtgctggtaaagtttatttgcgttaatattctctcatgtcaatcacatgtaagccctggaagttggtttttatatacagaatccagtgccttcctgggagaactacttttttcccaaaacaaaagacgacacaattagtatgataattgcggagtttaatgaacaccttgcttcacttcggggtctcatctgggatttcggagtgaactgtgtccagaggctgccagtggcaattcatgagggagtcgtagagttcttcacttttcaccataaactcttggtttgattcctcaatattcaaatgaagatgtggatctgcagaagccaataatggatatgaaaaaaatagagttttacaggacacatactagaaatagtttaaaattagaaagcttttagaaagcatttgcaggaagtactgcagatagtaaaggttaaaattcttaaattgcatatttcctttcaataagacttgaaaatagaaatttaagctataaaagtagtagtgtcatcaaactcaatgagcatccagctgacagaagagatggaggaaaaaaatggacagatttcagatgcttgggggatggattcaatttgggaggaaaggggaaaaggaaggtcaagaatgactgccatgtttctggcatgagccagatagatacaatgccaaacaatgaaccaagccaagggccccttggacaggggtttgtaaaaatacacatgctactttaactgctcagttaacagataaagtgaattaattttatacagcaactaattcagaaagacaggaggacttggccttccatctccgaaccctggaaccctgtgacgagatggtattatgttattgcgaacgtattaaacgtggattttctgcccaagttgtcaggtttccagagctttccaaggcttacaaggtcattaatttttttaatctatttttttcctctccttgtactgaatgtaatggaagaagccttttatgttttcctttgtaatttttgcaagccttagttccttgaggatcataatttgcttcctaatactcatatgggttcatgctattcatctgtatgcttattagggactaaatctttgccccacaaaattcttctgttaaaagcctaacccccacaatgtgaaggcatttggagatggggcctctgggaggttagatgaggtcataagagttgggtgctggtctgacagaagtagtgcccttataaaaagcgacagcaggcaggacacagcaactcatacctgtaaccccaacactttgggaagctgagaccagtgaattgcttaaatctgggagtttgagatcagcctgggcaacatactgagacgtcactacaaaatataaaaataattttttttaaaaaaagagcagagaacttgctcacattctctcctacaatgcatgcataaagaggtcaagtgtggaaacagcaagaaggctgctgtctgcaagccaagaagagagccctcgccagaaaccaaattatccagaccctggatattggatttccagcctccagaatggtaagaaaataaatctttgtttaaaccacccagtctgtggtactatgttacagtagccctagaagactaatgcagtactcttctgtatttatcattttagaaccaaaatggtcaaataggctttagtcatcatataaattccatgagctacttctcacttttcttcattggagtcattcatgattgtgttgtctgattcttattctttagagcttcccatcccttttgagtttcctttgagcgtttctggtcataaaagtagatgtttcccttttttcccactaaacattctgaaattttcttacacttctgtccccggttcccttcctttaccgttatgggcagttgtctgctaatgggtccctgactgcatgcccctggtggggaaagaggagttaggatcatatgcttatgagcatgctctccacttaacctgtggccaagaaaacagatatagtgtggtcagctccaaaccccagattacatgatctctgcccttccagtgatgttgatcaaaactataatagaagcctattcaagacaaactaattatatcatccctaaacctgtgaatcttctagacccatgttgtccaacacagtagccactagccacatgcagctattgagcattgctggccctcactgagatgtgatgtaaggataaaatatacaccacattgaaagcagaatggtggttgccaggggatgagggaagggagagtgaagagttgttatttaatgggtatggagtttcaggttataaaatgaagagttctggagatgaatggtgatggttacacaacattacgaatgtacttaataccactgatacatttaaaagtctattgcttcccggccttttggctaagatcaagtgtgatacatttaaaagtcaagatggtaaattttatgttatgcatatttcaccacaataggaacaatttaaaactctgcttgaaggtaatgtctgaatagccctcaaaataagggtcccctcaatctgcaggtgagggggcagccattaaaagaaaaaaaatagaaaaaatatatgctgcatttcaaagacttgatgtaaaaaaagtcgttaatttttatattgattgcatgttggaataatatcttggatattgccttagtttgggctgctaacaacatatcagaaactgactagttcgtaaacaacacacagttatttctcacagttctggaaaccggaagtccaagatcagggtgtcagcgtggttgggttctggtgaggaccctcttctgggttgcacactgcccagaagtcatgtcttcacatggcagagggcagagagaggaatcaaattccctcgtgacttttataaggtcaccatttccattcatgagggctctaccctcatgacctcacctaatcctaatcatctccctaaagacccatctcctaaaactatcacattgggagtgagggtttcaacatatgaatttggcgagggggaggaacacaaattcagtccataccagatattaggttaagtaagaaacattaatttcacctatctcttgagttggttctttaatttggctactaaaaaatttaaaattacccacatggatggctttgtgtttcacattgtctatttttaaatttctatgtgtttcaaactgacagagaaaactgtatgtatttatcacgtacaacatagtgttttaagtatatattcattgtggaatgatcaaaggatcaaataactacctcacatagttatcatttttcatttttgtggtggaaacactgaatatccactaagtatttttctttctttcttttttttttttttttttaaaagactagtcaaatgcagcagtaagaagcaaggaaagagtagaacaaaaagttcaatctgtaactgactgaacaaccaattgcgataactcactaccttcgaattagcctgtatttcttcattaactatagtcaccatggtatacaatacattttttttttttttttgagacggagttttgctcttgttgcccaggctggagtgcaatggtgcgatctcagctgactgcaacctccacctcctgggttcaagtggttcccctgcctcagcctcccaagtagctgggattacaggcgcacaccaccacactcggctaattttttgtatctttaatagagatgagggttcaccatgttggtcaggctggtctcaaactcttgacctcgtgatccacccacctcggcctcccaaagtgctgggattacaggtgtaagccaccgtgcccagcctacaataaatctcttgaacggtattcctcctagctaactgaaattctatcttttgaccaacatctccctaccactctctccctgcaactaccctagcctctagtaaccaccattctatgctctactgctatgaaataagctttttaagattccacatgagtgaaatcatatggcatttgttcttccgtgcctggtttatttcacttgacataatgttctccatgttcatccatgttgccacaaatgacaagatttcatcctttttacagttgaatagtattctattgtgtatatacgcattttctttatccattcatccacttatgggcatttagtttgattctgtatcttggctattgtgaatagtgctgcaatagacacggaggtacagatgtctctttgacatactgatttcatttcctttggatatatgcccaatagtgggattgctggatcatatagtagctctactgttaataatttgaggaaacgccatactttttataactgctgtaccaatttacattcccaccaacagtatgcaagggctcttttcttcacatcctacccaacatttgttatctttcgtctttttgataacagccattctatcaggagtgagacgatatctcactactgtggttttaatttacagttctctgatgattagtgaagttgaacattttctcatgcatctattggtcatttgtacatcatctcttgagaaatgtcttaaaaaatggccgggcacggtggctcacgcctgtaatcccagcactttgggaggccaaggtgggtggatcacctgaggtcaggagtttgagaccagtctggccaacatggtgaaaccccgtctctactaaaaatacaaaaattagctgggcgtggtggcgagtgcctgtaatcccagctactcaggagtctgagactgggttcatttgaacgggggaggcggaggctgcagtgagccgaaatcacgccactgcgttccagcctagacaacagagtgagactcactctcaaaaaaacaaaacaaaacaaaacaaaaaacttatccctgtaaccaaaaaccatctgtacccccaaaaactattgaaataaaaatttttttaaatgtgcaaaagacctgaataatcaggttattttcttgctaatgagtcatttgatttccttatatatttagcatattaaccccttattgatacaggagttaaaaagaaattatttagggtaagaaagtcctcggtaaggttttgcttttcatgaacagctgcccccaaatcattttcttttctaacaaacagcaacctgtaaaactgaactgcagacacagacaagcaagctagaagcttgcacatgcaaatgccagcagttgtgccaataggaaaaagctacctaaggaataggcatgttcaaaatggcggctccatcttctctttgccagccacttgtgcagtaaggagcggacaagatggcggacaagtggaaagtctatttgcataataagatcagggtagggcaaccagccttcgcctggcatcatgtagacgtcacacctggtctagccaatctgggccctacataaatcagacaccgcctcctcaagcctgcctgtaaaattgcctgctgtctgctacaggcctacttttccttttcggaggcctgtttcctgtcacacagagctgctctcctctctcctttcttctacctattaagccttgcactccttaacccacccacatgtgtccatgtccttattcctcctggtgcaagacgacgaaccctgggtatttaccccagaagatgcctcttcataatcacttgcatagcgtgcaaatattttctcccactccgttgtctgtcttcactctgttactgtttcctttgctgtacagaagctttttagttcactgtgatactatttttctatttttgcgtttgctgcctgtccttttgaggtcatatccaaaaaaatcattgcccagaccaatgtcgtggagcttttcccttatgttttcttctagtagtttcacagttttgggtcttacatttaagtctttaatctattttgagttgtttttgtatatagtgagagataaacagtctaatttcattcttttgcatgtggacattgttttctgagcaccatttattgaagagactgccttttccccattgtgtgttcttggcacctttgctgaaaatcagtgggctataaatgtgtggatttatttctgggctctctattctgttccattggtttatgtgtctgttattatgccagtatcatgctgctttggttaccacaactttgtagtacaaagtcaggtagtgtgatgccttcacccttttttttttttggctcagattgctttggctatttaggtttttttgtgattccatacaaattatagtatcatttttttctttttttttttcccaagacagggtctcactttgtcacccaggctggagtgcagtggcgccaccttggctcactctaacctccgcctcccgggttccagcaattctcccacctcagcctcccgagtagctgggactacaggcacgcatgccactatgcctggctaatttttgtattgttagtagagacggggtttcaccatgttgaccaggctgttcttgaactcctgacctcacgtgatcctcccacctgagcctcccaaagtgccaggattacaggcatgagacactgtgcactcggtcatttttttctatttctatgtagaatgccattggtattttgatagagagtacattgaatctggctgggcatagtggctcatgcctgtaatcccagaactttgggaggccaaagcaggtggatcacctgaggtcaggagttcaagaccagcctggccaacatggagaagccccatctctactaaaaatacaaaaattagctgggtgtggtaattccaatcctactgtaattccaatcctacttgggaggctgaggcaggagaattgcttgaaccctggaggaggcggttgcagtgagccgagctcaaacaccactgccctccagcctgggcaacagagtgagactgtcttaaaaaaaaaaaaaaaaaaaaaaaagacagagagagtgcattgattctgtagatcactttgggtagtatgaacattttaataatattcattgttttaatccatgagcatgagatatcttttgtgtcttcagtttcttccatcaacactttatagtgttcagtatagacatctttcacctcagttaaatttactcttaagtttttgttacagctattgtacatgggattattttcttgttatctttttcaaacagtattagtgtatagaaacaattttgtgtagtaaagttacaggatacaaaattaataagtttattagacctaacagttttttggcagagtctgtagggttttctctacaggcatacctcagagatattgcaggtttagttcctaaccactgcaataaaatgaatattgcaatgaagcaagtcacatgaattttttgtttcccagtgcatataaaagttgtttacattggctgggcatggtggcttatgcctgtaatcccagtactttgggaggccgtggctggagaatcacttgagctcaggagttcgacaccagcctgggcaacatagtaagaccttgtctctgtttttaaaaaaatttttttaaaagaacaaatttggccaggcacagtggctcacgcctgtaatccccgcactttgggaggcggaggcaggaagatcatgaggtcaggagatcgagaccatcctggccaacatggtgaagccccacctctactaaaatacaaaaaattagccaggcatggtggtgcttgcctatagtcccagctacttgggaggctgaggcaggggaatcacttgaacccaagaggcggagattgcagtgagccaagatcgcaccactgcactccagcctggcaacagagtgagactccatctcaaaaaaaaataaaataaaagaacaaatttgtttacaatgtaaataccttaagaaatagtttattgcggctgggcacggtggctcatgcctgcaatcccagcactttgggaggatgacgtgggtggatcacctgaggccaggagtttgagaccagcctggccaacatggcgaaaccccatctctactaaaaatacaaaagttagctgggcgtagtggcaggtgcctctagtcccagctactcaagaggctaaggcagaagaatcgcttgaacccggagacggaggttgcagtgagccgagatcacgccactttactccagcctgggtgacaaagcaagactgtctccaaaaaaaaaaaaaaaatagaaaaaaaaatagctcattgctaaacagtgctaacaagtaagcacataccgtttgcgaaaatggcacagatacacttgctcaatgcagggctgccataaacttctaacttgttaaaaaaaaaaaacaaaaaacaaaaaccatagtctctgtggaacataataaagtgaagtgcaataaaatgaggtatgcctgtatatcacatcatgtcatcttcaaaacttcttcctttccaacctaggaacctttagtttctccctcttgcctaactgctctggctagacttctaatattatgttgaatagaagtagtgaaagtgggcatccttatctggtttcagatcttagaggaaaagctttcagattttccccgttcagtgcaatattagctgtgagtttgttatatggactctattgtattgaggtacactccttttatacctaatttgttggaagtttttatcatgaagagataactgaattttgtcaaatgatttttctgcatctactgaaatgatcaccaagcgcagttgctcatgcccgtaatcccagaactctgggaggctgaggcaggcagatcacctgagctcaggagttcaagaccagcttgggcaacatggcgaaaccccatctctaccaaaaatacaaaaaattagctgggcatggtgtcatgcacctgtggtcccagctacttgggaggctgagatgggaggattgcttgagcctaggatgcagaggttgcagccgagatcacggcactgcactccaacctgggtgacagagtgagaccctatctccaggaaaaaaaaaagaaaaataatgttttttgtccttcattctgttgatgggataatgggatgtatcatgtttattaatttgtgtatattaaactatccttgcgtccctgggatgaataccacttgttcatgacagatgattttgtcattgtgctgttgaattcagtttgctagtattttgttggggacctttgcatctatgttcatcaggaatattggttgtagttttttcttgttgtgtccttttctggttgtgatatcagagtaatgctggcttcataaaataagtttcaaagtatttcgtcttcgattttttggagtgtttaagacatggcattagttcttctttaaatatctgggggctgggcatggtgactcaggcctgtaattccagcccttggggaggcagagctgggaggatcgcttgagcctaagagtttgagaccaacctgagcaacaaagtgagactccacctctacaaaaaataaaataaaatgaaaaataaatgtttggtagaattaaacaggccatcaggacctgggcttttctttgatgggagacttttttttgagacagggtctcactctgtcacccaggctgacatgcagtggcacattcatagctcacttaagcctcagtcttttgggcacaagcaatcctcctatctcagcctctcaaatatttgggactataggtacatgctaccatacccagttatttttttaaattttttgtagagacaaggtctcactgtattgccaagtctggtctcaagcccctgggctcaaatgatcctcccctattagcctcccgaagtgcttgggattataggcattatccaccaggcctggcctgatgggaaactttttattactgtttcaattccttattattggtctgttcaggttttctatttcttcataatttaatcttggtaggtggtagattgtatgtgtccaggaatttactcatttcttctatgttatccaatttactgatgtataattgttcataattgtcttttatgttcctttgtatttctgtgatatcagttgtaatgtctcctttttcatctgattttgagtttcttttgttcttaaaggtttgttgactatcttttaaagaaaccaacccttcattttgttgatcttttgtattgtttttctagtttctatctatttttgctatagtctttattatttcttttcttctactaattttgggtttactttgttcttgttcttctagctccttgaggtgcaactgcattacatttctactgaccagtactgtgccagattgatgaccagccaatacttgagtgtttatgatatggcagcagctgtttaaccacctaaaagtactgtagacctagcatacccacacttcctataagaaaggtatcaatgtccccactttacagaaactgaagcagacacactagagattaatttgtctggaattacagagctagtaggtagaatctgaaccccgtggcaatctgtatccaaaaagcagacttttacctctattattttgatagaggcatgggacagccaaatgcctaggcaaatagggtaaggtccctggagaacctccaacctgcccaagtcattgtgcacagggggcttggctaaacatgcccacggtgaaaaattccatcttttaacacatgtgcaataagggaaataaatcaatgtggagtggctcagactaagggcccacgtgcacattggaagaatgaggaggagtcaccaggaattcacaccttatgcaggggaggagcctggccttttcaactcgtatgtgatggcctggtattcaatttgtgaggtggaaacctgtgtttgggatccctctttttgttaagagctttcctttcacttaataaattccatcctcctcacccttcaatgtatccacatgcctaatttttcctggttgtgagacaaggacccagatttagctgaactaaggagcaagaaatcctgcatcaattttaataaattgcataactgataaaaggcaggaagaaagactcacacttaatctgaaagaaatcccacaaagttgaaataagcaccctttactcatgtttaaatcaaagtactaaaaactacaactgctcaacagcatataaacatttcttttcaacaccaatttgatttaatttaaacactgagcacctactgacatgtgaactctctgaattagtaacagggcctacaaagactgataacaacatgctcccttctttgataaagtcataaaggcagtgggtgggtttgtctggtaggggcaggggtttgggcaagagagagattagacaaacatgtgataagacagacatgtgataagaaaaaggcaatagtgttctctgcatttctcctctatttttctttcccattacttaaaagaagcaaaacattttttccccttcctcaaataagacacattcagagtgtttgtctctaggcaggcaaactttgttctttccaaaacaaattgagaagtacaggaagcaccaccagactgacactacagtgctgctctgtcaggtaccccaggatccaataaccctgaggccacagcaatcacctcatgctcttcccccttgaaaaagagaattaaagcataattctcctcaaagtctaaacttacagaggaaatggagcttaagaacaatgtattgtcttcttactgtttgggaatgtccccctttctcagtccttcagaaaggcccaaagaggtggcttagttaaagttgttcccatagaaccagtttctaaaaacaggagaaattactgaagcatatggcttaggcaacctacattggaattttccaatagaaccttccagtttctagcaagctgagtgaatgagaaaccaggaaatggggttttgtttccaaccacttcagcacaaggtttatgttaccttctagtgggtcttcatcttggttttcagctagaggtgtggtttcctgcaacaaaatattatctcatgagaaaataattttacttaaaggtttaatatcaatacatactttattgggaaaaactctagctctcaaaaaaactacctaaaataaaaataatattgacaattaatctctttaaatcaacttttgaatttgatgaaaagaatctttaggtggcatagtacaattatgaaagaagtaaactgaatcacagaagaactgtcacaaagaggaacaagcctaacgagggcccctggcccctggattttctgggacctaactagcatcctagagcctgagctaggaaaccagacaccagcgaccctggtatccaggctccttatttcttgtactacatgcctgactctacctagagttctgctcctccttccagaagacaatctgttaagtctccatgagcacgtttttctcatggccttctaatcacatcctcaaacccgtgactcagctaagaaccaggatattaggtgctcaagaaaatgcagaggctacagcaaagcaaaccaatcatatccttacataatgagagaagtaaactgcagaggtactcccaaagtaaatcttggttggttaacccagaccctgttggctctactggggcagcatacgtttttatgattcttctatgtagacctgttgggaacctgtctttttaagtatggccagctattccaaggaatcactatcaagaaagggctgatgtagctcctggcacttaattaagcttcccttgctaataagaatgagaagatactgagagccaaagatctactatcttttcttttcagtctatctgaaagtatgcctccccttcactctgaaatatactgaggtttggaaaataggttatatagttaccataaatttcaaaagacaatctgtcttttttctatttagatacggctaagaccgcaggcatggtggcatgcagccggtagtctcagctacttggaaggctggagcaggaggaccacttgaacccaggagatcaagactgcagtgagttatgatggcaccactgcactccagcctgggcaaaagagcaagacatcatctctaaaagctaattatataaaaagaaaagaaagaaatggcaaagacacccagaatccacacttccataagttcctttcccataatacaagacttgagtaaccacacatttcctcctttcagtgtgtgttctggtaaatgtggatgctaaataaccaggatgagggaagcaggaagtatctggagacagagcattctctctggtctgagggccacctgtgctgtgtatgcagctggctgcctttaaagaaaagcacatttataaaaggctttcctcagctagagatagtctgggaaggtgtgctgatggaccacaaagacccgagaatcattttggagacatccacctccacaacgtgaaaatgtaaaggagagggctggagagggggtaacccctttaacttggggagataaaggttatggacagaggcacagcacattgggggaagcagggaatgactaggacatcttggcaaggacacacgttattggagaagaccaaaatggggatgtgggagtaaaagagcgccaccacagaggcttaccatctttaatttcactcagcagcttcccaacaggggacacccagcaggatggcaggcagatggcacagggggtcactacagccacaaaagataacatatttatataattcttgtatgaaaaatgcatgttatagtaataattcggcctgagggtgagataaaaatcccagactgtgccaacaaaaatggacagaggaattgagagaaggggtagccaggtgagaaaaaaaggatgttcatttcttaattttctcaagagtgacgaaaaaatcaagaaatacttttgtttctgaagttgataatatactaattcctatacttctctatttagagatataagggtaaccaccaaaagacagaccgtctcccaaaaaagagcaaaaagagaaggggcaaaagaaaaaaaaaaaaaaaagagtgccaaaaccacaggcaatgtagtgaaagattttttttttaagtgctgcaatatcaaacatctgttaaaagggaaaaacccaaattgggctaaaagggggaaaaaatgacaagaaatctaacaagatattttatataagaggcacacctaaaacagacttgagaaaaattgaaaatgaaagtttgggcagtgaaatatcataatataaagcaaatgtaagttttaaaagccaagggactagatataaaattcaattttcattttaaggtaaagatcatcacacaaatggtgtcactctgcatattaggagacaagctggggtgggggaagtccgtaacatttagactccaaagtgttaatttctctaacatgtgaatatcttatgcagtcaagcaagagggacacaactcaacagaaaaattagaaagaggatatcaaagtcacagaacacagatagcaataaacatttcaagaggtatttgccctcaataatagataaatgcctccctgccctattagattggctaatcatacacagacaaatgtagagtagcaagaacacccaccacaataatgaaaagtgtaaattcatgcagactttaggtaacttgctattaaaattttttaatgttatatcctttaatccagcccttccacatccagaattatattcttggggaaaaaagcaacactcagacaaatgcttgaagataggtaagtttgttaaagccctgaaaatatttaaaatgtcagataagggatgagctaaaaatcgcaatgtatctaactgcgctcgctctgttgctcaggctggagtacaatggcacaatcatggctcattgcagcctcaaactcccggactcaagtgatcgtcccgcctcagtctcccaagtagctgggactacatgtgtgagccatcttgcccagaccataagtggacgattttttaaagaaaggtctccttatgcagaagcaagcaaacagcaaaccagtatgtactacatagttcgttcttgcccaaatcatcccctaaccaccaaaacagaaagatgaaccacattgatttagcaagagtacaggagaaagatctagaagacatagatccactccacagtactttcttctaagtgggaagggaatggggaaggaggaggggtgtgtgtgggggggaacttttcccttacttcaatacatctttgtgtgatttgagaaatatgtcactttagtaattcaaagtattaaaatatatttttaaagtgtgtttatgtccaactgctataaaacaaaccccaaaactaccttttgtcctatatagtgttaaagagtaaaatttatcgaattatgataatctaaaatttagcagcaagaatttagaaaaagacttcattagctttttgtgttgtttctagaagagaatgggaaattatctgcaagtgaacacttctagtttatacacgtccaaactcagcaaatcatataaattaaacatgtgcagggactttttgtgtattatacctcaataaagctatacaaacatttttcttaggctatcagctttactctctagtattaaaacaggtagcaaaagccatgtctgtgggaatttggatgacaggacacagatgtgtgaagataggaaagtgatgtttactattattgggcacacgaatgacacaagattcattctagcaagggataccttaggcataaccagagttccagctgtgtgttcaggggtctcatgcgcagaaaaacagtcctttccatttccatccactgcacagccatagctgtagccagaaagaaggtaagagccgtgctgtcgcgcataccagttgccatagcggtaactctggctgggctggaactcctgcttcactctaatagcagaggggagactacaggaatgacaatcatcacaaccaacgcagaatcatccacaaacccccaaaccctttcttctttccaggaagtttgcagtaagctgaacacctatgttcaaagccatagtttgatacctaatgtagatgacgggttgatgggtgcagcaaaccaccatggcacgtgtatacctatgtaaaaaacctgcacgttctgcacatgtaccccagaactttaaaaaaaaaaaagccatagtttgtaagttaccaacagttatgtagcaaatagaacagtaacagctttccttttcaaagtaggagaaaaccactcacctttgccagtagcagtaatagttattttgttgagctatgccaaaatctgcagaactctctggttgggccatttacccagaaactttacaaaaagagagcagaatccagtttttattcctgcgtcaaaaatccagcttgtgggctgaaacctctcaatcctgacaaataagtctcgcaactacatctgagataattacatttagtggcaattcctgctaggcaattaattgcttgactttcctgacaacggggcaaaggtgtgggtgggggaggggtgtactgaggcacctgggggaacttctgcaatctgttcctcgggcttccacctgccagcccctctctcccaactgtcaggcagcgggagccagcagaaccccagggagggacagaaggggtaggtatgttggtcgacaatgaaggatagtctccactccaccccttaccataacaggtaaaagaggaaactctaataactaaaaccttaagacaaatacatttctctcctctgttacctgctgagaataactattggaactagcacctgctggctttttctttttttaattccacgcaggttgaaagcatcatccaactacctgcaaaattaagaggcagagaagaacgcgctccctcgcccccttcccttctctcctcttctcttacgctctacattaatgagagtacaggatacaattttaaagaaatatttctctggttcagtttttttttttaaaaaaagcataaaacttcccaaacttcgatgtgcattcaaatgacctggacttgtttaaaatgtaggttctctaacttgacagatttggagtggagcctcagattctgcctttattagccagctcccgccacttgaagtagcaaggttacacagtgtcaaaattcaggataacttttaagtccatatggggcacttagggtttggccatttccctgcagcttgctaataactaagttcttaatgtatttactatttacctgtaatgcgaaaaatagcaaacatgatgaattcaaaacattcggatcattcaatcattcaccagttattgagccattactatactcatccctgagtatccatgggagattgtttacaggatccccctcagataccaaaatccttggatgcccaagtataaaatggtgtagtatttgcaaagaacctacacacaccctcccataaaccttaaattctgtctggattacttataatacctaatacaatggctatgtattacttcatgtgggttcaccagtagtatccagcatgtggcaaattcaagttttactttttgaaactttttggagttttggggttttttgttttgttttgtttttgagatggagtctccctctgtcacccaggctggagtacagtggcatgatcttggctcactgcaacctccacctcccaggttcaagtgattctgctgcctcaacctccccagtagctgggattacaggcatctggcaccacgcctggctaatgtttgtatttttagtagagacagggtttcaccacattgcccaggctggagggcagtggcatgatctctcctcactgcaacctgtgcctcccaggtgcaagtgattctcctgcctcagcctccccagtagctgggattacaggtgcccaccaccacgcctggctaatttttagtagagacggattttcaccatgttggccaggctggtctcaaaacttctgacctcaggagatccgctcgccttagcctcccaaagttctgggattacaggcgtgagccaccgtgcccggcctcccaagtattttcagtccacgactggttgcatccagggatgcagaacccacagacgctgagggccgatggtatccgcaaggcagggtaactggcattggtgatgtactggagtttatagagagtggatttcctcatgtcttcaagggagattttattgattagcaactgtggcagacattgttaagtgccacccaatattggtttattttcttccttaataacaattctgatttcacttgggctagcaataggcccaagctaaaagactacatttcctagcttctcccttgcagcaagatgtggccaggtggtcagtctggctaagaagatgtaaacagaactagtagaaggggataggggaaagctgtgtgggaaaagggtatttgcttagctggagggtctggtgctgggattacaaatatgacggctggtgtcagaataactctgcagctatcttggactatgaggtgacatccaggaaggcatcatgcagaagaatactgggatccaagacagaatgagtctaggtcaccaatgactaaggactccttccactagcactagactggcctaccgctggtttacttaatgtcttgtttagaccactattgttatgtcaggtaaaacacaattcctaactactgtagtttagacagccaataaaacatgtcagttaaagattcttttcctgtaaaattttttttctctcactttaggactgactttattttacacaaagaaaatcacaattatggctataaccaggtaagcattgaggctgcagttggaaagcaacgtggaagttgaacattgaggaggtgctaaggaggctgaggaagagagaggtcaatgtaatcatgttgcaaccacctaggaagatggcagcagctgtggaacagaaggttgtaagcaagatcccagggtaaagatgggcacttaggccttggagatgacagtgacaagggctcacaagcgctgttttgctcactaaaagccccaaatgcaaaccttctgtttcaactagattactcccatgaatcaggtgaagcaaatttctattggggcacactactggacaggttcagggcacgtacagcattatctccacttcccttcgtgctggaaatacaaaggagaccaaaacccccaggaatacattcacgtgcaacctccatagtccttgaatttaacagagttgctgcctgtcacattgagaaagaggagaattcagcaggaatatgagactctcatatttctaacagggctgatttttctctactgtgtcctgcttgtaccccaggatatccactttaccaccctcaaccacccaagaagaaaaactagcttttactttaacaaaccgaagctaagcactcaacaaatatttgttgaatgaatgaataaatcagagcatagctcaagagcaaaaaccttttcaatcaataatttaaaagcaaagctacaaaacaatatcctctcgtgctttagtgtttaatgaactctcaacattggttgtttcttggcagctgcagatttcacaagaatgagattaaatggctttttacatcctgtatttggaaagagaataggaggatttacaggaagttatgctcagttccaatccagttaaacaggtatataattctcttttgtctttcttcagacaatgaaaatccgcaatctaagacctgaaactactgccacagccatgcataaaatgaaatgctgctgctttcctctctgttaaagagaatgttcaaggccgaggacacataaaaaagagcagcattgctggctctgttatttagctgtgtgttcttgaaaaagtcacttctccagacatatctcagcatttataacctaagactgaatcactgcattttacccttaatgaggtacgcttacactaatctttttgaaacagtacttaaattgtagcaggacaagccgcagacaaaacccctcagccagcgagtttaagaaagaagggctttattcggccgggatcttcggcaagactcacgtctccaacaaccaagctccccaagtgagtaattcctgtcccttttaagggcttacaactctaaggaggtccgtgtgagagggtcgtgattgactgagcaagcgggggtacatgactggggggctgcatgcaccggtaattagaacggaacagaacaggacagggattttcacagtgcttttctatacaatgtctctaatctacagataacataaccgattaggtcaggggtcgatctttaccaggcccagagtgtggtgccgagctgtctgcttgtggatttcatttctgccttttagtttttacttcttctttggaggcagaaattgggcataagacaatatgaggggtggtctccctcccttaaaatcctaatgctctcctccaaaaatgtatatccacatatttgcatataatttcatgggattcaaaacccctgaaatttatccaggaacccccagattagtaacacctggactagatgttgtctaagtcctctgagctctgtaattggttccactgatttctaagttttggggtttttttttctttttaaagtaaaaccactttgagttatgttcatggtgcttacaccatggtttccattctagaaccaactatattctaaaattcctggttggaacaaaagttacttaagcaagtaaaagtgtgacagtctggtaacagattctaaataatcacctttttatggtgataagctaaaatttattttaaaaagtgtattaaacaagtattaatacttctcaaacagcagttgagatgtccctggggtaaggagacagggcaccagggacattccagaagtaacagaatatacaaagcatgattttgaaagttttagcggtttttaatttgtggatgagggtgtaacacttttgcattaaaataaacagatatgttgtggagtaaaatgcataaaggcacatttttaaagataaaatgtgaaacttacaatgtcctgcttactaataccttgtctcacgtccagaggacacttacttcacactcctctaatcttagtggttctctggtggaaacttacacattacaaaaaaagtaatctattctaaatcctaaaataatttgattttttgtaacacaatgaagataactagcacaaagtaaagaaagaatgactttttttttgagacagtctcactcttgcccacgctggagtgcagtggcgggatctcggctcactgcaatctccacctccctaattcaagcgattctcccgcctcaccctcccgagtagctgggactataggcgcccaccaccacacccagctaatttttgtatttttagtagagacggggtttcaccatgttggccaggatggtctcgatctcttgatctcgtcaaagtgctgggattacaggcatgcgtgagccactgcgtctggccattttattttattttttgagacagagtcctgacctcaagcaatccgcctgcctaggcctcgcaaagtgctgggattacaggagtgagccaccgtgcccagccaagaaagattttggaagagtgaatgaatacaaggatttccactagactgagaattagtttgtcaacagcatttcagtgtcttgagaagtgtttacatttggcgtggacaaagctggcagatgacgtagaaagtaaaaagttgcctcttcaaagtttcccttcttgttaaagaataaatcataaatgttagaaacaatagtttcttttaaagactaacttacttcaagcctccttgctttgtgctaataactctgttaagccctattgtatgtaactgcgggacatgctcacaggcccaggcacgttccagctcacagcctgtttagcaaatcgggtatcagtttaagattatgaggtccagccccagccaacggatgcaggacacagcagtaaggacaacccaaaggcgtaagggacaaatatgtctgcttttcctttgttcaggagtgctctcaccatcgttccatctgcaattgagcaccctttctgcataaagtaaaaattgccttgctgagagatcttttgtctccatgctgacttttcttcgtgtcaccaattatctatttctaacaataacaaggtcttttctgcactgcagtgacaaccaaagcatcccaaatgaaatcatttctgcaagacccaaactagcctctattaacacgtactaacaattcagaacaccagagaagaaaagttattggaaacaaaagggtctaagcgctgaagcactgtatcgcacttgaaatggaggctgaagatttgagaaggatggactatgcatcttgtttaccaaatgacctactacggtgtttatgagaactatacgaaccaagatttactctgttgggagcttgtaggaaagctgtaatgtctaagacatacctgaatctctaaaccttattaaataaaactttttttttctttgaaagggggcctggctcgtcccccagactggaatgcagtggagcgatctcggctcactgcagcctcgacctcctgggctcaagcaatcctcccacctcagccttccgagttgctgaggccacaggcgggcgtcgccatgctgggctaatttataacatttttgtagagacggcatcaaaatatgttgctcaggctcactttgttttcccaactctcaaatgaaggctctggccgggcgctgtggctcacgcctgcaatcccagcaactttgggaggtcgaggcaagcggatcacctgcggtcgggagttcaaaaccagcctagccaacatggagaaaccctgtctctactaaaaaatacaaaattagccaggcgtggtggcgtatgcctgtaatcccagctactcgggaggctgaggcaggagaattgcttgaacccgggaggcagaggttgcggtgagccgaaatcgcgccaccggactccagcctgggcaaaaagagcgaaactccgtctcaaaaaaaaaaaaaaaaaaatgaaggctcactgctccctccccaggaggtgccgcaaccttggccaatacagccccagagttagacaagcagacagagaaagtgtgcagggctggggttctggcccgggcagacgggaacgcggacacatctagcactccgagtccgtcaaggcagcgcgagcgctgcgccgctggaacaagtcaccgcgaaccctaatcccacccctccttaccctattaacgacagaaagcctcgttccgctggtccctgaacaaaaactcctaccctactagtacacagcccacaacaatgcacgctgccggcgctacagcccctaagcaaccggccggaagtcggccccacctcctcctgatgtcacggaaatgaagggcttcgcagaggatgtcccgcccgctcccttcagacgggcgtagctggcaccttcctgagatatgcctgcttgcccccgatttttttctccttgcagtgagaacctcctcatgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgtttttttttttttttttttggtttccggttctgtcacctccaggctgagccgggctggcggaagaggcacgtgcgctgctgaatggagctggtcgctggttgctacgagcaggtcctctttgggttcgctgtacacccggagcccgaggcttgcggcgaccacgaggtgagataccgcgtagttagagacagtcggaggcggggccgggaaggtcgggtttggttcctacacagcagaggtgaacattggagcgcctgctgttcactggatgatttgatgaatcaaacctaagagacttaagagaaaagctaaccttttaaaccgtagaatggacattttatcaaaatgaggcaatatctgccttttctagtagacaaaaggtccacgggacacaaaggaaaccggcatttctgcatacggacaaatgagtcgtagattgtggatttaaggatcgatcccataagttgacagtattcagaatttaatgaaagaagatctcgctcttttgctgaatttctgccctggaattttacaaattactagaactagattaggataaatcccttataggtaaagcgataccaattcattatttgttgggaacttatggcgagctgggcggtggagatgcaaagatgctggaggtatggatcttgccttagagacgttgcctacataaggggtggaggactgaggagacgcatagatggagagaaattacagcagaatatgatattactagatgtgtgaatagataaaaaggtcaaataaattatcagtagtcaaataggtagataggactatactcacgactaggaatccgacctcctaacatctagctcacttttattcttgaagcaattctaagcattttctagaaaattgagtacagtacttctttatgaagtcaaggcgtcggtctttaattatccagaaaatttggaagtatatcacttggcctattgctttcgtttattttgtttcctactccagttatttgctctttgtctttggctgaaaagtgatgtgttttgaatagtcaaagatgatgctatttaattttttttttttgtagtgaaattacttaactgtgttccagacacacagtagtcctcacagcaaccctctgaggaggatgcagttattctcgttttgcagatgaagtaccaaaatgttggtcctagataggttaagtgactgctgaaggacacacagataataattgacacagctgaccccaaaatgtcaggagcccccgagggtctctgacatttgaaactcttaaccattaccctatacttctactaaatctaagcaatagcctagataacctacattatgtgaattttaaaaggttattatttgatttaaggccatagcagacccgcaaaaatgcttgattcaaaggaggcccccttggtcttaaatgatggaaggagtatcttctgtaactaaggacctgatttgcagtaacacatgttcaaagaagtttgatgggtttttttctttttcggtttgttttgcaaatactttttgatgcagttccttcagtttaaggagtgagtgagtgtgtgtgtgtgtctgtgtattttgctgtcatgcttcgcactcatccaatcagacttcctaatgctattgtcacatggcaataagcacagagttcctgagatttcgttattggtgattctctagagcttacgttggtactcatggaaacatacctttactctgttggtttttctttataagacttgtccactgggcgcggtggctcatgcctgcaatcccagcactttgggagggcgaggcaggtggatcacctgaggtcaggggttcaagaccagcctggccaatgtggtgaaaccctgtctctaccaaaattagctgggcatgatggcaagtgcttgtaatcccagctactcaggaggcttaggtgggagaatcgcagttcattgctgtgtatcaactgcttggaatagtgccagacacatagtaggcactcattatttgaaagaataaattcaaataaaaatgtgaatatctgaaaaaataaattaagtctcacatataaagtaaatacactaaagagttaaagatttgtgtaggatctaaaagtcttccttagtccagtctccattactgtgttctagagtgatgatacccagtgttgcctgcccacctccttgctttaccttcctcatcaagtctcaagtcctttgtggtaaactacatgtcattttgtagtttaacatatcatttttccatttataggatccattgatagttttcatgaatcgtggaatgatttatcttttcagaaacagataaatggttccgtgattcatgaaaactaccagtggatagagttggtagaactgtggtgtgactggcattaattgtatgttttcatcttcagcagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtaagaaaattgtatcccttaagatgagaacatagaggttttctttacaatttgacttcagttgaacaatttgttgtatctattttatagcagattctttgctagaagatagaggaattttaaaaaaaaatggtttcttagcctggcacaatggctcacacctgtaatcccagcactttgggaggctgaggtgggtggatcacctgaggtcagtagctggagaccagacctgtctctactaaaatacaaaaaaaattagccaggtgtggtggcacacacctgtagtcacagctactcgggaggcggaggcaggggaatcgtttgaacccgtgaggcagagattgcagtaagctgagatcacgccactgcatgccagcctgggcaacagagtgagactctgtctcaaaaaaaaaaaaaaaaggtttcttgctctgggttggcttacggtctgtattgggagacagaaaggaggcatttaacccagtcagagtgaggttttcactgaaaccttccttaaaatgacatctgaattatcttaaaagagaaatgtcagttattgggcaggtaaagtttgcaaggagggagaaaggacattccaggcagagccggcagtgtgaggagcacaagtagtagcatcatagcaatatctgactttattgagggcatattatgtacccctctgtgtgccaagaaagtagaagagaacacctagtttcaaagatgtagcgtcacagcaatatctgactttattgagggcatattatgtacccctctgtgtgccaagaaagtagaagagaacacctagtttcaaagatgtagcgtcatagcaatatctgactttattgagggcatattatgtacccctctgtgtgccaagaaagtagaagagaacacctagtttcaaagatgttacttgacttgccgaaggtctcaaacactggaactagaacttgaacctgggcctagagcccatgcttttgaccactggtgttcatagggaaccgtaagcagttccggattatgagaaggttaaattgggagtttgaggggctagagaagtagatgggaccagatcctggagtccttgagagagccagttagagactgaattgggagggagggagggagcaagctagcaaatgaatgatgtgggcttgaggaaagtactgccagtttgtatcggaggggtgctgactgagaaccccaacagaaggactgatgaaggcctgccccattggaattggcagctacggattgagtaacatcagtttgcaagattttctgagtttattcagtaataagccacagacatttccctagagagaggaaggttacttggtgtgtgcggtagaaggattgagttacaagagaattaagaattttggtgaaggagtggattaggttgtcaacatagagaaaatgtgttgtcaaaggccaggcgcggtggctcgcgcctgtaatcccagcactttgggaggccgaggtgggccgagcgtgaggtcaggagattgagaccatcctggctaacaaggagaaaccccgtctctacgaaaaatacataaccttagctgggcatggtggcacgtacctgtagtcccagctacttaggaggctgaggcaggagaatcgcttgaacctggggaggcagagtgtgcagtgagctgagactgtgccactgcactctagcctaggcgacagagcgagactctgtctcaaaaaaaaaaaaaaaaaaaaaagaggaaaagaaaagaaaatgtgttgtcaagggcctggagatctctgaaatacaaaagcaggtggagtgtgagtgcagagaggcatgaaagggatgggaagatgtgagcttgtggtcagcaaatagcttcctagaggtcaagagttctaacgtggaacagctctatgtggtaacgatgcccaggctgtgggtgtaggggactgaaatgcaggggaggcaaaggtcactggagttgaagtcaagaagtagtactacagttcccggcttgtggtttggttttccacactggtggtcaaggtacccaggatagtggcagaatcaagggagagaaagactgaacaggtaaatttttttcttcagtaccaaacattttatgctgtttttgttgcattttcccaggggacagagaatgaggagtaactcagccaagaaagttggttttctgcaaagaaaggcagataaaatggtgccctttttcctacccaatcttacatgtatttcagaggatccacaccaggcattggtttccagcagtaaatttgcagcgataaatggcttccttctattaggtgttcccttagtttattcagactgctataacaaaataccttagactgaataatttatcaataatagagatttatttctcacagttgtagaggctgggaagtctaagattaaggcaccagcagattttcttgtctcgtaaggactggctctctgttgctgtgtcctcatggtagaagggcaaagcagatccctgcacaattctgtaaggtcaagcttgagagttggagccagtttaaaaaaagcaaacaaacaaacgaaaaaaacaactttttttttggcgggggcgggggggcttctcgctctgtcacccaggctggagtgcagtggcgcgatctcggctcactgcagcttctgcctcctgggtttaagcgattctcctgcctcagcctcccaggtagcttggattataggtgcctgccaccacgcccagctaatttttgtatttttagtagagacgggtctaaccatgttggccaagctggtcttgaactcttgacctcaagtgatccgcccgcctcagcctcccaaagtgctgggattacaggcgtgagccaccgcgccctgccaaaaaaaacaacttttataatgtcgccagtcctctaatcccgttcatgagggtttgcccttatgacttagtcaccatcacctcctaaaggtctcacctcttaaactatcacattggcaactaagtttcagcaaatgaattttgggggacactttcacacatggcagactgtccattgctgctttaacagctgtcttgctcttcatcagaagctgagctttgagtgattcaaatatacattctttttttctctatctcctagtcctagtttgttacaaagaaggcttctctctcaggtttggaagaaataagttaaatttgatctgcccaaacccattagtacaagtgttcaacaataagaaaaggaattacatagaaggagtttagattggggggtgaatgaagtagggctcttggtttcttggtttcctttatttcttgtataaatcctttttttcttttttctttttttccttcaacttttaagttcaggggtacacatgcaggatgtgcaggtttgttacgtaggtaaacgtcccatggtggtttgctttacagatcatcccatcacctaggtattaagcccagcatccattagctgttctttctaatgctctccttcccgcaacccttcccctcccacaggccccagtgtgtgttgtttttcccctgtgtgagaacatgtggtgtttggttttctttttcttttcttttctatttctttctttccttcttttttgagatgcagtctttctctgtcacccaggctggagtgcagtggcagagctcggctcactgcaacctccatctcccgggttcaagcgattcttgtgcctcagcctcctgagtagctgggactacaggcacacaccaccacatccagctaatttttgtattttcagtagagacggggtttcgccatgttggccaggctggtattgaactcctgacctcaagtgatctgcctgtctcggtctcccaaagtgctgggattacaggcatgagccacctcgcctagccagtgtttaattttctcttcctgcattagtttgctggggataatggcttccaactccatccacatccctgcaaaggacatgatctcattcctttttatgggtgcataaatcctatttttctaagagttgctaatagataagcttttttctagggaagcaaatgtgggaaaccaaactttccaaagtgagaaataggataatagggagaggaaaatatgaacaaatgaatgagaagtgtgtggaaatggatcaaaacagatctgagtgataaggattggattgtggctgattgggtagctaattcactgtttagaaagtggaagtcatgtggcagtacacctggtttgttccccagattagcttgttagctgattagttttgtttacttctgctcaaactatcctagccagccacctcctaaatttataatttgaagacataaagcaaggacgtgaactgatttgttcaaatctgtatctaaactggagatactctgctgaaaatatttgcatagatttgaacaactgtacttacatgaaaaaatttaaggtatgttttagtaatattaagacattgaggccaggcacagtggctcacacctgtaatcccagcactttgggaggctgaggtgggcagatcacttgggcccaggagttcaagaccagcctgggcaacatggcatggtgaaacactgtatctacaaaaaatacaaaaattagctaggtatattgatgtgcacctgtagtcccagttactcaggaggctgaggtgggaagattgcttgaacccaggaggcagaggttgcagtgggataagatcatgccatagcacttcagcctgggtaacaagagtgaaaccctgcctcaaaaaaaaaaaaaagaaaaagaaaaaaaggtattgagtgttttacttagcatagcatagccttcaaatcagaaatggagtttgcatttaaaatgaatattatttttgcctattttggtttttccataggtacaataacttgcctgaaattctatggcaacaggcatttaatcagtggagcggaagatggactcatctgtatctgggatgcaaagaaatgggaatgcctgaagtcaattaaagctcacaagtgagtcgggctctttccctttggcattctcgatgtgccagtcaagttggggactaacttttggtttcattatagaggacaggtgaccttcctttctattcacccatctggcaagttggccctgtcggttggtacagataaaactttaaggtaagtcattaatgctcaagagcatttatctaaggtgtgtgttttactacagctctccaccatctaaaaatactgttatacaagggaaaggtcaaaagctggtgaaccttttcatagtggttcatagtggtagaatgaaaatgacaagctctgttttctttcttttttttttgagacagagtctcgctctgtctccctgctctgtcgcccaggctggagtgcggcggcgtgatcttggctcactgcaagctccgcctcccaggttcatgccattctcctgcctcagcctcccaagtagctggaactacaggcgcccaccaccacgcccggctattttttgtatttttagtagagacggggtttcaccgtgttagccaggatggtcttgatctcctgacctcatgatccgcccgcctcagcctccgaaagtgctgggattacaggcgtgagccaccacgcccagccaacaagctccgttttcaaacatgcaattatgctgcagtcatcatagctgtgaattgaagattttagaaagggaaaccttttgaaaatacaatggatacgagatgttaaagggatatgggaatgaagcaagtcttaatcctgcctcataatatttcaaaatattgctgtaaggaagatagcaggtcttctaaatagccaatatttagtaaaatgtcacttaagtcttcattatgcttgttcttttacgcttagtaaaagttagttggtgatcacaccgtaagtgagcttcctgttttgcagaacgtggaatcttgtagaaggaagatcagcattcataaaaaatataaaacaaagtgagtatttttgtttgaaatgcaggttgagcattcctaatctggaaatctgaaatgctccaaaatctgaaactttttgagcactgatgtggtgcctcaagtagaaaattcaacaccttacctcatgatgggtcacagtcagaaccttgtttcatacacaaaattatttaaaatattgtgtaaaattaccttccggctaggtgtatatgaagcatagatgaatttcatgtttagacttgaaacatgagttgcatgggttttatcctcgagatatttcattgtatatatgcagatattccaaaatccaaaatcgttctggtcccaagcattttggataagggatactcaacctgtatattttacagtgacttaatggaatatgaatatagatatacatttttacatgtgtgtatgttacacatttatttccctgcatggtggtggttacctctgagcaaatgccttgggttactttcttttcccattttagactagattctttttgtggctctgccacctgcctttgatttttattttgtttcattttattttattttatattttttattttattttattttttgagatggagtctcgctctatcacccaggctggagtgcagtggcgctatctcagctccctacaacctctgccttctgagttcgttattctcctgcctcaccctcccaagcagctgggattacaggcgcgtgccaccatgcttggctaattttttgtattttttggtagagagatggggtttcaccatgtttgccaggctggtctcaaactcctggccttaagtgatccacccaccttggcctcccaaagtgctggcattacaggtgtgagccactgcacctggcccacctttgactttttgaacctagattattttctaaaaaacttgacttgtaaaatgtgttacgaagatgaaataggataatgaatttgaaaatgcacagtataaatatttgctatttttattactatgatcattttatgttttatttacaaaataaataaacttcgtttttttccacttacagatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagtaagtaatcagaaatcattgaccaaagtttgtggtgatggttggaactgttgatgacattctggatgttattactctttttcctctctcctaggagtctgtccttgcagtggctggagatgaagaagttataaggttttttgactgtgattcactagtgtgcctctgcgaatttaaagctcatgaaaacaggtatttttaccaatctttggtgtatatgtctagtcttaataaaaggtatatatgcagtagtttcataagccaggttatatgtttttattaacaactgcagaaataatcagacatatctacatgtacagtatatggtatctgtagtctaataaggtggtggaagatgttatcttcctggcatttaataatgcaaaagtgggccgggagcagtagctcacgcctgtaatcccaacactttgggaggctgaggcgggcggatcaggaggtcaagagatcaagaccatcctggccaacatggtgaaaccccgtctctactaaaaataaaaaaattggtgtggtggtgcacgctggtagtcccagttactcgagagggtgaggcaggagaatcacttgaaccctggaggcggaggttgcagtgagccaagatcgcaccactgcactccaacctggtgacagagtgagactctgtctcaaaaaaaataataataataatgcaaaagtggtgaaattgttttctggactgtcatttacacaaggtattttttaaatgtctgttagacttggagcctgaaatcaagcatatttgaacaaacaaaagactaaacaatcttgagctttgttcccatctacttttgtccttttacataagtccccttgcctacttcttccccctttccatgtgattttttttcctgcaggagaagtgaattgacgttattgagttcctgttttgtgccagcttttattaccttttaatgctttctctatttctagggggtagatagtctcaaagtaagtagttaagtggttggccaatattaccccaatagtggagctgagagctgaacccggttttatctgactcttatatccctgctttctccagtaattttgaaaaaggtgatctaatatacagagttagattttgatgtgatccatttgcatgttctatgtctcaaatgagtcttaattcttatttcttaaacagtggttaagttttaagaaatccatacttagagtactgcagtcagtagtataaaggccttactcttctcctatattgggaagtgaatatatttttcaaagtcgcccattccagatgtactaataacacttaagatatttggccattcattcatttaacaagtattcattgagcatcattatgaaatactacacgaagtatttaatgatgaacagaaaagacaggagcttgtgctctcatggctcttacattataaggaggcaatagattataagcaagcagatcattataacaggatggaaatagaaaagtagagtgattaaagattaacaagggtaattggtttagataggatgatgagggaagaagatgtgagaccttaagaatgaaaaaggagttagttttaaaaagagagaggcacaggtgcaaagaccctgagggagaacagagcttggtgtattttaggagcagatagaagacctgtgtgactaggtgagaatgagcaaggagaagacggtggaagccaatcggtgcctgtaatcatcataatttttcttactatggaaaaatttaaaagcatttagactggtttaaggtgctaactctttaagacccaccatcagctttagcaactgtcactgtgtggccagttttgcttcatctatatgcccagccacttcttcctctcccatcttattttaaagtagatcccagttttgtagggttttaagcctgcaagttacatgatttgatttacatttttaaaaatttctggccaggtgcagtggctcatgcctgtaatcctggcactttgggaggctgaggtaggcagatcacaaggtcaggagtttgagaccagcctgaccaacatggtgaaaccccgtctctactaaaaatacaaaaattagccaggtatggtggcgcacgcctgtaatcccagctactcgggaggctgaggcaggagaatcgtttgaacccaggaggcggaggttgtggttagctgagatagccgagatcccaccaccgcactccagcctgggcgatagagcaaggctccatctcaaaaaaaaaaaaaagaaaaagaaagaaaagaaaattgttaaggggcaaaaaagaagcagaaaggccaatcaggctacttctgtgatccagaggaaaaatgagagtggcttagactaacagtggtgggactggagatgagggaaatggatgtgtgggagaggcctggattcatcgtttctgttgtcttttctctccttactgaacttggagtttcttgaggtgatgggctttgttttactcatctttagttcctttgtgataacctgattatttatagttatctgttttcttttcaacttttccttcagatatggttggcagtggattttatcttgttttttgggcctggatatatctcattaatgggaatgcgaagcatagctatattttaaggcaccattcattgagcagtttggaaatacttgaaacattgagaaagcactagtctttgtgtgtaattttataacaatattagactatttggaggaaaagatcttttatggtgttaatatttctatcctagggtaaaggacatgttcagttttgaaattccagagcatcatgttattgtttcagcatcgagtgatggtttcatcaaaatgtggaagcttaagcaggataaggtcagtgcttcaacacaatctaaatgtactttaatacaagtcttgctcataagtgaggtggaatttttttaagggtcataagacataggtctttaaactttttaaatctcttccaggcatgattgatattaatggttttaaaattagggttcccagggagctgccttgatggttgtcatttctgagtgtgagctggtgggatcccagaactcgcgctgctctttttagtcagagaagctctactttcctctcttgaatattggagttctctggaagctcttaggtaaaaatactgccattgctaaaagtaatttggaagctcctgatcaattacaaaattaacaaaccatttaaaccagacactttggaaaattgaattccctcctgtagtctccttacagtctctcttggtttattctttgttctctcataaacacattctgtgaatatggtttgttgaatgtctctttccaaggttctttgttcagccctggaaataagacctgattcctttctttagaattttctttttttttttttttttttaagtatacaattcagtgatttaatttagcatgttcatggagttgtacaatcataatcgtaattaattttagaatattttcatcacaccaaagagaagctccatacccattagcagtcaccccccatcctctcctttccccccactgccagtccctggtaactagtaatctgttttttgtttttatggatttgcctattctggacatttcatatatggaatcacacaacgtttggccttttgtgacgggcgtttttcacttcgtgtatgtttctaaggttcatcatgttatagcatatgttagtacttcactactttttatgactgaatactacgccgttgtgtggatataccactttttatgtatccattcatcaggtgatagacatttggattgtttccaccttttggatgttatgaatagtgcttctgtgaacattcatatgcaaatttttgtgtggatatatgtttttttttctttttttttatactttaagttttagggtgcatgtgtacaacgtgcaggttagttatatatgtatacatgtgctatgttggtgtgctgcacccattaacttcgtcatttaacattaggtgtatctcctgatgctattcctccccctgccccccaccccacaacaggccctggtgtgtgatgttccccttcctgtgtctgtgtgttctcattgttcaattcccacctatgagtgagaacatgcaaaattggctctgtgaataacagtcaaactaatcatgagtgaagattatatgttgcttctgaatatcatattttgtactcaagaaaatacaggaagttttaaattaaggtaacttgattatggaaaaagaaattattgaaaatgcacattatgaatgtttgtttcttctgtttagaaagttcccccatctttactctgtgaaataaacactaatgccaggctgacgtgtcttggagtgtggctagacaaagtggcagacatgaaagaaagccttcctccagctgcagagccttctcctggtaatcgaatttgattgttttgaaattttgaataatctattatctcttaaattgtagaagtggaggagatccagataatttcactttattgacagcttgtgtttatttcattcaaaggggaaaacagtctttttttaaaagcactctcttttgtgttttagtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggttttttttaaaaaaaaaaaaaaaactggtaaaattacttttggcagacagtgttttatgaattatgtatcatgttgatatataatatgttaatgtgtcatgtaatttttactttgtacaaagcaaataaagatctttctc

SEQ ID NO: 38458 - DNA, 62467 bp, Homo sapiens
acgcggcgctcgcgctccctccttaaatgagcctgggcgccccgcgcccgccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaaggtaaggaccggggctggggccacggacggcgccccctgcgggccgaggctggcgcgccgccctgcccgcgcctctgcgtcccttacccgcgcccgggacccgacgcgcctctttgtctggcggggctcgcggctactcggagcggaccgcggggcgcgagccctgcccggctccgccggctctccgggcgcgccgcttccgacccctgcgagtccggccgacgttcgcggggcgcgtgtgggaagagggatcgggtcgggaaggcggccaggaggcccctgggcccagcagggccctccgggctgcgccctcgcgccgcttccgtagaattccgcgcatccctttgcaaagttgtgagattcctgtcgtggagcggaggccgctctttctccagatgtgatggcaaaaagtaattccacgagaacaataaaagccgcggccgtgacgtcgtgcagtggttttcgaatagccccgcggcgcctgcacctcgcggcggggaacggggcctgctgggccagccgggtcccacctgctgcggccacggaggctgcggcaccactgcgggctccgggggcggcgcgcgggcgccgcggacccggcttgtcccggcccccggggagcgctgctgctcgggtgcttcccgggacgcggcgctcctcgcgctccgccagaggtctcagaattccccgccgctggtgttcggttcttactaatttgttgtactgggaattaaaacagttggcttgtccagagcacagagctctaaaacctactccaccggctttgcatttcccaggaggtggtaatttagatgaaaatttatatacatagataattaggattgggatacaaagttgctcctgaaactcggactgaataaatcgtcttttcaatttccagagggaaaacagcaccaccactcagtaaaggacttccctttttccccctgctgatttaaattgaaagctgacgtgtttgtaatgtcgtaacatgttctttttttaaaaatttcgagggtacggctgaggcattattaacggtgttatgtataactcagcactgtatcttaatatttgtagagtgacttttttcctgctccctaacagcacttttttcaaatttgttttattagaaagttcagtgtaattttgcttttgattttaattggacacattgtctactctccacatattcctaaattcgtaattgagatttcagtaattcgaaacgtttaactaccccactgtaaacgtatctacagcttgtactaaggtaacctaggactttctagctgatgaatatttcacaaaccgtaaatccgtagtgatttctttattacaattgaaaacaactctgaaattcatcctgtggctttcatatctctaactcctaatttttacagtcattcctgggaaaggaatgtttttactctttcgtgataaaccgtatgcacactaggatttctgatcgtgttgcttatctgaattttctgccgttgtcggattgcgccctcactacggtaaggttgtcagcatgctactgaccgtgcatccgagagcacccccggatgaaatcgcgtagatctgtcacaccgctttacctgcagaacttgataaaatcgagctggatagggtaggggctggtagcgcctcctccaatggtgaagggatttgcagcgtttctgcctttgcctttcccgtgggtgcacactgccctctctggccatcgtggtgaagcgttgagtgttgtacctttcaggaaaggattctggtgatggcagagctacggtgaaaacaatatagtgtctggcttttcttttttcagtgttagcctacactatttttacatgctggagtatttttaaagctcaagctgaattattattgttgttgctgctattggtggcggcttcctagagagaaagcaagttatttttaaagtcgtctgtggtatcaacttgtaaatgccaataactggtctggaaagattcaataaattgttaacagtagttgattctaatacggaaatctaggggattaaaagacaggaatgaagggaagactggtttcactgcacacccatttgtatcacttgattttgtttttgttttttttttttaccaaacgcatgtataatttatttaaaaatcaatattttaattttaaaaagttgcctttaaaaagatactggcctttcccattacaaactactcattgtgtgccccaaggcatgaagaagttttccttttatcctataaagtgaattgctttaacatcaaagaggttcttatctgaagcagctatttaacatttacataattgtggatattacccacagaagccttgtttgaaatattatggtcagtttctactaaaataaatcagccataatgagtgtgtgagattttaagtagaaagtaattttagttctttaagatgccactgattattcttgttttactttcagccattaagacaaaagaataaccttactaggcttttaaacctttcctatgttgttgaaactaaaaaattcacttttagctgtgatcactctaggcctcacagaattcgagttaatcttctgtcaaggttaactaagcattatagtctcatgaaaatattacatgaggattataaatccattttttgttcttattctgcacacttgcttcaggagaatctgttcgactcagcaatatttcaagctgtagaaactggttaaatttgtaatgtaacagcaaaaatattccttggcactgtatttaaaaatcttgtctgagacggtgcaagtattaactcgtttttcattcttacatttcacccaggactataaactagttatacagaaataagtgtggtactgaaaaacttgtcctttaatactaaagccttattaaaaatcaactttttggcttttccttccaggggttgggaaaaactgttttaacactgtcaattgaaaagtcttattaaataatggtttttttgtagtaaatcctcaactgcaatctggtttatctttcattttgaaattaaaatcactatttaggaaaaaccctgcatgacaaaacaagttgaaatcaaagccattttcagtcctttttagaaaagatagaaaaatgatagactagaaataaagttcatatctgaaattttaaaacaatagactacctccttctcttggggtaccacccatccagcacaatctcctatcatttttcaacttacgctcctgtagaataattatttatacttagaaatacgtctccctgaggcactggagattgaaattattatgatctttgagttggaaaggagcatcttaagaggtggtctaatccaatggtttccaaacttcagaggaacttttgtgaggaagcacttgaaaaaaaaaggaaaaaggacaacagaacagagttgctgtgattggtgggaggccttgccctctcagtcacctcaaacaccagggtggctccaagaactgacacttcaacgggtttgttatattgcttccaaaattacagggtatactaatctgaaagttcagtcctttctaatcaaaatgacattaagacatgttggtttaaatatgcctggagtaacattggaaattacagcactagaagataccaagtagtctttcaaatatgacctgatcatgttagaaggtgatggtagtcactgtacagtcaggaggactgatgtgtaattaaaatacagcttacaaaagcgccatctcagatcagctcgactaaggaggagtttgtcacattctgcaggaaagagaaagcacttctgctatagagttactctttcttactaaagtgattggcatgtcattagcatatgtaggctggagtgatcccaaagttcaccatccatctttgttcttaactagtaaagtatgattgagtttgattaaatttgggtactttttttgttctttggaacatagtttatcaaaaacaagtgactgccatgtcaaatagtatgtggactctaattgaactctgttctgctgtcattataggaaatggtaatgagcagagagaccaggtaggtggttctctgtgttggattttaaaagctttatgtttaccactgagttgcttaacacaggaagatgtagaaagagacacacttaattactaacaaaggtaaattgagccagcttgaggaaaataacagtggtggcagggtatctcaggagggtgggggggaatctcagttcttttcccatcccctgatttgtgctcgcatttaaaaaagcaaggtcacatgtgtggctactgtttgttcatccaagatgtgtgcctgtcagttactgtgctatgtgtttgcggttacaaagaagatgcactggagtcgcgctcagtcacccccatgtgttcatcgtgtctgtattgaatactgttgaggccagacagtcttttaggctgtggagatgcatcagtgaatcagacagacaaggcccttctttctagtgagaagagacagacaaccaacaagactcaaaataccaggtaatataataatgaagtaaagcaaaatgaaggagaaaatgtagcgcttatttagaaattgggaaagcctcacaagacctgaacaacaggaaggaatcagccaaagagattctaggccgaaggcacagctggttcctgaggcaagaattagcttgatgtgttttgagtgatgggaaggcggcctgtgttctagtagagagcgctcggaaggccagagagacacgcaggctccaggtcacatagtacctccgaagtcagagtaaggggcacagagttgttctaactataatgggactctactggaagattttaagcaaggctgtgatgtgatctgatttgtattttgaaaaggtcactggctgctgtgtacataatacactatagggactgtggcagaaacttccagttgtctagaaatgtccatttaactatttgtcagtaattctctgaatttaactgagcgcacagttccccaaaatgaagactatttaccagtttcctgttggtttaggtgaccatgtgactaagtctagccagttagatataagtagaaaatgatgtgtgcaacttaggggaattgttgtttttgttgtttaaacttttattttgaaatcattgtagattatgggcaagtgtttttgttttgttttgtttgagatggagtcttgctctgtcacccaggctggagtgcagtggcacgatcttggcgcaccacaacctctgcctcccaggttcaagcgattctcctgcctcagcctccccagtagctgggactacaggcgtgtgccaccatgcccggctaatttttgtatttttattagagacggggtttcaccatattgttcaggctggtcttgaacttctgacctcatgacccgcccacctcagcctcgcaaagtgctgggattacaggcgtgagtcaccgcgcctggccctgggcaagtgtttttaaagaaagagagaatgccctttatcaagtcatcattcttgataactagaatgcagacatgggagctataatgaagatagaatagctggcactccagcctcatactggaccatagggtgaccttggaaatgagcctctcacagctgggtagtgagacagaaggaacccaggtcctggtatttatagagccttcactctgatgcttgactccctatgtccagcttgttcgcatgacagagcaatgtatttctatcttgttttaaactgttagtttaggtatttctgttactcatgccaaacctaatgctaacatagaagtgtgcaaaatcagtataagaacaaaaaaattaaaaaacagatggagagctgttgaatgatcagaagtgaaaagtctgaatgcagtcaagtaaaattaatctggaaagggttcctggagaaagcaggttttagaaaatgtactttcatggaagcaaagaggtccaaggtccctggcaagtgcagatgttcagaaacaagaagtatttgttggagcccttataagaatagatagtagagccttcacctcaagttcaacgtttccaaaatcgactcaactccttttcgcccacccctgccctgcccaatccatattggtccaaacatgtctcctgccactaccaaaggagggaaaaggccacctctcactgttgctttcagtaatctgccatgctcctgttgcagtggtactcacagtgtggtcccagctccagcagcttctgcatccctagagaatttgttaaaaggcagattctcaagccctgcctcagacccagtggatcagagtctctgaaagtactcccatctgtgagttaataaacccaaggtgattatgatgcacattaaagtttgaggaccacggtcacagtgattcagttcccacacctggaagtagaaatgctggtgggatttgcacatttttgagccttaatatattctaccagattaacctccaaaaagttgtgccagtttgtaatccagtggcattatatgagtatgtcagtttcctatagcctgaccaacactagaatctgtacatgtatatatgtatgtatgtttgtatgtttgtaaggctgaatttttgggttttggcacatttttatgatggtctaatcttttttcccccatttattattagtttttatttatgtgtctgtcgttagtaaatgaaggtgctcttcacctcaaaatatatacataattcaccttttttttcccaatctagtatttattttttgtttttagcttgaaggcgagatctatttttatttcaaagaattaatatgttatcccagaaccatttattaaatccatcctttcaccaaggatttcaaataccatgtatatcataataaattcttggggctgggtgtggtgactcatgcctgtaatctcagcactttgggaggctgaggcgggcagatcatttgaggccaggagtttgagaccagcctggccaacacagtgaaaccccgtctctactaaaatagaaaaaatgagctggccgtggtggcgcatgcctgtagtcccagctactcaggaaactgaggtacgagaattgcttgaacccagaagcagaggttaagtgagccaaaatcacgccactgcactccagcataggcgacagagtgagactgtctcaatcagtcaataaataaaaattaattcttggatatatatatctatttctgagcttttaatttttttccattttgttatctgtaaggtgctggagaataaggaccttgtctgtttggttcattgccaccaggaagtgactcactacctgttagacaatgggttcctgcatgtatttaacagatcatctgtttcttcctatgtcattgctacattttttaattactgtagctttacaataaatatatcatatattgtttttatttattctatgtgatttctaaattttctttggccagtataacaaagtcttcaagatgagcatcagaaacgttttgttaagtccaaaaacaggacccactaagagtttgattaaaatattaaatgtatggcctattggaaagactcattatctttgcagcattattttactgctcagaaacatgttactgctctgttttattcagtatatttattgtttatttattttagttttactttcttcccttaataggtgtaataatttttcaaataattctcttgaggtttttaggttttcaataacattgaaatctataaataataattttgtcttctttccagtatttattgcattcactagaattgccactattaagtaatagtgaaaagaataaatttgacctttttttttttattttttacagtggaaagtaggccttaaaattggaaggcctaggaacagaattgtctgcttagagctaaaatgacagtgattcagggtaaaaagaggaggaataaagggagtggctttgaggattgtttaacagcctgaatagcacctgtcttttatcatctgagtgacttcattttaggtcagatctgtacacaggtctgactaaataagactaaattcaactctagaaccaggagtaacatcataaatggtggacattacctttttcaagcatcaaatcacaagcagttctctgtacaatcaaattgcatggttaaagagtttagaattatttttgtgtagatttctgccttatagaattagcgccttcctatatacattatcattgaattcaaagtgtgaggtcttcctgtatttgagatataattgatccttttggtaagaggaaacagtggcacctagattgggaataaagacagaacaaagaaccacagaactgcttcatgtgctaaataattgcagggtttagcattaatggaatttgttttaatatctcagcctgattataactcaagcagtgtacaaagaccttgttatacaactcaggaaactgtgtttataatgatacagaatttagaatggattaatagtcacaactgtattaccaaaaactgtatcagtacatctttctatccctaattgctgtgcagattcgccctattctttatacgtcgtttttatatttagtggcacagctcatttggtcgattgagttgtgaatagctagtaattacttgagaaaaaaagaaaactgtgcagccctctaaataaagttgaaaagaatataataggctatttggccttgcaactttattttcagtatgattgttctgccttacttgtgtattctgtgcaaatttcataaagcagttattttatacaagcacatttttattggtcattgtataccgtaattgtgctggcacagttcatccctttgccatagttgccgttgctgtcttgccttcagtttattggcctcttacatgccctgtctgctggctttgtgtggttatttgcttatagatggatttgtaaatgtcaaactggtaaatagttacacctgtgattaaggaggaatggtatactgcgcacgaaatattgaccagtggcatatgatctgaatgatatgcctggggagatagtgtctactaatgagataaattgacacaaatggttgggttatttgctgaattatcaaatacctactattacctgacttttctttttgatcataaatcttctgtattaaaaaatgtttcaaaactccattcttctaatcagatccagtgtaaagatgtgaagagttcaagatctcagcataacgtgagatcttcaacactaccatcaaccaaaaaaagggaagggggaaattaacgttattgagaaaagacagaggagacacagaggtcagcaaggatgcaagaaaccaaggatgaagaggtcaaagaattagattttaagatacgaactgaataacaagagctacctcttaaccatttctacgttggtgactttggtagtagacacccagtacgtgctattgagtgaacagtggtaactgtctaccaaccacttgcactagcagactccagtgcctccacctccctcacccctcacgtcctgtaagttgcacttgactctacacctgaaccatgtcattagtttctcctcctttccctttccactgctaccactctgcttcaaagatggtaatgcaaacatgatcacctttccttcctaatcttctctcttctcattaaaagtatagaccccacacaaccattaggattattggtctaaaacacagaagtgataatgtcatacacttgtttaaaaacctacaagggcttctcattatagttagaagtccacactttttagcatgccattcaaaacttgttacaatcagatctcacccaacttttctctaacctactatactgctgtagccttccacttgccaaccacactgtattactcagagttccctaaaacctgctgtaggttagagctcatgcctccatgtttttattttattttattttattttattttattttattttattttattttattttattttatgttatgtcattttatgttatgttattttatgttactttatgttattgaggcatggtctcactctttcgcccaggcagtagtgcagtggcacgatcatggctcactgcagcctcttaactcctgggcactagtgatcctcctgcctcagcctcccaagtggctaggactataggcacatgccaccatgcctggctaatttttttttttttttccgtagagacagggcctctggaactcctgggctcaagcaatcctctcgcctcagcctcccaaggtgttgggatttgcaggcatgagccaccagcgccctgccctccatgttcttatttaagctgtttctttctccttttcctgggctcaaggactgtaaggtccaaccagagtatgccttcttttttgggagttttcctcattctatttcccttaacccccagcagaatggaccttctgcttccattatgccttctgcatatctcctgttaaactccgtttcaccttgtattgtagattcaacaatacattgattccttgtggatgctggtttgtcctaatatccatcatttatttagcagaatgtctggcacataaaaatactatatacattatctcatttaatcttcacaaccaccaatgaggttgacctatttatacgtcatctccattttacaaataagtaaactgagctgaaaaggcctcacagctggtagaaggcaaaacttgaaccctagcctagattcatgaaactccttaagtccatactcttaaccattttgctcgatttctctctccacacctgtgcatccttggtgcccgctcttcagtggatactctgtaagtgcctattcactgaatgaataactccagttcacgcagtagttcgggacaggctggcagtgtggtttcctttgaaagggagagtgcagcatccatgaaaatgtttctttaaatcttcaaaccacatacacaaaacaattcaatatgttgttgattgggtctcagaaatgttcaacatggaaaaaagcttcagtgttaaatatggctagcctttgtagcacagagcacagcatagtactgcacaatgataagacagtttgaattgatttctaggagactgctgcccccttacttctgtcttgattaagaatgttctcagaaaacagatataatctaattgaactttcactgccatagcacactgcagagccagctatactgcatgtaaactttgagatggactacagtaaatagaggaatagttaggatgagcaaggtctgttgcaaaaaacaagtgtttttttttttttaaacaaaactattaagttgaaaaatgctttcaatgccatgtattattaaatgcttataaatgagtacaaaaccacttgtcttttcttgggttatcttaagggttaggtagcaaatcagaacataacatttaatgcttaaagatcttgagagtgaattttgagtaataaatagtgattttagttaatctttttttgtcatccaattttatttattgacttagtaaaatgtagtatagattcaatttcataacttttcttctctgttatttctctagtgttgttaataacagtactggtagtggaagggattgccgtggcccaaaaaacccaaggtaaagtacttacattggtgacttactgcatgtttaagacaatggactggcttatttgaaaggattgcaacttttgggtactattttcataatccctttggggtgttccagtgacctaaggctttctgtcaacccatcagcctcaatttaactgagtttagctgcagttaactaaattgtcagcataaagtcttgccctgataaatttttaaaattgacatcactagtagctcctagcatactgtggattatgtccaaaaattaaaggagatttatattttatcactaagcaaaaataaaagtccctttttctaatttaaacaaatgaaacacttcaattaatatcttattcaaagtcctttggttctgttcttttgtcttgatttatgtttgatgattagctagtgtgattttttttagccagatttttatgtctgaatttagtacatttccagtgtaatgttgtttgttttttattttcatctaagtaatacatacacatgataaaaatcaaagcattcctaaaaagttaattaggaaaaatgagttccccatcttgccctacttaacttcctgctccatggaaataatcactcttagctgattcttttggtatttcccttcctttctctaaataacatgctgtattgctacttcttggttatttcagttttataaattagataatgatttttcaccgtggaagatgagaatttagctctttcacgcacctaccgtccaccccatccatatttgagtgttctcgtaccttgcatttgtagcacccttctcaacacagttctgtcataattctggttaactcagtattcaggatttacattaagtcactcattcagctgaattttatctttaggaaatcttttttttttttttctgttttaatttttaaaattccctttcctccattttctctcttttgccttttcaggaattctattattttacttggttatggccctcttggtttttgtttctggctcttctgttttccatctttttgctccacattcgctgagacttcctcaactttacctctaaaccaggagttagaacactttttctgtaaagggtcagatcgtaagtgtttaaggcgctgtaggtcctacagtctctgaagcaactcttcaaattcctcaactcttctgtcctggaacaaaagcacacaaatgatggggatgggtatattccagtaaaactttatttacagcaggctccaggtcatgtttggcccagggtcatagtttgctgaactctgctctaaatgttctgctgattttttcatctcttctgtttttggaagcttttttggttctgttttctgaatataatattgtttgtacagtatctttgtttttgtcttatagatttacttgcttttctttctcaggatattaaatgattgttttgtggtggtggtggtttttaaatatttttcttgcatagtctttatctcctcagagttgcttttctccagttttattattattattatttatttatttatttatattagagattttcctccaatgtctggtgatccttgagggctcatattttaagaggggcactaaaaactgatcgttaactgtctgcaggtgtgggcaaggatcagttactggctctcactgttgacagatctgacactggggaactcctgcatctgcatcaagcctttcctaggggctgtttcgactcccagagaagaatcttttcttttcctgcttaaaggctcaatatctgaccaggaggcctttgtgggagttaagcaggaaacgaaggctgggacatgtgctaacattcactcgtctccctgttttcgttctcaactgttcctggtgtcccctagtccagtaaccctgttgttttaccttctccaaagaaatcacctttagtgttctgatgtggttgtagagctgctagatttgtggaggaggaaagggtactgaaaatccaactcattctaaacagacttttaactagcctcgtgtttttaaaaagcccaatttcactcaccacccccaaccccacttcctggtactgccagttgttactgctatatctacccctctctgtttaagagtttatacccttttaaaaatccttttattgctgtttaagtggagtttgaggaaggagctcagctacgtgcatgtatttagtctacagtcttcaactaaaatccctctaacctttgaatcatcttttactgttgtgttaaactaagtttgagggccccatatcagagatcagctcctgggatgcctttatttttaggttagaactgaattgtattgcatcttactgacttagcagattcccccatatggttttgccctttgttaagtgcctataagccctttatttccctgttctcttacacggcaaacttgtcctctcccagcaagttttccctccctctctttcacttctgtactcaatttattgtgctaaatttgacagtggttcttagaaaattttatatatgtagcatagagtgagcaatcgtttggaaagtggtgggggaaagagaagaatgattctcttttgctgtaatgagtgttttaaatgccgtttttccctaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaaggtatttgaacgatttcttttattggatgaatttttactttattgtaaaactaaatatgttggtaaaatgacctatgtaaaccagtttgaatgaaatttaaacatgtatttgaattaaactgtagtaatgataagtatttctgcatattgaatacattaacaagatactagcagaaatgttaggggaagtttgaatctcccaaagtataattcaactacgtacattagtatgtatgaaaaacttctttctctgataagaaacttaaacttactggcatcccttataaggcttaattcaaatttatgtccacataagtgagttcttttcatttcttctgtttatttttctgtgtattgtggtacgttgtatcttgaactaagtattagcttcttgactcttcagtttgaatcactcaaaaatatttaatttagtagatagcatatgccaatggaaaagattactatagttctacagagtagcattatttttaatgtaagatacatttatcatgacttgtatagcaattctcactaagacctttgtctatgaagcagttagcagaacagttattctgcttttctcatttgtgtcaatacatttatattctttcttgtttgtgttgtcctgatttgcttactcttattttctagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccaggtaaagaataagttatcttttaagtggttgggcatctcactctaactctgattttagaatcttaaggttagaaaagagattaatttggtcaagttaatcaaatcaagattttaaacaaattagcaaagtcaaagggaaattagtccatgaacaaataagaagttaatagaaattggacatagaaacgtatcacttgaattttgaagcatatcagagatggtgccacattttcttagatttttttctgtcttatagcacatgctcaggctaacatttaaaatacatttaaaaataaataattttaaaaataattcaacaaattgtcttgttttcagaattcccacaaaaattgttttgtatgatttttctcatttagctgttagaattaaccactcaactgaatgaatactctagaatatattgagcaatagaaagaatactgctctgcacttggatgtcaaagatctgggtttgaattctttctctgcctcctaatagctgtaagacgattaagcacagaattatgtttgagattggccattagtaaaatgggaatgcctgctgtgttagtttattgatgctgccataactaattacctcaaatttggccacttcagacagcagaaactgattttcttgccgttggggagaccagaagtccaaaattgagcagggcctcactccctctaggaacctgggggagaatccggtctttgctccttccagcctccagtgcatgccccagcattgctgggctgtggctgcatcacctcagtctcagcctccctcttcacagctctttctactcttttcaagatccttaacctaatggcatcttttgtcttgtaatatttactcttttaaaaaactatatgtgtgtgtgtgtgtgtatagatacatatataagtgcaccctactactcacaggttatggggaatccaatgtgtgtatattggggggctactgtaccatcagcctgctccaccgtgttacctgccccacagtaggtgagaacactctgagaactgtaaagccctgtccagtatggcgtgtacatatccctaatgcagaaacagatgtgcaagttattgttcctgtcttcaccaagcttacacactaacaagatgaaaaaataacagtaagacaactgcatgatctttttgcttttatttttcgtgcaagaaatttaattggaaaaaattaaaacattgaaatgaaaagaaaatatccataatccttccaccctgtatataaaatcagtgtgaacaatttggtgtatatcccttccagtgtttttctatatctgtttcttttgtttgttacacaagattgggattatggtacacatataactttattatctgcttttttgcctgaaaaacagatgtttgcctgttagtacttatgtaggaaattttaagcttggcttcagtgtttatctgctctttttaaaaatttttttctatattctccatagccaaccaagtatttatttgcacaataccaaaaggatatttccaaaaagtaaacattgtctaatagactttattttttagaacagttttaggttcacagcaaaattacacaggaagtagagttaccataagcctcctgcctccctttccatcagcatcttgcacgagagtggtgcatttgttactaatgatgagccaacatccatgcatcattatcacccaaagcctgtagttgacattagggttcactcgcagtagggtgtgctctgtgagttttgacaaatgcatgatgacatgtatccgcccttacagaaccatacagaacagtcccactgctctaacagtgccccgtgctctgcctgttggtccctccctttccccaaaccactggcaatcgctgatctcttcagtatctccctagtcttgctatttccagaatgtcatgtaactggaattatacagtatggagccttttccagttagcaatatgcatataagtttcctccatgtctttttgtggcttaatagctcattttttacaccaaataatacttcattgtctagatgtaccatggtttgtgtattcattctactgaaggacatcttgattgcttccacattgtggcaattatgaataaagctgctattcatgtgcaggtttttgtgtggacgtgagttaattcatttgagtaaattctaatacatgccacaacatggatgaaccttgaaacattatgctaagtgagataagccagacgcaaaagcacaaatatgactccatttatataaggtatttaaagtagtaacattcatagaaacagaaagtggaatggttatcagggtatgtgggggaagggggaaggggagttaatgtttaatgggtgtagactttcagcttgggatgattaaaaattctgaaaataaaaaaatggtgatggttgtacaacattgtaaatgtgcttaatgccactgaattgtaaacttaaaaatggtggagccaggcgtgtggtgcacacgtgtcattccagctactcgggaggctgaggctggaggattgcatgagcccagaagttcaaagttatagtgagctatgatcacaccactgcactccagcctggatgacagagcaacaccctgtcttaaaaaagatcaacattatgaattttatgttatgtataatttaccacaattaaaaaatagtagcagccagatgtggtggcttacacctgtaatcccagcactttgggaggctgaggtgggtggatcacatgaggtcaggagtttgagatcagcctggccaacatggcaaaaccccgtctctactaaaaatacgacagttagctgggcgtggtggtgcacgtctgtaatcccacccactcaggaggctgaggcaggagaatcgcttgaacctgggaggtggaggttgcagagagccaatattacaccactgtactccagcctgggcaacagagcaagaatctgtcagaaaaaaaaaaaaaactagtagctagtaagctgttttttcacagtggcagggaaaagaaagaaagacaggatatcctgccttgtgaaatagtccacaggagtttgagaaccaatagtttatatcaaaatgactgattggattaaattggtcagctattttatttttattaactaaatcaactaactgaagtaattgaaacattagtgtcatgaagatactgttagaatagatggtggctgcacataagtttagactacttgacagaaaaagacatccaaagaatactcttatttgaataatgtttttaaatatttaaagacaaagtcagccaacttcatatgtaaagatacttactttggagtcaagtagctctttttcctctattcatgttatagatcatgagagcaactttaaatggcctatagttaaaatatagacaaagtataataaaatgcttaggatttctagagtttatcacctttcatttgcattttatagtgcttcacagttttgatagacattatgtttaattttgtgctaatgactaatgtcaggaggattatgtaatattttattttacagatgaggaaactgagtcagattaagtgattttcttggttcatagaatggcaaatccaggactagattgcatttcactaggcaatacttcctactctatcatgttgcctttataatgtggatgaggtcacattggagaaaagccttattaaaatgtggatgaggagtccacaattttatcactaaaagagaaaaccaacacatgtcaaaataaataggcaatgcataattagctaaatatgtctgtctgatgttatttcaagtcatgttaataaaataaattttgtctaggaggtggtaaatctggaagaaacctattaacaatggtgagaagttcattttttttaatgaaattctctactgagggagaggctcttaatgggttgttagttcctggacataactgagataattatggacattttaatgcaataatgacaatatcctagatttctggaatacatatgaaatagttctgattaatctgccagacagttcctgtgattcccctccgccatgccgtttaagatttaaatttcactttgacatttctctgcaaaagagcagaagtgtctattgtcctctttcagcaaggatgagttttgtttataaagttaaaaaaaaaagttgctgagatatattctacataagctaataatttttttccactttttaaaatatgtaatttgataacttcctaaagtatctggaattaaaaacaacagttttaacaggaattgagtctctagttgtacacaattaaattgcgtattgaaatagattttccagtccgggtgcagtggctcatgcctgtaattccagcactttggaaggccgaggcaggcagatcacaaggttgggagtttgagaccagcctgaccaacatagtgaaattctgcctctactaaaaatataaaaaattagctgagcgtggtggcagacacctgtaatcccagctactcgggaggctgaggcaggagaattgcttgaacccgggaagcagaggttgcagtgagccgagattgtgccactgtactcctgcctgggcaacagtgtgaaactccatctcaaaaataaacaaaaataaatagattttccagaaatctgagacattttagacaacccagcaattttttttattctggctgttaggtatatacacaggttctatctgaactttaaaataattttttaaagatacctgtgtttataatttctaaaactttatttttattgtggtaaaaaatatacataacaaaatttaccctttaacctttttttttttaagactcattttgtcacctaggctgaagggcaatagtgctgtctctgctgtctgcagcctcaacctcctgggctcaaaagatcctcccaggtcagcttcccaagtagctggcactacaggcatgagccaccatgcctagctctctttaaccatttttaagtgtgtaattcagtggcgttaagtacattcacagtattatgcaactattaccaccatccatttaagccgaagtttagaagacaaattgtaatatgattcagcagaaaggaacttcattcctttttaaggccaaataatattctggtatattgtatatgtgatgttccgtttacctgttcaactctgacagttgatgtgagtttgcaagtagcataaataaattattcactatggaatcaaaaatataaacgtgattaaataaatgtcaatcctgtaagcgagctcctaaatgaccaatgatatgtagttttcaccaatgaaagcttctcttaccttgctatgaaatggaacgttagatgtaatgtaagacatcgaggattaaagtaactatctcagtaccaatgactttcttcttttttctgttacagatccagactttacttacctaggaggtattttaaatcccattccaggtttagtatattaccacttgttcctcttggcatttttgattagtcttatgttcctttgaacacctttcatgtattccttccagattgtcagttcgagctctcgggagctgatggaatagtgcgctctagtcaggtagaacaagaggagaaaacaaaaccaggccaagccgttgattgcatctggaccattaaagccactccaaaagctaaggtattattatgtattgagtcgcttcagagaagaacatcatgataaggcatgatttgcaaaatgtgtaattttggtttgtgtaaatatttattgactacataaactgatactgcaactttttaaaatgtattttatttcacttactttattggcatctactaagatcccagcattattatagttaaataaactgaaatttctgaaattcttcaggaatattacatatatattaagattctcaattataaaagattaagattcttaagacctgtcagttcccaattggtgagtgtgcatactgatcagtatgattatagattcattaacagctttatgaggaagaaaataggctacaagaggtgaaaatgtgttctcaaaagttacagagttggtcgtagcaatctaaaagcgaaaacccaaatgtgtcgagtctgttcttaccctgccatcctctgctactcatggggtgcttttattggaaagaactgcagggaaggatgtttttaaataactctgacagattgagattggatacttttgcatttaatgtatacttctaggaatatcaacagagttaaaattatatttaatgcgtattatgtaaaaagagggaaaagaggagagagtgagggtgggaaaacatacctctcaagaatcatgaaaatcagatttaaagattgggtaatatgatagataaggtaacctgaaaacccatctgctagaagacacatggaaacattgggtaaaatatgacaaataattattttaaaagcatatgtgtaagctccaggaaggagaaaaagagggtaatgcttatggatgagaaatgaagagagagaactgtagattaataaactgaaattgatgttacagatgcccctggctgacttttataacctgttactgcacaggggtagacatactgggagcttccttttaattcccatactgagaaaagaagagtcctggggttcacatggcctttgtgagactcacatgaagctggagccctcaaagggaggcaactcacatgaaagcatagattagaaaaaatgtttcactaccacatgctgatgacaaagaagcttgtttttctgggtttagtctcagggtggggttggaggtgaggctggggtcccccctagctttatacttagaaaccctgcctttattagggtttgagaaatgaatttacattccctgctcaacccaggagtcatgaagtccaaagactgacagaatggtcctgggtgcattaaacctttgagtcacctggcaaaaataaatctaaaagtcaccaagaaagctgcagggttggcatggataaaacactgctgcaggtcagctcacagcccgcagattctaaaacccctatgctcacagcccaccatgggtacgagttcaccgacataacacacaggaaggagttccttagatccccaagaatttgagtgtttcacgtatcctacaagaaggaaacagagatgagaaagaaaaatgaccacgtccatttttaaaataaccaaataggaggtctataagttaaaagtatggctattaaaagatgtgtctgaggaaattacccagagtgtatcgctggaagaggtggcagtttattgggattttccataactgatactctgtagtgtgtaagtctgatgcccggatgttgacgcacacatgtgacgtgcgcctccctccagccttgttaccatgtcggcacattgcctatctgacatgaaaaggaaaaaaaagaaaaaaaaaatttcaagaactaatgaaaagcatgacacagggtgactcccaagcaggaaaaaaaaatttaagtgacactgacattgtaccccacagacaaggagaaaagttattaaacaatagagaaaatagtctacaaaaggatgctattaagattgacaccagaattatcaatagcaaaatagaagcctgaagacaatagaataatgtcttcatagtgttaagagtgttcattgtcatttaagaatgaaggcagtggccaggatgtggggatgattaatgggtacaaaagtataattagatagaattaatatctggtatttgatagcacaacacagtgactacagtcaacaatttattgtacagtttaaaataagcataattgggttatttgtaacacatgataaatgcttgagatgatggatcccccatttatcctaatgtaattattatgcactgtatacctatatcatgatagctcatgtaccctataaatacatatagctattatatacccataaaagtaaaaaataaaagaatgaggacaaaattaagatgtttctctgcaaagtaataaatgaattaaatgctacagttaaaatccaaatatatcttgtttatgggataattacaggaaaatttgaaaatacaaaactaggaaagaaataacagacaaatgtcaaaaaagagctgatgtaactattaaaacaaatcaagaatgtctctatctcactagataaatctcaggtattaatatagccttaaaatgcacaaaacaggttgttgattgtcaaggaaaattgacagatccataacatagttggtaatttttttttacttcttagtaattaacagttcaagcatacaaaaagttaatatggctcaaaagatttaaattacacagtatgtgcttaatggacacagtatcttgctcccaacatccagaaaataggcattctctactagcattcataaaacattcatcaaaacagatacacgtgctcagctaacaaaggaagtctgaacatatatgcagagcatcatgtgacagaaatgcaattaaaccagaaatcagcaaccaaagattactttaaaactccatatgtttggaaatataataatatactacttagtaatttgtaagtcacagaagaaatcagtatggaaatttgaatacatttaaaatgcattaatgaaaatactacatttaaaaaaactgcggtacagctaaaacagtactttgagaaaaaagactgaaatttaataagttaagactcaagaagttaaaagaaaaacaaatccaaagaaagggcaatcataaaacagaaattaaaaaaaaaaacgaagatacaaaaagaataaatcagtgaggcctgacatcggctctttgtaaaaggtaacaacaggcagacttatgccaagattgatctagaaaaaaaaagacataaataggccgggtgcagtggttcacgcctgtaatcccagcactttgggaggccgaggcaggcagatcacgaggtcaggaaatcaagaccatcctggctaacatggtgaaaccccatctctactaaaagtacaaaaaattagccgggcgtggtggcgggcgcctgtagtcccagctactcaggaggctgaggcaggagaatggcgtgaacccaggaggcggagcttgcagtgagctgagatcacgccactgcactccagcctgggcaacagtgcaagactccatctcaaaaaaaaaaaaagaaaaagaaaaaaacataaataatattagaaatggaaaagttataaatcaactacagcaaggatttaaaactattatgaaacaaaccaagtagaaagtagatctgccaaacaaaaaaggaaagaaactgtttctttcataaataaatgacaatgggggaaaaagaaaaaacaagaacctatagattaaaagagatataaaagtcaagtgaacttactgattgaaacaaactataaatggagggaactgatgacagaagtttgaacactggtatttaatattaagttatttatttgtttggtttgataataggataaaggttattttttaagtggctttagtgatacagaaatgtttacagatgcaatgatttaatgtctgagatttgtctctagtatgtaagaggtagaagttaggagagacaaataaaataagattggctaggttataattgttgaagttggaagctgggtacacagatatttttgtctgtttttgcatatttgaaattttaacaaatgttttagactatcataagagaatattataaataatgatttgtcagtagatttgtaaagggtatatataaatggtgatgtttggagagtatggagggaatcccggcttttttctctcttaatcagaactcacaacaggttgggagactaaaattctaaggaaaacttgtctttctggccagaggaactagatagaggagaccatgttgtcatctggagaatatgaagaagtcttggagaggagagaactagagcagggaagcactaatgcaggctttctttctgaggtgcctgtgtgtggaacagatccagggaaacgtggcagcagtgttgggaaccatgttacagtataaaccacctctgagtccctgagtgtgtcacacactgggcaagcctacccagcacagcaaagtctttgaacattgggaccaccacccaaacaaagagagacagaatttgcagtgcgaacacaacttagttgattgtctgcagaaccaaaacaaataacaaaaaacgacattctccagggattttttaacaggatccaagtcacacagcataatatttaaaatgtccaagatacaatgaaaaatcacatacagagaactaggaaaatctggttaatttttaatgaaagacaaccaatagatcccaaccctaacccaaatattaagaactatccaaaaatctttttttaatttaaaaaaatgtttttaatagaaataggatctcacaatgttgcctaggctgttctcaaactcctgagctcaagtgatcctcctgcctcagccttccaaactgctaggattacaggtattagccaccctgcccagccagaattatcaaaaattctaaagcagtgatagaaccatgcttcatgagatagcagtaaacactctcaaagagtaggaaaataggactcagcagagaaataaactaattttttaagtgaaaaatttagaactaaaagaaaaatctgaatttttaacaaataatcactgtatgagctcaataggaaaatggagaaaatagaaagtcactgaacttgaatcagtagaaattatccaatcagaagtacagaggggaaaagattgaaaacaaagtaattgaaaactgtctatgggacagtttcaaagggcctaacgtttgtgttatttaagtcctagcgggagaagagattggcacagaataaatatttgaagaaaaaattgctaaaaagtcccaaacttgaaggacatatatctgcagatttaaggagctcagtgaacaccaaataggataaacaaaaacaaaaagcaatacctgcacacatcaaaatcaaattacttgaaatcaaagattgagatcttgaggtctaccagagaaaaatgatgcatcttgtataagggagcagtgatttgaatgactattttttctctttagaaatgatggaagccaaaggtagtggatcagaatcttcacaagctgggataggcagtaaggggaactgtgatgcaagacttctttcaagaatgataaaactaagagaatttatcacctatgcacttgctataaaggaagttatttagataagataaatgatactagaaaaaatcatgaaacttcatgactaaagggaaacgaatggtaaatatctgggtaaatttcaaccattttaccagtatcaggaatgaaagagagaattctatcactaccgaccctaccaatattaaaaggagtaagaaaatacagggaacagctctatgccagaaaatcagatgacttcgatgaaatgggtaaatctcttaaaagctacacagctgcccaaacatgtcccagtagacatacacaacccaaatcatcctgtgcttattcaaaaaatgaattcgtaaacaccttctaacaaagaaaactctaggcctagatgggttcgctggcaaattgtaccaaacattcaaggaagatataatgccaattctttagtatcatccaggaaatgaaagagcagggaacatttctaaacttactttgtaagataagcattaccctgataccaacagacaaagagacattataaggaaactattgatcagtattcgtcaagaaaatagatgcaaaaatttcaataaaatattagcaaatctaattcagcaatataaaaaaatacataatagtaaagcgtggtttatctcaggaatgcaagtctggttcaacatttgaaaaatcaatgtaattcaccataaagactaaagaaaactatgattgtctccatttgttaaaattcatcacccattcatgataaaaatctcagaaacataggaacagatgagacttccataacctgaagaagggtatctacaaaaacctaccagctaaaccaggcacaatggcatgcatccatagttccagctgttaaggaggctgatacaagaggattgagaatcacttgagctcaggagttcaaggccagcctggacatcatagtaagagcctgtctcttagaaaaaaaaaaaaaaaacagaaaaccctacagctgacaccatacttagtggtgaaaacctgaattctttccccttcaaaatctgtagcaagctaagtcctattcaatgttatactagaagttgtagccagtacaaaaaagcatacagattggaaaaagaagaaatcaatctttttgaagatatcgttgtctatataaaaatttccatagcatctgaaaagctcctggaacaaatatatcaggttaacaaggttgcaggatggaagaccagtatacaaaaatcaattgcaggtcaggcactgtggctcccgcctgtaatcccaacattttgggagaccaaggcaggtggattgcttgaactcaggagttcaagaccagcctgggcaacctgacgaaacccagcccctacaaaatatatatatatacatgtatatatatatatatatgtatatatatatatataaaaattagccgggcatggtggctgcagctgtagtcccagctacccgggaggctgaggcaggaggatcacttaagccaaggaggcggaggctgcagtgagccaagagcgcaccactgcactccagcctggacaacaaactgagaccctgtctcaagaaaaaaaaaaatcagttgaatttttatatactagcaatgaaaactgtagttcaaaattaagaaaacagtaccatttaaaatattactccaccaaaaaaaactgtgtagtatctgttaactgaaaacttaaaagaccataatgaaaatattcagagatgacctaagtaaatatactgtgtcaatgtattgataggcccagtagtgctaaaatgtcagttcttatgaaaatgatctacacagatgaatacaatttcaatcaaaatcacagctatattttttgtaaagattgacaaactgattctagaatgtaatggaaaagcaagggattacagaagccaaaattattctgaaaaagaacaaacatggaagactcatgacctgatttcaagacttaatgtgaagcttcagtaaccaagactgtggtactgacaaaggacagacacacagatcaatggaacaagatagtccagagattagatttctgcaaatatgatttgttaatttttttgacattcaaaggaaattgagtggagaaaggatagtctaacagatggtgctggaacaattgaacctccatattcaaagaaaaaaaaaatgaaccctcacctgttgagtgtaggtgttgcctcacctacatccaacactgtatttaaaaattaactcaaaataaatcatggacatagatgtaaaattataaaacatttagaggagaatatatgaaaagaatcttactgggttagacaaagagttcttagatgcaacaccgaaagagtatccataaaagaaaaattcaggctgggcgcggtggctcacatctgtaatcccagcactttgggaggctgaggcgggcggatctcgaggtcgggaaatcgaggccatcctggctaacacggtaaaaccccgtctctactaaaaatacaaaaaattagttgggcatggtggcgggggcctgtagtcccagctactcaggaggctgaggcaggagactggcatgaacccgggaggcggagcttgcagtgagccgagatcatgccactgcactccagcctgggcaacagagcgagactccatctcaaaaaaaaaaaaaaaaaaaaaaaaaaaaagaaatttataaattggactaatgaaaaagcttttctctgtgaaagacactgttgagtgagaaaaaaaaaaaaaagccactgactgggagaaaaaaaatcacctatgaaaagatttctttcatccagaactcaaaactcaacaataagaacaaaacccaattatgaaacagatttcaacagatacttcaccacagaagatttaatcattacaaaaatgcaaattaaaaccacaatgagatggcactattctccattagaataactgtaatttagaaaaatcactaagtgctgggaactatgtagagcagctgaaactctgatacagtcctggtaggagtgcaaaatgatagagccgctctgggaaacaggttggtggtttcctataaagtaactgtgtgactcagccgtctcttctggatgggtacccgggagaaatgaaagcttatgtttatggaaaaaaacctataagtaaatgttcataacaactttatctgtaataaccaaaaactagaaatgtttcaagtgttctttagcttttaaaagaataggccaggtgcgatggttcacgcctataatcccagcactttgggaggctgaggtggggggatcacttgaggtcaggagttcaagagtagcttgaccaacatggtgaaaccctgtctctactgaaaatacaaaaaattagccgggcctggtggcaggtgcctgtaatcccagctacttgggaggctgaggcaggagaattgcttgaatccttgaggcggaggttgcagtgagccaagattgcactactgcactccagcctgggcgacaagagcaaaaactccatctcaaaaaaaaaaaaaaaaaaaaaagaataaactgtggtacatccatatagtaacatctattcaacaataaaaagggataaactacagctacatgcagtaaccccaaatgcatcatgctaaataaaatgagctagactcaaaggatacatgctgtgtgatttcatttatatgaaattctggaaaaagtgaactgtaggacaaagaacagatcattgcttaccagggatgaagactggagatggattttgactgcacagtgacagcacaagagaagttgagtgggttgtggaactgttcttgaagtgtcagcaaggactgagtagtggattgagtagagcaagcagactcaaagaatttgctttagaagtataaattgtctcgttagaattcaactgtaaagagaaaaatgtatataaattggtacaaccactttggagagctatttcggatgtgctctggtaaagctgaaaatggtcacatgctactacacaagtatacttctagatgtatacccaaatgaaatcgtcatacctgtgcataaagagaagacaacaatgtttacagcagtattagctaattataaaagtagaagcaagctaaatgcccaataggagaatggatacatagtgatttatttctataattggtatgaggttttaaaatatatggaacaatacaacatatttttatagatatgtaagtatgaaaatattaagtgtgctttaagtgaaattaaacaatatttattagatctcattcttcattgaaatattccttgaaaagataattccatattcacaaatttttaggagcgttacctggaatattgactatagaagaatgttgtattgcttttaataaaagtaaatcagttaaacttaaaaaaattattacagttgacatgggaattggatcaaattttaaaatttgaatgtttaaatgtgtaaataggccaggcgcagtggctcacgcttgtaaacccagcactttgggagtctgaggcaggcggatcacttgaggtcaagagttcgagaccagcctgggcaacatagtgaaaccccatctctactaaaaatacaaaaaattagccaggtgtggtggtgcacaccggtagtcccaactactcaggaggctgaggcacaagaatctcttgaattgggggtggaggctgcagtgagagccgcgatcacgcgactgaactccaacctaggagacagagtgagattctgtctaaaaaaagaaaacaaacaaacaaaaaagtgtaaatagatggttttatttaagaaatctaaattaaatgttaaaagtcaccattacccttgaatactaaatgtgagaaactagttcatgggtgatgtttaagaaaaatatccatttataaatataaaaagaagccagtcacggtggcccatgcctgcagtcccagcactttgggaggctgaggcggaaggatcacttgagcctggcagttcaagaccagcctagacaacatggcaagaccctgtctctatttttaaaattaaaaatatattttaaaaataaatatacaaaagaaggcatcgatgtttaagagtatacaaatagtgttttagtccacttttatcagtggccttttcatgatagtagctttctggggatttcatttctgttggggtcttcaggggctccaataaatagcatcccttttccctggtggagtgctgaaccaattgagaaataaaagtgtcagtgtgtagggagttggaaaagcctctttaccacagtgaaggctaggatagagagagcaacgcagagagatgatctaattagtgttggcaactccttgcccaccagttctacgtctcacctaagtctagaacagcccattccactccagggaaagttcgcatctgcagagcagaccggcctacccagtcccacttcctatgaggggagggaaaaagaaaccaaactcccaccatccaggtaacttgccctgcctccctgggtaggatatagggatagggtaagaggtcacttacttgatgaaagttgtaagtaaaagatcccttctcatgcaatctggagtaaaagaaaagtagtttatgcccttctcccaacattgcaatttgtcagattcacgttatgaatatttcccaaaaatttgttgaactaaacaattcaatatttagctgtatttacagtagaaaagtgctgtgatcttgttattatttatctttaactcgatgtttttttaaaaatatgtctttgaagagcatttactatagccttatataataccatatttatttggattaaaagaaaagcagagagtaaatataaatacttcagacagcttgattattctactgatacttctaccaagtcatagttttacaagcctagtcactttctcattgtctgccatgagcaagaattatactggatgaaactgagccagtgaccttccattggaagacatcacagtctagtggaagagggaagtcattacagcattagagctcgctaccagagtgtgagcggagggtttgggttatataagtgatggaaaactaatgagaactgttgatatatttaagaaaacatattgcttctttgttaaaatacacgcatgaagactttgtaaagttttgaactggaaatcctatttcattaccaattttccaccattctcacggaagtggtgaaccagtcatttcaaataaaccaaaattatttagtcaaaatgtaattctttaagctatattttgtaagttgttctctcttagttttatgccatcaaggtatttggtggggtggggggggaatatatgacatgacatttttgttttattaatctcttcgaattaaagggtagatgtggcatactgctccctcagaaataatagctaggaagtgaatactcattagatgtcttgaatggcaattcaaaggtaatctttattcactcactcaaattttattttaatgatagagtcacatatgagaaactagagcccaaacagggaacactgtgtgagtatgtaaagcgcttcatggaatgagaaggacgcacatttagagtcagaccaacctgggtttaatccttgccaccgaataacagattcatctctgcccacaaaaaaacatgatacctacttcattaggctcttctggagattaatgcttaaaatctaaattcacaatgtaagagaaatcgccaaacaagaatgggtcaagagtgtttaggaaataacttagaaccatttagctataaaatttgaatgggggatgctaatagagcttcctttgatagtacagttgacgtctgcctgtctgaaaatgcaggtattgttaagaggtgaaataaagcaaccatgtagaacagtaggatattgtgtaaataaataataggacatccgggaataggtatggctaagagtatagataaaaacatttttatatgttacagctaaagtaggatgtgtatatcttacaattaaacacaggtttttttaatgtgcagaaagagtgaaaagaaactcaccaattaatcacatgcattgttggaataatagaaatatgagtgattattttattttctcccctgtccagtaccatgagattgcttttataatgagaaaaatgtgagatagttatgccttgtgagcaaaaagtttctactctttatagacaaaacacaaagtaagttccttaatgcttggttccattataaagacaaccaaagaaacagatcattaatcttagttcctctcactatttaggcatcagccatttatcgattatggttttctgtcagctgtcattcggtgtcccatgttgtctgtggaaaatagaaatagaaaaattcaaattaatatatctttttaaaagcagtgtttttgtgttaatattacagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcgtaagtaaataattcctatagtattgagatcttttacatatttttcactcattcacagtacactcagcatttacttttttaaaatatttattttaggatgtttttttttgttttactacagctctttttaatgcaagaatattatttaaatttaaaatattttaaattttatttaatttttagaggtggggtgttgatttgttgcacaggctggccttaaactcctgggctcaagcgatcctctgcttcagcctcccaagtagctgagactgcaggcacacggcactataccaggcagcatttacttttgacaaaaatgtgcaagtcacaaggtaggagcaactatatcttggtccctgttctcttggaatggactggtatgggtgaaaaaaccatgttaacatatcaattggaacactcattataaaggtgtaaacaaatggtagagattgcagacagggaagacttatactttctctcaagattttctaacttagtagtagtattaatttagcttggtgaatagttatgaatccatgaaactatggtcatcaaagatttagatatgccatagatctttttctttttaaataactttaaacttacagaacattgtaaaaatgatagattccctatgtgccgttcactcagattccactaatgccaacatctctcaaagccagagtaaaactgaaaattaacacagatacgatattattaactaagctatagaccggtccggtatctctagttttgctatgaaggtccttttatgatccagtttcccacattgcttttagttgtcaagtatccttagccttctccatctgtgacagttactctgtctgcatctttccttggcacattgtcaagagtactagctagccagtttagtagaatgtccatcagtttgggtttgtctaatgtttcttagggattccattgaggctgtgtatttctgtcaggaataccacagaaactatgttgtgcccttctaattacatcatgtcagtgaagcaggggtacatggtaccattttgtcttattgctggtgatgttaactttgatcacttcattaaggtgctgtctgccagttttcttcactaaaaagttgctatttttttcctttctaattaataagtctctttgagactatgccaatatcttctaacccactaattttagcatccattgttggcttctgcctgtaacagttactactgtagcgtttacctaatcatgattttccatttccatcataccttctgtatacattaattaacattctgctgtgagaaaaactatccctttttcctcacttattcagttattaataattacatcagtatgggctcatggatattttattttattctattgttataatattaataatattattattgtgaccgggcatcgtggctcatgcctgtaatcccagcactttgggaggccgaggcggcagatcacttgaggtcaggagttcgagaccagcctgggcaacatggggaaacccccatctctactaaaaatacaaaaattagctgggcatggtggcaggtgcctatagtcccagctactcaggaggctgaggtgggaaaatcacctgagcccaggaggtcaaggctgcagtgagctaagatcacaccactgcactccagcctgggtgaccagagtgagactgtctcaaaaaaaaattattgttttctatgatactaacactattttgttgctcaaagcccgagcttcagccattggaagctccttcagtttgcctcctctgtcctctcaacataccgaattaatagtttttaaattattttcttactttacggcaatgctggatgaaccaggctcaactagtgttttccctgacccaacgctggaccagccgcatttccaaggagccctttcttcatcttaaacagcgagaaacctgactaattatctgaaatggattaatttgtttaatcctaatatacacaaaaagtaacttcacaattgctaatccatatccctttgagaaatttcctaacaaaataccttacgtacagttctttctatgtttaactttactgtcaagatactgttttccagttactcaggctagtggtttatatttcattttgtgcacccccccaacatcatggtgtctgtacattgtttttatgtgggagttgtggaaacataattgttgttcctaggagcccacatcccaagagggacacttggaggtgtccttgcctccttcattctctgccttccatttcttacctctatctggatttctttttgcacaaatgagcagatacatctgtattttcttatgtgccattttttcttatgtgaaggacagcattattcttttacactttatgtttttaacttaaaagtatatcctggtcaggtgcagtggctcacacctgtaatcccagcactttgggaggccaaggtcggcggatcacttgaggtcaggagtttgagaccagcctgggcaatgtggcaaaaccccatctctactaaagatacaaaaattagtggggcatggtagcacgcgcctataattccatctactgggcagggtgaggcatgaaaattgcttgaaactgggaggtggaggttgcagtgatctgagatcaggccactgcactctccagcctgtgtgacagagtgagaccctgtctcaaaaaaaaaaaaaaattatatcctggaaaccattccatatcaattcatagagcacatttttattttatagctgcatagtacagcattgtatacaccaactttattttatcttctacttatggtgggcatataggttattcccaatatttgcagttataaagaagctacagtgaataatgttatgcgtatgtcattttgtattgttagagacatatcttcaggataaattcctagaagtgggattgtttggtttaaaaagttgtgtaatttcgttagatattgccaaaaacccttccggaagggttgtagctttttttttcaactgtggcaaaatatacatggcataaaatttaccctcagtcacttttaaatgtacaaatcagtggcattaagtacatgcacattgttgtgcaaccatcaccactgtctttagagcatttttatcatcccaaactgaaactctatacccatgaaacagttccttcccatttttctctctccctaccctggtaacctctattcttctttctgtctctgtgaatttccatattctgggtaactcatagtagaatcatataatatttgtccttttatgtctggcttatttcacttagcataatgatttcaaggttcatccatgaaatctttccatggttcatccatgaaatctttccatggttcatccatgtggtcatatgtatcagaattgtattcttttttaaggctaaataatattccataagtaaatgccacattttctttatacattcattcatctgttgatggatgtttgattgtttctacctttgagctatgatgagtactgctgctgtgtagaattgctggatcatatgggaaatctgtgtttaagtttttgaggaaccggcaaacttttccacagtggctgcaccattttacacaccgaccagcagtgcacagagggttccagtttctccacatgttcaccaatacctgttatttttcatatttttggataatagccatcctaatatgtgtaaagtaacatctcattgtggttttgatttgcctaatgattagtaatgttgagcattcttccatgggcttcttggctattcatacatcttctttgcagaaaggtctcttcacatcctttgcccgcttttgaatttttttttaagttgtagacgttctctgtgtattctggatattaatcccttattgtgtatgtgattagcagacttttttgcactctgtttgttgtcttttcactcccttgatatagtgtccttttgggtacaaaagttttgaattttgatgaagcccaaattaatgtgggttttttttgttgttgtttttggtgtgatatccaagaaatcattgtcaaaaccaatgtcatgaagcttttctcatatgtttgcttctgagagttttatagttttagctcttgtaatacatttaagtctttgatgtatttggagttaatttttgtatatagtgtaagttaaggctccaacttcattctttttcatgtggatatccagctttcccaggatcattttttgaaaacactgtcctttcctattgaatggtcttggcacccctgtcaaaaatcaattagatctgggcacagtggcatacacctgtagtcccagctatacaggaggctgaggcaggaggattgcttgagtccaggagtttgagaccagcctaggcaggagttcaagaccagcctggtcaacatagcaaaaccccatctctatttttctttaaaaaagtaaaaaaaagaaaaaaaaaaaggccaggcacagtggctcatgcctgttatccgagcactttgggaggccaaggtgggtggaacacctgaggtcaggagtttgagaccagcctggccaacatgacaaaaccccatctctactaaaagtacaaaatttagccaggcgtggtggcacacgcctgtaatcctagcttctcaggaggctgaggcaggacagtcacttgaacctgggaggcagaggtcacagcgagccgagatcgtgccactgcactccagcctgggcaacagagctagactctgtccaaaaaaaaaagaaattatgtgaagatttatttctggcctcttaattccattggtctatatgtctgttgttatgccagtagcaactgttttgataactgtagatttgtagtaagttttgaaatcaggaagtatgagtcctccaacttttttcttgtttttcaaaactggattggctattcatggttcattgagatttcatgaactttaggatgactttttctatttctgcagaaacactgttgggattttgatagggatcattttaaatctgtgggtcactttgagtaatattgtcatcttaactgtatgaagtcttcccattcatgaacacaggatgtatattcccattgatttttcatctgtaattcattcagcaatgttttgtagttttcagcatacaaatgttttgcccccttagttaaatttattcctaatattttattctttttaatgctattatactggaattattttcttaatttccttttctaattgttaattggcagtgtttagaaatgcaacggatttgtgtatgcgggttttgcatcctgcaactttgttgacttagtttattagctctaacgggggtgtgggtgtgggggtgggtgtgatctttagggttttctgcatataagattgtgttgtctgtgaacagagaaaaccttttatcttcctttccaatttggataccttttatttccttttcttgcctaattgctctaaccagaacttccagtatatattcaatagaagtgaaattgggtatctgtcttattcttgatcttagtggagctctgtccttcactactgattatgatgttagctttgggtttttcatatatggcctttgtcatgtgaaggaaattttttttctattcatagttaattgaatgttcttatgaaagcctgttgaattttgtcaaatgcttttttaaaaattcattgagttcatcatgtagtttttttcccttactgtaaatgtgatgtattaaattggtggacttttgtatattgaaccactcatgcattctgggaataattcccacttgttcttggtgtataatcattttatatgttgctgaattctgaagtaataattttcttgaggatttttatattaatattcataagggatattggtctttaggtttttttgtgtatctttttctagctttggtatcagagtaattctggcctcatagaatgagtaactagttctggcctcatagaatgagtaagtagtgtttgttcttcaactttttcaaagagtttgaggattagtgttaatttttttttattattacaatacttgaagttctgggatacatgtgcagaacatgcaggtttgttacataggtatacacctgccatgctggtttgctgcatccatcaacccatcatccacatttctcctaatattatcactaccctaggccctcatcccccaacaggccccggtgtgtgacgttccttcccctccctgtgcccacgtgttcttatatttcagctcccacttatgagtgagaacatgcagtgtttggttttcttttcctatgttagtttgctgagaatgatgatttccagcttcatccatgtccgtgcaaaggacatgaactcatccttttttatggctgcatagtattccatggtatatatgtgccacattttctttatccagtctatcattgatgagcatttgggttggttccaagtctttgctattatgaatagtgctacaataaacatgtgtgtgcatgtgcctttatagcagcatgatttgtaatcctttggatatatatccagtaatgagattgctgggtcaaatggtatttctggttctagatccttgaggagtctccatactcttctacgatggttgaactaatttacactcccaccaacagtataaaagagctcctgtttatccacatcctctccagcatctgttgttttctgactttttagtgatagccattctaactggtgtgagatggtagctcattgtggttttgatttgcatttctctaatgaccgtgatgatgagctttttttcatgtctttcttggctgcatagatgtcttcttttgagaagcatatgttcatatccttcacccactttttgatggggttgtttttttttttttttcttgtaaatttgtttaagttccttatagattctggatattagccctttgtcagatggatagattgcaaaaattttctccgattctgtaggttgcctgttcactgtgataatagtttcttttgctgtgcagaagctctttagtttagttagatccatttgtcaattttggcttttgttgccattgcttttggtgttttagtcatgaagtctttgcccatgcctatctcctgaatggtattgcctaggttttcttctagggtttttatggttttaggtcttatgtttaaggctttagtctatcttgagttactttttatataaggtccagtttctggaaggggtccagtttcagttttctgcatatggctagccagatttcccaataccatttattaaataggaaatcctttccccattgcttgttttcgtcagatttgtcaaagatcagatggttgtagatatgtgacgttgtttctgaggcctctgttctgttccattggtccatgtatctgttttgataccagtaccttgctgttttggttactgtggccttgtagtatagtttgaaagtaaggaagcatgatgcctccagctttgttctttttgcttaggattgtcttggctatacaggctcctttttggttcctacgaaatttaaactagttttttctaattctgtgaagaaagtcaaatggtagcttgatggggatagcattgaatctataaattactttgggcagtatggccattttcacgatattgattcttcctatccatgagcatggaatgtttttacatttgtttgtgtcctctcttatttccttgagcagtggtttgtagttctccttgaagtggtccttcacatcccttgtaagtagtattcctaggtattttattctctttgtagcagttgtgaatgggagttcactcatgatttggctctctgtctattattggtgtataggaatccttgtgatttttgcacattgattttgtatcctgagactttgctgaagttgcttatcagctttaaggagattttgggctgagacgatggggttttctaaatatacaatcatgtcatctgcaaacagagacaatttaacttccggtcttcctgtttgaatacactttatttctttatcttgcctaattgccctggccagaacctccaatactatgttgaataggagtggtaagagagggcatccttgtcttgtgccagttttcaaagggaatgcttccagcttttgcccattcagtatgatattggctgtgggtttgtcataaatccctctaattatttggagatacgttccatcaatacctggtttattgagagtttttagcatgaaggggtgttgaattttatagaaggccttttctgcgtctattgagataataatgtggtttttctcattgggtctgtttatgtgatttgcttatgttgagccagccttgcatccgagggatgaagctgacttgattgtggtaaatatgctttttgatgtgctgctggatttagtttgccagtattttattgaggatcttcacatcgatgttcatcagggatattggcctgaaattttcttttttgttgtgtctctgccaggttttgttaccaggatgatgctggccacataaagtgagttatggagaagtccctcttttctgttgtttggaatactttcagaacgaatggtaccagctccactttgtacctctggtagaatttgggtgtgaatccatctggtcctgggctttttttggttggtaggctattaattactgcctcaatttcagaacttgttatcggtctactcagggattcaacttcttcctggtttagtcttgggagggtgtatgtgtccaggaatttatccatttcttctatattttctagtttatttgcgtagaggtgtttatagtattctctgatggtaatttctatttctgtgggatcagtgattatatctcctttatcattttttattgtgtctatttgattcttctctcttttcttctttattagtctgactagcggtctatctattttgttaatcttttcaaaaaaccagctcctggactcattgcttttgtttttttttgtgtctctgtctccttcagttctgctctgatcttagttattttgtcttctgctaacttttgaatttgtttgctcttgcttctctagttcttttaattgtgatgttagggtgtcgattttagatctttcccaccttctcctgtgggcatttagtgctgtaaatttccctctaaacactgctttagctgtgtcccagagattctggtacgttgtatctgttctcattggtttcaaagaacttatttatttctgccttaattttgttatttaccccatagtcattcaggagcaggttgttcagtttccatgtagttgtgtggttttgagtgagtttcttaatcctgagttctaatttgattgcactgttgtctgagagactgtttgttatgatttctgttcttttgcatttgctaaggagtgttttacctccaattatgtggtcaattttagaataagtgttatgtggtgctgagaagaatgtacattctgttgatttgggttgaagagttctatagatgtctattaggtctgcttggtacagagctgagttcaagtcctgaatatccttgttaattttccgtctcgttatctgtctaatattgacaatgagttgttaaagtctttcactattattgtgtgggagtcttaagtctctttgtaggtctctaagaacttgctttatgaatctgggtgctcctgtattgggtgcatatatatatttaggatagttagctcttgttgcgttgatccctttaccattatgtaatgcccttctttgtcttttttgatcattgttagtttaaagtctgttttatcagagactagagtgcaacctctgcttttttttttcttgccatttgcttggtaaatattcctccatctgtttattttgagcctatgtatgtctttgcacatgagatggatctcctaaatacagcacactgatgggtcttgactctatccaatttgccagtctgcgtcttttaattgggggcatttagcccatttacatctaaggttaatattgttatgtgcgaatttgatcctgtcattatgatggtagctggttattttgcccattagttgttgcagtttcttcatagtgtcaatggtctttaaaatttggtatgtttttgcagtggctggtaccagtttttcctttccatatttagtgcttccttcaggagctcttgtaaggcaggcctggtggtgacagagtctcttagcatttgcttgtctgtaaaggattttatttctccttcacttacgaagcttagtttggctggatatgaaattctgggttgaaaattcttttaagaatgttgaggctgggcgcagtggctcacacacctgtaatcccagcactttgggaggccaaggcaggtggatcacgaggtcaggagttcaagaccagcctggccaagatgttgaaatcccatctctactaaaaatacaaaaattacccaggtgtggtggtgggcgcctgtaatcccagctactcgtgaggctgagagaattgcttgaacccattgaacccaggaggcagaggttgcagtgagcctagattgtgacagagcgagactccgtcacatacacaaaaaaaaagaatgttgcatattggcccccactctcttgtggcttgtagggtttctgcagagagatcgctgttagtctgatgggcttccctttgtgggtaacccgacctttctctctggctgcccttaacattttttccttcatttcaaccttggtgaatctgacgattatgtgtcttggggttgctcttctcaaggagtatctttgtggtggtctctgtatttcctgaatttgaatgttggcctgtcttgctaggttggggaagttctcttggataatatcctgaagagtgttttccaccttggttccattctccctgtcactttcaggtacaccagtcaaacgtaggtttggtcttttcacgtagtcccatatttcttagagactttgttcgttccttttaattcttttttctctaattttgtcttcccgctttatttcattaaactgatcttcaatctctgatatcctttcttccacttgatccattcagctgttgatacttacatatgcttcacgaagttctcatgctgtgtttttcagctccatcaggtcatttatgttcttctctaaactggttgttctagttagcaattcctctaaccttttttcaaggttcttagcttccttgcattgggttagaacatgctcctttagctcggagaagtttgttattacccacattctgaagcctacttctgtcaattcatcaaattcattctccatccagttttgttcccttgctggcaaggggttgtgatcctttggaggagaagaggagttctggtttttggaattttcaggctttttgcagtgttttttccttatcttcatggatttatctacctttggtctttgatgttggtgacctttggatgtggtttatgtgtggacgcccattttattgatgttgatgctattcctttctgtttgttagttttccttctaacagtcaggcccctctgcggcagatctgctggagtttgctggaggtccactccagaccctgtttgcctgtgtatcactagtggaggctacagaatagcaaagattgctaccttttcctttctctggaagcttcgtcccagaagggcacccaccagatgccagctggagctctcctgtgtgaggtgtctgtcgaccccttctgtgaggtatctcccagtcaggaggcatggggatcagggacccacttgaggaggcagtatgtcccttaggagagctcgagtgctgtgctgggaggtctgctgctctcttcagagccggcaggcaggaacgtttaagtctgctgaagctgcacccacagcggccccttcccccaggtgctctgtcccacggagatgggagttttatctataagcccctgactgggactgctgcctttctttcagagatgccctgcccagagaggaggaatctagagaggcagtctggctacagcagctttgctgagctgcggtgggctctgcccagttcagacttccctgtggctttgtttacactgtgaggggaaaaccacctactcaagcctcagtcatggcagatgcccctccccctaccaagctcaagcgtcccaggtcaacttcagactgctgtgctggcagtgagaatttctagccagtgcatcttcgtctgaagggccccgtgggggtgggatctgctgaactacaccacttggctccctggtttcagccccctttccaggggaatgaacagttctgtctcgctggcgttccaggcaccactagggtatgaaaaaaaacttctgcaggtagctcggtgtctgcccaaatggccgccagttttatgcttgaaacccaggtccctggtggtgtaggcacccgagggaatctcctggtctgcgggttgtgaagaccatgggaaaagtgtagtatctgggccagaatgcgccgttccctcatggcttcccttggctaggggagggagttccccgaccccttgagcttcccaagtgaggtgaccctccaccctgctcctactcgtcctccgtgggctgtacccactgtctaaccagtcccagtgaaatgagctgggtacctcagttagaaatgcagaaatcacctgccttctgccttgatctcatggggagctgcagactggaactgttcctattcggccatcttgcccaggaatcaactgattggtgttaattctttacatgtttagtagaattcaccagtgaagccatgtgatccagagcctttctttgttgagaagttctggattctttttttaatctccttgctagttttaggcctattcagattttctttggcttcattatgcagttttgattgtgtgtttctaggaattcatccatttcctctaggttgtcagtttgttggcatacagttgttcttagtattcacttatgattctttttatatacgtcagatctgtagtaatgtctccagttgcatttctgattttaataatttgagtctttttgttcttaataattctagccacaggtttgtcagtcttgttgatctgtccaaagaatcaagttttgggtttttgctctttttctgttttctattttatttattgtcactcaaatctttattattttgttacttctgctagctttggatttagtttgtcttctttctctagttccttaaggtataaagttaaactattgatctaagttgtttcttcttttttaatgtaggcatttacaggtgtaaatttcccttttactactgcttttagtactctgcataagttttggcatgttttgggtttcatttgtctcaaggtatcttataatttcccgtggatttcttttttgaaatcacagctttaaaagttgtgtaagagtgtgtagtttaatttacacagacttgtgaattttttcattttccttcagttgttgatatctagtttcattccattttgatttgaaaataaattttatatttcagtcatttaaaatatattaagacttgttttgtggctgaacatacgtagtctattctagagactgtctgatgtgtaattgagaaaaattacatttttctgttattgggtggaattttctgtatatgttaggtccatttggtctatagtggtgttcaggtcctttattttcttattgatgttctgcctggtcattctatcctttattgaaagtgcaatgttgaagtctccaattactattgtacaagtgtctacttctcccatcagttctatcaatgtttgtttcatatattttagggctcctttgtttttagtccatatatgtttataatcgttatatcttctgggtgaattgacccttttatcaatataccgtgtccttttttatccaagactagtcttgccaccccctagctgtcttttagcaactatttgcatggaatatctttgtccatccttttactttcaacttttttatatctttaaagtgagtgtcctacaggcagcatataattggatcttgttttttcccatcaattctgcaatctcttcttttgattggagagtttatttatgtttaattgctgatgaggaaggttctgtcactttgctacttgttttctgtgtgtctatagctttgttgtctctcatttcctccattactgccttcttttctttaattgatttttttttgtagtgacaagttttgattcccttcgcatttccttttgtgtatattttatagatatgttcttatggttactatggagattgtgtttttatgaactgcttaagtttttaaaagttatcttcactatttggtaagcatgtgggaagtttttcttattaaaggttgtagctcatacacagacaaccaccacaacttaaaagtggagaaattttgaagacagattttaggattcttctttgggttcctaggccaggcacagcggctcatacatgtaattccagcttttgtgaggccgaggcgggtggatcgcttgagctcaggagtttgagaccagcctgcctagccaacatggtgaaaccccatctctactaacaatacaaaaattagctgggcgtggtggtatgcaccactcaggagactgagatgggaggatcacttgaacccaggaggcagaggttggagtgagctaagattgcaccactgcactccagcctgggtgacagagcaagaccccgtctcaaaaaataaatggccaggcgcggtggctcatgcctgtaatcccagcactttgggaggccaaggcgggcagatcatgaggtcaacaagattgagaccatcctggctaacacggtgaaaccctgtctctactaaagatacaaaaaattagccgggcatggtggcgggcgcctgtagtcccagctactcgataggctggggcaggagaatggcgtgaacccgggaggcggagcttgcagtgagccaacattgcaccactgcactccagcctgggtgacagagtaagactccgtctctaaataaataaataaataaataaataagtaaataaataaaacaaaccttcctttaggttcctgaaaaatcaagtgaatacattcccaccaggaaaaactgtttctgttatatttctttgcttttctatctccttaaactcctcagccaattagctaaggattaaaaaaaaaaaaaaaaaatccaagtgatatatcagtacttcctaatttttttttattttgcttatcataagtgcagatcatattaccagtagctttggcaaaatctgctttccaaaataccatcatttttttacttgaatttgaatggcccttaactttaatctacatttgggcagggctggttagcctcttccaactgtttcctcagattcatctcctgtatgaagaataataccattttaagacacatctgaactgcccagatatagttgagtttgtatgttcacatcacatatattttaaaattataagtggtatatcttatctattgtcatgaaaagaaacaaatattttagcctttatatcctgactgatgagtatggtgtaatggtaagctgtatgatttgtgcaaatacagagtttgtaaatacaaaagtgtgacagtaagatatcagatatttttgacaaatttgaaaattaatagtttttctcaatcttataatttcaaggcattgtattattccatggattctgtattaaaatcatgactgtttatgaccatatacaggctttcttatagctgaactcttctatctagaattttaaaggtcttcatgagatgccaaatggtcaattgggttatgaagccaatttggtcaaccagccttcctacctgctttccatgcatttctttggcatttgtcatgtgaggtactgtgtttgatgctaggaagatacaaacatgcatggaacagtacctgccctaaagggttttccagtcagttaggtaaggtgacctaggcaaatagtgacagtgtaggattgaccgtgacgaagaccctttgagacataaagggttctcctgttaaatatccaagttccttcaaacaggcagcatcaattacggaggaggtggtctttgagtgcaggtcctttgggtgtgtccttgagagtagatatattttgaaggtagaaatgttcattgaggctgttattttagacagaagcaataatgagcaaagcattgaagcagagctaaggtgggccacaagaagtgtggtagagggagtggcagagaaaggaggcaggaaaggtagattaaaactggatgaagccctttgaaaaaaatcaaagggaaaatgtagactcatcttacaggcatcagggagttgacactataaagtaacatctttagcgctgtgccttagctggggcatggatatgagttaagagtttacttccatagtcacagcgggaagccatggaggtctgaacctaagcaggggcagtgaggacaaagaagagtggggaaacggaatccacaggattcaatgacccattcaatgaaggctaaaagagtgagtcagtcacctacaattttgagtctgactgaaagatgaaaactgaacagacaagatggggaaagtgtcatgttttggacatggtgagctccttgggcagctggaaatgtcgggagctcacggtggcatttgctgagagtgaactttgctgctgctgcttccttcaccagggagagaacctgagcatgtttctaaaaccttttaaatttgagaacttttcaaacttaaaaaactatgcagaggctgtttcactgtgtcaaataactacaaatcagtgctttatacaaagacgtagctaacaagaaaggcttttagccttcttatttttccctcggtttctgtgcacctgtgctgtccagtccagtgtccgccagccacctgcagcctctgagcacttataacatggcccgtctaaaccgacgtgtgctatcattataaaaacgcctcccagatgtcagaggcttggtatgaaataaagaatgtaaagtatcccactaacagtattttatgctatatgttaaaatgagaatgttttggaaattgtttcggggcttccaacagcatccccatgttaggtgccttgctggaaggactctagaacccagcatttatttgtactgcactcacagctgggatggaggacaacaaaagggagccgccagggagaggctgccagggtctggaccgatccttgcgcaggtccacatatcgcgtcctttccatgaggggcattctgagtatgcctgtttctccaacaacagcaaatgggcatggactggacacagtggctcacgcctgtaatcccagctctttgggaggccaaggtgggaagattgcctgagaccagcctgggcaacataatgggacaacatctctacaaaaaaaaaaaaaaaaaccaaaacagttttaaatgagttgggcatggtggtgcaaacctgtggttccagctactctggaggctgagacaggaggatcacttgagcccaggaggttgaggctgcagtgagctgtgaatcatgccactgcattccagcctgggcaacagagtgagactctgtctccaaaaaaaaaataaaaatgcagtagcacatacgcagtgtttctgcccagagaagcccattagagactcagcacccaaggttcttatcagagtctggtcacataggcaccctctgctttgcatatatcaaaatttcagactcttagcaggaaagcaagtatttggcataaatgacatcttttatgcaaagtctaggtacaatgaagtacccttatctgttagggaatggatggcacccaagggccagtcttgcaatcagaacctttcaaaggtagcaccctcaggcctgctataatgttaactctttctgcactgatatgttgggttaaataaactatataagtcaaattaattccaccaatttcttttttactttttaatgtggctacttgctcacattttttactcacatatttattttgggcagcactggtctatatccatgatgagaaattcttctctaatgtgttttagttaaggtattttctctatatacactaattttttttgttaatacaaatctgataattaaacaggtgaaaagcctccctcgagtgatatctttatattaactaatcaccaaatgtaagaataagtttaaattgtaaggctgcaatagatttaacttcatatcccaaatttagctttattacccaagaaaaagaagaaagccgccccttcagaaaaagtgtgtgtgattaaaataagggatttaacagagttttttaaaaacaagagccagcttgaaaaacctccatttggaaagcaaatttcagagctccaattagtaaattttttcatgcttatcattaattcaaattattgaactatttcttttgttctcctctaagctgtgatttgtaattgttacaatttcacccatggaaacaattagtatttcagaagaggtttatataaatgggctaattctgcatgagagattcagttcatgcctacccattgtagattgcagatataactgaaatagaataattttgctaaaatgaatgatacagaatagcaatcaggatatatttggcttcttcccaggcactgaatactaatatatacctcactctttaagaaagaaacagttttaggaaaataatttctaggactagaactgtgaaagcagcagcagatatttttgttagaataaacccgtaatgtgattttcggtgacatactgcctgcaggccccctgcaggctttgctgaaggacagccatccttcagcatcattgccacatctcattgaaattgggggggacacaaaattccagccctccccttcctttccacaccatgacccagcagtgaggaacagcaataggtagagagttctcaggctataagtggagttcataactggcactatttttgctgtctttttttatataaagacttatagttcaatcattttattatttgaattgaagcataccattaaaatcccatatcaataactgatgcttgattgtcatttccaccagccatgcttaaccagtgaaaagccataaaggttaatgtaggtgtaattattaatataactcacatttctatgaaacaaaagctgacaatatcagtgctgttttctaatcactttaaataatatggagagcagttgtaaagaatttataataaaaactgaagacattttcctctcactgctcaatcagtgatgaacacggagtggtaaacctgtctttaaggccacctttgaagttataaagagccatcaaaggggggggtcacatgatgttctgtagataaaccttaaaaaccaatggtagttttattcatgaaatccgaatgtcaaggacccacagtgctgtttattacctcattcagcctgtcttgaaaatggcttatctttcctgcatcccgtttttgtgaactagataaaataggtagtagaattagaacataatatacaattatattgtatgtaatagaattacagtgtgatatataaataaaaaaagaaactccagtttgtagaaatgaggaaatcaaaaatgctatatgtttctcttggccgttttttagtatttttcggtgcccccatttgtatgatacagttttatgatatctatgacaaacccaagtaggtgcactagctaattttgtagctaattttgtaaagtgaataaaacaccaccatacactccccagccctcaatatgatggcatgtttgtgtaactgatacctgttgtctttccgatgagccttggaaccatcaatgttatctaagaaccatgaagtaattatttcagtggttttagtgataccattttgacaggttagcagtctctggataaattacttattagatatatacatcatttgaacttaagtctaaaacagaagtatcatgattgagaccactgattgcatagtctcatcaaattttggaaccagaagtctgagatacactgtattccatccccttcattttaaaagaggaagccgaggcccaaggaggttaaataccttaaaatgtggattaactgataatagaaaccatttttattgattactagcccattgtttttttctgctttctgctgcatggtgctatttcccaagttccttcacagttcgtagctattgtggactcttcagtcatgtcagccaccaaggggttctcatacttgaactgcagccgctgagtactccgcaggtgaacaagcttaacagtttagtgtgaagactgttgaactgtatatagagaaagaagtctaaactcaactgcaggttggcttacagtgaggagggggaagggataaatgaaccctagttcataatgactatagatttttaacctgttgtactgaaacttgggtgaatactaccgtttagggcattctgcttaaagagagattatggtcacactcttaatagcaaagcaattttggatattcaccgtggacctacatttgtcagattatgttttggagttatctaggtacctaataaatgcctgtttttacagcccatgttcacagcccattgagaaatagacaaagtgggtaaggcagatgaatgaaaacatgtcagttttattactgataatgtactgcaattggagaatgtggtcagatattccaaacttcctatgactgcacactgaagagtcttctctttggaggggagaaaaataatgctcgtggctgtttttaaaattatgtttattatatatttattaaaagaaagataatatttagaaaaaaatctcattagtcaagtaaaattttagatactctatcttgaaaaaccttctgaaaacagtataaaaaatatttgagatatgtcagtataacatagagcaatattcgattctccctccttggtgcagcaaatattttctgaaaatcaaaagtacagaatcttttaggcaggaaatacattttgtccaattataattttagaagtcaaaattgttaaggtttttggaccaggcacagtggctcacgcctgtaatcccaacactttgggaggctgaggcaggcagatcacttaaggtcaggagttcaagaccagcctggccaacatggttaaaccccacctccactaaaaatacacaaattagctgggcatggtgacacgtgcctgtagtcccagctactcggggaggctgaggcaggagaattgcttgaacctgggaggcaaaggttgcagtgagctgcgatcatgccactgcactccagcctgggcaacagagcgagactccatctccaaaaaaaaagaaaaaaaaattgctaaggtttttgggcttctgtcgtactgaatgggaaaataataagctgcctcacttcttgactttcatatgttttgtttgtttctttacactgaaatacttaatactactctattggacttctgcctccaagccaggagtttatttcctaacagaagtaagcacactgactaataataatccattctaacaaaggtttacatacacaaggataggtgccaaatagaggagtatgtggagtgtgataggaacacacaggagcgactggctaccccagagaagcaaggggattttcacagatggtaacatttgagatgatactgaaagatgagtaggtggccgccacaaagagaaagaaggagccattccaggctgaaagaacaatttatacaagtaggaaattacatggtatatattccatatacctttagtgtccttaaaacaatttttttgaatccagaagagtggattttttttattatgggtaaaatatacataacaaaatttattattttagccattttaagtatacagttcagtagcattaagtacattcacattattgtgcaaccattaccactatccatattcagaaagtttttgtcttcccaaactgaaactctgtacccattaaacatcacctccccattccttcctctttttggaccctggtaatctctattctactttctgtttctatgagtttgcctcttctaggcacctcaataagtggaatcatacaatatttctcatacaataattaatatgtaattatagggctgggcacggtggctcacacctgtaatcccagcgctttgggaggccaaagcaggtggatcacgaggtcaggagttcaagaccagcctggccaacatagtgaaaacccgtctctgctaaaaatacaaaaattagccaggcatggctcgtgcctgtagtcccagctactctggaggctgacacaggagaatcacttgaacccaggaggtggaggttgcagtgagccaagatcatgccactgcactccagcctggcaacagagtgagactccatctcaaaaaaaaaaaaaaatttaattataaataattatgctaagtgaaatatgtggctttgtccatgttgtatgtatcataatttcatttctttttatgaccaaatcacattccattgtcttgtggatgctacattgtttatccatccacccatcaatgggcattttgtttgttcccactttctggctgttgtgcataatgctgctgtgaacattggtatgcaagtaactgagtttctggtttcagttctttggagtaggtagctaaaagtaaaattgctggatcatacggtaattctatctttaactttttgaggagcctccagataattttccacaatgactgcaccatcttacattctcaccctcagtacagaagggttccagtgtctccacatccttgccaacattgtctttcaaagttttggaaaaaaaaatctaccagactgtatactggttccataagaaccattgaaaatacattcattatcattacattaaaagtgaccttttggggcctagcataagaaaaagtttgaatgagccagcatcagagaatattgacgtttgtcttattgtttgaatagtacagagtttattcaaggaaaggcctttgcggtaagaaagtactcttataaagtcagatttgttatgtatgaaataaaatcaggtggtctgcctgctctttgcaacactgttttctcttcctgcagctccctgcacaagcagcactttcttttgccatagcaacatgtgcatcaataattctttagtctgtaatggtgtccaaaattgtgcatacccttgggatgaaaatcattgtaaaggtgagtttgatgtaaaggccaacatttttgagaaaagagtggctattgcccttcattaagaacttaaaatgttattttctacaacagtgcttagcatagctgctttttgtttgtttgtttgagacggagtcctgctctgtcgcccaggctggagtgcagtggcacaatctcggctcactgcaagctccgcctcccgggttcacaccattctcctgccttagcttcccaagtagctgggactacaggtgcctgccaccacgcccggctaattttttggtatttttagtagagacagggtttcactgtgttagccaggatggtctcgatctcctgacctcatgatctgcccacctcggcctcccaaagtgctgggattacaggcatgagccaccgcgcccagcctagcatagctgctttgacaaaaatggaaacatgtaaatgttcttttaaatggatcatagacctgggatgtggtgaaaagcatactctaaacaaaagcattttttgtctacaaactgttaagttgttctaaagtgtattgtggccaggcgcggtggcttacgcctgtaatcccagcactttgggaggctgaggcaggcggatcacctgaggtcaggagttcaagaccaacctggctaacatggtgaaaccccatttctactaaaaacacaaaaaaatcagctaggcgtggtggcacgcgcctgtaatcccagctactcgggaggctgaggcaggagaattgcttgaactcggcaggcagaggttgcagtgagccgagattgcgccattgcactccagcttgggcaacaaaagtgaaaactccgtctcatccaaaaaaaaaaaaagtatatcgtggtatgccttgcccttattttgttactgttgttgaagtttgtcatttgtattgtaaacataccttatttaattgtcaaaataatttagaggttagcctgaagtatgtggaaacactatttaataaaagtcaacttgcagattctgtcttaaaacataaaagcagaaacattctatgaactgctttttttatttcgtaacatttcctatgctgtattcccagtgtgtactcactgaaagataaatgcagcttgtggtaatggttgaatgtctgcaagctggttgtcagatcactgtgtaagaactaaaggtaatcttccttttatcctctaagacagcagtccccaacctttttggtaccaaggactggtttcgtggaagacaattttttcacagaacaggggtggggcaggggggttggtttcaggatgatttaagcgcgttacatttattgggcactttattattattacattgtaatatataataaaataatcatacaactcaccataatgcagaatcagtgggagccctgagcttgttttccttcaactagacagtcccatctgggggtgatgagagacagtgacagatcatcaggcattagattctcctaaggagctcacagcctatatccctcacatgcacttgggcttctgtcatactgaatgggaaaataataagctgcctcacttcttgactttcatatgttttgtttgtttctttacactgaaatacttaatactactctattggacttctgcctccaagccaggagtttatttcctaacagaagtaagcacactaataataatccattattgttatccataatagggctcctgctgctgtgagaatctaatgccactgctgatctgacaggaggcagtgctgcgggtaatgcgagtgatggggagcagcagcagatacagatgcagcttcactcgctcactcgcagctcacctcctgcagtgatacccagttcctgtctgtggcccaggggttgaggacccctgctgtaagagttcaataaatatcttactgtggaaaggtgatctaatctgatatggctgtcgtaaatactcgacatgaagtgttttcagttaatcattcaaaaacagtaggtcatgataatatactggatgggttagtctgatgatgttagtttgctctccctggggtcatcagtagatgcgggtatacctgaacacagcagttggtcaaacctaccataaagcagaaagctaaacttgatagaacaagagtatttatttggcatagtctatatttgtatatttgatttgatttgcagaatgtatgcatttatgtgtcttctgaagaaacggaccaagaactttatcttctgtaatctatcagtactgcgattggtaactttaaccagaaattataatagggttgttttatttgtttaaaaacctaattgtaaattgcattgtctgtagtatatttggcccaagtattctgttttacctaaaaataccttactaatttgtaccaggattcatattaatgtattttgaaaacttaacgtttctcattttctttctgcagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctgaccctttaatcatgttatttatgccaccaaggttgtggatcttaaggtatgtatggaaaggaactcatttatcaaattgtaagtaatacagacatgccatttaaaagaggtaaattcttgttttctatattttgttagtaaattctcaatgaaataagttgaagtttcactggatttcattaacttttaaatattacatatatgtgttttctcagattagtgaaaattgtgaccttaaatttaatacacatatactgcctcag

SEQ ID NO: 38459 - DNA, 34523 bp, Homo sapiens
gggcggggggaggggaggggagggggcgcggggccgcggcagcggagctcgcatcctcggcggggcggctgtgcaggaggcggcgcccgggcgtcagcggacggaccgatcgacggccaagggcgcgcggaccgacggcggctgcccggaggggatcgcgggcctcggagacagcgactgcggacgatgcgcggcctcaggccccgcgcgagcgggcgctgcccggggggctgaccgcggccggacggcgccccagcaccgggcgagggagcccgcgtcgcgcggaggtcagtgcccgcgcccgcccggcccgtctggccgcgcccgccctgcccgccggcctcccctgggctgcggcagcggcggcggagccgggggctttgttctgagccggagacaatgggggagggggggcctgggcctgcgggacccgggcgggcgtgaacgtgagcgtgggggcagggcctgggggtctttgtgtgcgtgtgtcatcgagtcggggagggtggcggcgggagcgtgcgccgggggtgtggggtgcgacagcgttgtgttccagtgcatcgtcggagtgtgtcagtgcgtgtcactgggaggttgtgtgtccctgggcgtctctctggctgtgtgtgcatgtgcgtgtcactctgagggtgtgagggtcagaatgaccgtgtgtcatggtgagcgagtccctgtgagggtgtgttgcccgctctgtgggagcccatgtgtcagaatgtggaggatgggtgtgtgacagagaccaactgagacagagacaaagaaactgagtggggagaagtacagagaagcagaggagaggcaggcacagcctgaagtggatggaggggggggtcacccagacgtgttctgagtgggagattggagcaactgggagtttgtgtctgggatacccagctcagaatcccgtgcaggggacagagcaaggtcaccgcaggcgtgggtcccacgtggagggggtggggagagggaggtctagaagcacaatgaactcagtgtggcgggctgggcccacagccacaaggtcataggccagaaaaatattgtcgcttatgtcaacttctcaaatacccatagggacacagtcatagccctactcaacccacaagaggacacagtcccagggaacacacatcctcaagagataccctcacagccatcatacacttccaggaagcccacccccaggaagcacccccagtcagaaccaacacacacctacagcagactctatcaagccaacacacacctacggaaaatgctctcatgacaacacacacccacaggagaaatgctgcaaccaacatactcccaccggttcattgtcaaggccaacacataccatggaagacattgttactgctaacactctccagaaacactgtcaccagcaacaaacaagtagaccagcacctctcaggagacattgtcactgcaatccacatccatcagaagcactgtcacaactgtcacagcacatcttattaggtttacttccttggagctgcccatacatagtgggtgtcctagaagcctgtcactaacaggaggctgtgccacagttgcccttaccacacagccacttgtacaacccccaggagacagtcatggatggcatgcacaccacaggaagacctgtcccaacttctgaataaactctgcttaacttatcaagctcacaccttcaccccttctcatacgtagatctcccaggtataccctcttgttccctgaaaacttcgagatctggatagtgtatcctgccatggtttctcagtgtccttcaacaccacagcttcacagattcttgacctccttagctcctgttaccttcctccctcccaggaccactctgtagaactattccacctttaaaattctaaactcttgcattcctctctctacccacaacctcctatatccttccagctttcagatgttctcgctcccattacactctttgacctcataatgacctcttgcccttgacctctttgttttctcctactctgttcctttctgactttgtgctttctttccagctcatatgctaaggatcatcccttcaaccactccttggccactgtgtttccttgtcttctatactcatccctcaaattattgcccctaactagaatgatttctcaaccacaccaggggacgcttctataaattcatacttctaaaaaattcaaacctcaactgggcccttcataaataaatagatgattttttttctattttcttcacactcattaccccacatccctcacaccattgttttcagtagattaattaatcaaaacgctaattcattcatttaacaaacacatactaggcacctactctgctaggcattgtgatgagagttggcagcacaagtgtgaacaaaatggacatggtccttatcctcatggagcttacaggctgtggagtgagtgttgtaacacagcagcacacagcagagtaacctaggccagtgtagggaggtcagaagagtctttctggaggaagtggcatttaaacttaaacttgatggagtgggtggagaatatgccaagccaagggagcagcatgtaaaagcccacatgaaggaaaatagtgtgtgtgtgagggataaagcagttcagtgagcctgacacttacagcatgaggtgacgagagagggagagtctgtgggagaggtaaatggaggcttagaccatgcagggtctaggaggccacagaaagaaattcatttaacccaagaataatggagagtcaccaaatcattggaagcttggagcgatatgatcagattcattttagaaataccactctgacagccatgtggagactggagaaagagcctgagaagaaggacagttggctgttgcagaaactctggagggtataacactggcctgaactggagtagtggccggagagaaggagaaagtggatggtttcaagagctctttaggcagtgggatcagcagggctcagtgacaaagcagacatggtggggtgaaggaaaggaaggaattaagagtggacaacctggtcttctggctcactgaggaaattgaggccatctgttttgaattccctcagatttctgcctcctccctcaaattttatctgcatcctcttcaatcttttctccttccttcctataagaacgaagtgctgtctcttctacttaaggccaatcctctacctgtgttacggatcccatccccttcctcttccacagggacctcactcaactgattattccatgtgtttcccacgtctccagttccttcctttctcccattcctcctgggaggacataaagatcctccagcctctcctatctttctttaaccctgtaataccccgttaactaggaggcttcctcacttttcttcactgtcacattttgtgaaagagtcttctgcatatagctgttcctacttcctcacttcccatttgtgcctgcccctcaaatgtaactgctttccctaggagaaagtaacatctcttctgctcaatctggaggatcttttcaaaagtccttaactgcctgacctctcgggaggagctgacattattgaccattcttttctccttgagttgtttttgttgtttggcttctgagccatgattttattctatcaacatttaacaggcaaataagtggaaagttacattatggtatgtatctcttctggagctcctcctagctgttctctcagtctgctttgagggatcctttgtatgccccctgaatgtcactgttccttaaagttctggcttggaccttcttattgtctcactgtatacacacctctaggtaatcaatttcattcatttttcaaggcttttattaacatctataggctgatgactcacagacatctctcttctaggccacatttctgcatacctgctgcatgcctgctctttactgtatagctcaccgaccccttatcatgtgcaaacctgatctcatcattccttccttccccaaatgaccatccccactcaggttgcaagctggaatcccagaaattaactgtcaccattcccttctccacgtatcccataatccagaaatcccttggaacgtgttggttctatcttctctccagcaatctctgatatcccatccccttttctccatcacctctgctgttgccctcatctaccatcttttcacatgaatttttgcaagagcctcctaacttttctttctacacttctcttccttctttcaatccattcttttcattggagtaacagacaccttcctaaagtacaaatccaactatgtcactccctgctcagcattattcaaatgccttccattttccttgaacaaaatcttttctttttaacaaaggttatgagatcatagtctgacctccccaagcctcccagtctcatcacctgccccatttccccagccccctcacgttttgagtttcagccatactgaatttcctgtagttcaccaaagacactacctttttccatgcttctgaccctttgcacatactgctctgcctgcctgaaaggcccttcactcccttccctcctggcttatcccttcccttcctcatatctggtctcaaaccctgcctttaatgactccaccgggcaggcttgaactctgtgtttcgttgttgtcattgcctcttccctgtcttatctccccaaaccgcgctgggacctccttgatggcaagagtgcgtattactcatctttgtgactcagggtcccacacaggtgcttggctgtgaacaaaatgaatgaatacatgggtacctcacagcacatccctcaccctcgttcactcttcagaagactgacacctagtctcagctgcccacataattaagaaattttcacactactcacttactctgctggagacacttccactcccctcacctacaatttattcttccttcgtctccctcgatcctcttcctctcccttatctgtactttatctttcattcagttagcaaatatttaagaagtaccagaagtttgcagacccaaatccattgagccaggtgtctactggggctctgggaagggatggaagaagcagaagctgtgccagactacaaggcattacagtgcctcaccagattctttccccagaggtgtcctaggctgctccttcctttaatgccctcttagcccacggactcacccaccctgagccctccaactcctggcatcctggcctcagtcctccccatattaggttccttgattcttgtactcttttcttcttccctctcctgcctgtcagtggtaacagaggcaagactggactctctcttctctgatgccctggtatctgctaggaaaagcccctcccaggggttcatgctattgtctcctagcttcttcccagcttcctgctgaccccccttccttcagctcctgtatccatcttccctaggtaaccttctgacaccaggccactttcaaccactgccacttgggaggggcttccatttccctgtgtctcctggtgaaagggcacctcctccaggaggtccacctggaacttccaagcccttctctgctcacttagtatgctgcagtgtccttgttatttttttctctttctaagctactggatagaagaagcttgttatctctcagagcctagaacacacctcttatatggatggtgagagagaaagaaggaaaggaagaaagagaagaaagaggggagagggagccacactttagactttccagacacactatttatggcctggatgacttagcttctttgagctcccctttcatcaggtgaaaatggaggtagcagtatctccttaagagagttgttttggggattcagaaggaaaattattaagtgttcagctattaacttagttaattttacttctaccatctcagcccctctactatgctgtcctaccctcagcttcccacttttccaaatttgttcttctccttcaacattctggttgctacatctccaacttttctgctagctctggccttgctggcctcttctacagcctagaccctgattgtcagggtcagaatttagggcaacccttgctgcatgtcactaccccgtgccccagctccctcaccctgccctgcccgtccctgccgagtctccctacctgtgaacatcatgaaggaaaggacttgatctgtccacgtcacctctatctctagggcttagtatggcatttggcacatggtaagtcttcaacaagtatttgttgaataacagatttatcaatgaatcacttcacatgtgtaccctacgacctcctctcccctctccattttttctttgtctcctggaggcctccagtcatcctccatgttccttcccctctcttaccacctgcccccatgctcacctggactgacaattgtctcaacattgagctcctcctcctctcacccaccctgcacacactgccagatgtattctcctaaaacagaactttgatcattctccttccctgctttgctgcctgaccagttatatgagcttttatcagagcatcccgagccctccagcaggcaagcagtgtggtctaacagaaagcactagctttggagtctgtcaggactgcattctagatcattctaaatgtctctctgctaccttctttgagccctcagtttcctcatctgtgaaataacacttactgcagagttactgtgtgtgtgtggcacacaacagcagcagctaacatttagtgagcgttcactgtgtgctggacattgtgctatgtttattgttagcattatttcattaactctcatatcaaccatttaaggtaagcactttaaaccccagaggtttaagaggaaactaacacttagaatgtttagtaacttgcctagactcatgcttaagtggccgagtcaggatttgaactccagcctgacagtcgagcctgccttcttaaccactataataatatctcatgctcacatacttataaagcttactatgtgccagacactactctaacagccaaatacaatgtagtaggtattattattgtccttatttataaatgaggaaatggaagcactgagaaactaagtggcttgcccaaggtcacacagccagtaagtgaaactgggaaccaaatccagctggcttggccctggagtctgcatcttaaccactatcctgtcctgccttgctatgatatattgtctccctattctaggggtgtagtaagcatgtattggtgaatgaatccatgctgatgtctgctctatggctagctattggttgatccattctttctcatttcccactgcaagaggcttgcacccttagtactcttctggcacaattttctccacgatcactagagacctcctcactgctaaatttagtgtccacttctcagcccttatcttacttgaattctcagcagcattggacattatcgatccctttcttttttgaaatgttttctcccttaacttctgtgatactgcccccaggaagaataaaggtctcttcaacctactgcttaatgtaactagttctcagggttctgtccaagactctctgctcactctacacattctatctgatggagtctctaaggccacagctttcagttaccccatgatttgtccaaatccacatctccaaccctggtctctatgctaagctgcaggcttgcaaacccagctgtgcttgaatatcttcacatggggatcccaacagtcaccccccaaaatggcttttcctctgcagtgtccaaatggaaccactttagtaacctggccagaaccctggtaggcaggccgaagtctagagtccttccactccctcatcttcctggagagtcagtgaccaagtcttcttaccttcacctcctcacatctttcatgtctgtatcctcagcctcaccgctgctaacctggactctcccagaggcctcattcttcacctctctcctccagattctcttcctttttcaggcctcccttgccctgtgaggactctgtcccctcaacttccctgtaatttcttattctctccatctttctctcctccctgaatctcaggcaacatagactacatagtcctgcgaccaaattaaggctgtgttaactcaggaaaattgtttcactctgagtctcaatttccttgtttgaaaatggaagccgggattccttcctcacagggttgttatggtgattaaatgagatactgtctgtgagctgcttggcacagggcccagcgcaccataaaagctcagaaaatagacttttcctctgcctcttttgctcacatctgtcctcagcttctccctggagtgcttcctgggaaccagtcctcaggagggacagagccaggcccgggcactgctctggccactgtcctatggggctgtcccagggatatccagggaagctagtttgttagctgtctcctcctccctcctgagccccctcctccttcttccagctctggcccagcacgcaccggtggggctgtggctgttcctgcctcaactcacctcccctttctgaattagctctgctccctctttcctctgccatacacagtcactctccctcagtcttgttccctgtcatccccctaccagaacctcttctcacttcctctttcttttatgcctggccctgtatcctcacccctttgctcactgaggctaccctcttcttcctccacttctagcccatctaccttttgtggcgcccctcctcacccctgttgtctttctgcccctcgctggccctgggacaggaagttgagggaggaggcctgggtggtgccagctcccccagcctgtttccccttcagcgcctcgggccactcctctacttcctcctggagcacccccttcccttgtagtccccctgctcctcccccccagcccacctctctttcctctcccatgttccccctgcttccaggtcctgtagacacacaggctgggggtgtgagggaagctctgttggtgagggagggggaattgacatcacgtttcaggccccaatgaacagtcttgcccctccccctcctaatgagaaccagctgtggttccagaggcccagatgtggggatggaggaggagagcaggatggagtcagaggaccaagtagcaggaccggggacagagtgagggcacgtagcaaggcagaatcaggtgggagaagagccatgacagatttggaagaaggaagaagacagatctaggcaggaggcagcatatgctggggaaagagacaagatggaggggcaggccagatctggggaagggatgggacagacctggatggggaaagatacaagagcagggaggaggagccaatctcagggaagaggagtgagaaacactggacggacttggggagatggtgcaggggagagctggagcgagcatgagacggtctcgggagagagtctggagttcgagtttggaactggaaggcttgcagcaggaagtgatgaggcacagtccagacagaggccccagggacctggaggtcacagctgcagccgcagagctgaccacgagtgccccggcagcatgtgcgagagcatgcctgcgtgtgggtgggtcttcaagtgtgagtgcatgctcgccttgtcagtctgtgcatacgtgacactgggcctgtgtgtgtggagggtgggtgtgtgtggagggtgggtgtgtgtgtgtatgtgggggcatatcagagggtgtgaacatgcctcttggtgtgagggccatgagaaagtgtctttctgtgtgtgtgtatgtatgcctgcatacgtgtgggggtgggttccatgtgaaggaataggctcatctgtgtggaaaatgtgcttctgtgtatatatgtgaaagggtctctgtgtgtgtgcactggctgtgtatgttaaagcaagcctctgcgcacgtgtgtatgagcatgtgttgaatgtacctgtgtgcatgtgcatctgcctgcatgggaatgcatcttcgtaagcctgacagcatgagagagagtgccaggcagtgcatggggctgtgactttgtgagtgtgcacctttgcgtgtccaccgtgaaagtgttctgcaagagtttgcagtggtaggagcacaggttgagagaaggagttgttttcacacagggcatctgcctggacatgagtctctcctcttgaagtctgatcattcacctgagatttatctcaaaccattcatagattgcttcattcagaaaacgtgtttatcatgtactatatgctgtgctccatgctacatacaaagatgaagaaaatacagtctgggctcacaaacagctacttgtctgggtaggaagacaggtaactataatacagagtatgataagcacattggcctcactattatcttccctccctccaaaccatgactgctttctctccactaactgattaaatcaatagagccattcttaccccttgacccctagcccagcctttgggcttagatccctgatctgggccctggaaccatccttgtactctcatcctctcccttcttcagatcaggcctgggttcaccctgacctccttgttctgaatccctctgacctgttattccatgtggcacacatacaaccccagcattctgaagctgggatgaaggcagagagggggcctatcaggggatggtgctgggaattaatgaaagagagtctagcaaatacccagctctgtgttcctttcttacattgtttctaattttcacaaaaccccacaggataggtgtcagcatagccattttacagattacggacataatgcgcagcctggggctcaaacccagtccaagctccaaagcccctgctctttttgttgcttcacacagatgggagagaggaggtgggtcagaagtgtaagtaggggagtcagaaacccacctctctctgtggaaaggaagtcctacagcacagcaaatctgtaaagacctgagaacaggtttgtgtagtcacaggactgaccgaggggcctcagggtcctgggctcacatgtgtttgtgtgtgttgtctcagttggcatgaccatggatgtgtctctctgagtgtgttacgtgagtatggtggtgtggaagcatgaggctctgaccattcatttagcacgggctgcctgctcttgctataactctactaaatgctggagaatcaagaggctaaccaagacctgtcactgccctcaaggagtctccaatccagtgcagagggcagacacatgaacaaatcgaggctgctgtgcaatttattgtcagtgtttaccaaaagtaatgagagcccagtagtgtgtataataggctctgcacaggcaggagggagtgattttgtggagaggatttttagaggttatctcatgacaaaacagtagcaaatacaaggtgaggagttaggaaggagcatggtaatagatttcatgttggagtgcaaggtatggtgggggaagtaaaggtgagggaccatggagaagttggcagggctcagatcatgaagacatgttaaggactttatcttgtagatcagaagttctatacctagttagtgtccatgaacctcttgatgctatagacataagtttgtgtggttgcctttctttccgtagaggggcatttgttttctgctgtcagttatgggaaccagtggaaacctttcatcaggagtggtttggtgagagttgtgtaggtatctccagtcaggtggagatggatcagaaggtccaagccagtaagtggaagaccagtgaggagctgttgcaggaatcacaaggagagatgttcggactgggatgtggcaatttggagaaacaagaaagacctgagacatgtctagttgaagtggtggggtttacatgactaattggaaatcaggactgaggataagcaaggacacaaggagagcttctggattgctagttggacacctggatggatggtggccctattcacaggaaaaggaatggaggggaagcagtttgaggtgatgactggggatactgaagcccagtatatggctggacatgtgtctccagaggtcttcagagctggagctggagattggaaagtcattagcaaatagatggcacataaaaaatgattgatacctttgaactgaaggcatgggagtggataagatcacgcaggcagagtatggagagtgggaaaagacactgcccaggactgaaccccgaaaagcaccaattgtgaaggagtgggcagaggaaaaagaacttgcaaaggagacagaggagtgggcagggaagcatgatggaaataagaggtgggggtcacagtgtgaaaccgaggagaagagatttcaaggagccagtgatcagtgtttcagagttccagaataacccgataaaaggaagataaacaggtggccgccaacatagaacatggagatgtttggaagcttagtgaaagcaatgtcacaagaaaggaagcctcactgcgtagagggaggagagtgtgagaagtgagaaaatgggggaaatgaaaaaatctttcagaaagggcgatagcttctgaatgtccctctttcctctggtgactacatcccatcttcagtctgtgctctcacttatccacagattcttcttagtcactagagtaaggggctccggggcatttccttcctgatcttaagcatcatttgaaacctcccttagactcagaggcaccacccctctctggttccttgccccgcctctttttctttctgagcggttaaggacacctttatccagctggtagttcaggtcagaaatgtgcgcatcatccttgacttctcccaatccttcttcccctcacttcaaacagtcagcaagcccggcctctctacttcctgaaccccaccagagacctatccacttctcgccatgttcattgcttacactcacccaagttaccatcaaagcagtgtcatctcctggatgcccataagtgcctcctcactgtccaatctgcgtgatctttgctttccaaaggactgcaatagccatcttcacaaaatataggtcatattctggcactcctccttgaagtgctttagtggcttccatttgcctttaggataatgtcaaaatcttcaatacagcttacaagtccctgtctcatttcataccctctgcccctagcactatgcttcacacacatgccccccccaccccaccccaccctcagacactctgagccccaccttgactgtaggctctaagcctttccacatactgttcactcttctagaatgtccttttctcctttctgtatcccccttctctggccaccattgcctagctagcacctagttatttagatgtcaactttaatgtcacttcctaggcaaaacacggactccctgactccctgcctgtgttgcttctcttatattcctccttgctctttgtacgccttcttcacaactcttaccatacttgtaattacttgttcaactcctggactataagctctatgaagccagagaccatttcctttattcgctgtggtatcctcagtgcctctatattgtaggtgctcaatctcttgttgaatggagagaggagtagggaagtagagctaaggaaacaacatcattcccttccagcagggtggtgggtggggagagagagagagacttgagcatatgtagtattgatggaaagctccaggagagaggaaaaggttgacggttcaggaaaagttaccaaatacatggttatagaggctggaagaagcgagtattagttctggatgagaagaaaatgagaaaagaatgtccatatttttaagcctagaaataggaagaagggagtttgtgggcattcagacccgaaaaaataggatgcataaaaatctgctgagggtaggaaaggatgagatctgccaaggggaaggctggagtggcctcgaagagtcctgaggcagagatccgtgtggcccaagatgagtgtgaggcagcacaagggcctgctgggggctgagcatatctgaatgttgatgtggcctcgtccaggttatctggactgctgatccctcctctgtcatgacccgtttccttctgttttctcccaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgggtaggcctggcacatagcaagatagtgttgggggaatctgagagccacaggggacctcagagcaggaaccaagccttacaaggtcatctgttgatggtgacttatgctagagggttctgccctatgttgtaagctccaaaatctgtgcagaggatgagggttaatgagaagatgagaaagcagggtgcaagagctgaggcagatggtcttggcaggtgaggaaattaagattggatctagtggagaaatgatttgtggtgtcaggaaatgaaagcctcaaagctgttctgcagggcagagatggagattctacatacgtatgtggcttctgttccccaaagaagacaccagaatttatggggccctccattgcttgtcaagtgctgggttgtgctggaagaaatcctcatccctgccctcagagctgagccttaataggccatttggtctcagacatgagaatgagagatagcaagaattatctcaatatccagagcaggaaggcctctcaggggaagaggcaggaaccctggacaggctgagaaagacacatactggctgcaagtcagtcctggagaaatggagggaacatgaaactggaaaggcactctgaggccaggttgcagaagtccttgaacacaaagcagtagttaggactacttgggaagcaaaggagctcactgaacttcttttttttttttttgaggcggagtctcgctctgttgcccaggctggagtgcggtggcatgatctgggctcactgcaagtctgcctcctgggttcacgccattctcctgcctcagcctcccaagtagctgggactacaggcacctccaccacacccagctaattttttgtatttttaatagagacggggtttcactgtgttagccaggatggtcttgatctgccctcgaggagatcactgaatttctttgagctgggaagtgaatgatcaggttgggttttattaagttagctatctggctttaagggtgattggatcagcaggtgtgtgacagatcgttccttgattcatatgttcaagattttatttaactactgtaagcctagcactgtgctaggcccagagaacaaagaaaagagacaatcctgttcccagggtggtcacagtctagatagggagacacatcagcaactagtgctgcagcaggtggcgtatgagtgctgtggaagcccagaggaggggccttgaagaactaatgaaactttgccaaatggataatatgaggtgtgcagatggagactccaggcctaaggaaagagctgctgaacaaataccaggacgtgttcaggagactgtattgttcaggctggcatcagctgtactaatgagaaagagtcgggggagatgagaaaagacagtagacaggagccaggtcacaaattcaactttatcttgaaaatcatagggagcaagtgaaggactctaagcaaatctgatatgtctttaagaaagattgctttggctgcactgtggagaatggcagcaggagagaggacagtgggcagggagtcctcttaggaggctggtgcttagtgtccttatgtctccaaactccaccagactcttgaacatctcctcagggcatagacttccaggctagctctgggcctggctgacctcttgtcctctggccagactctgcatatttgctcgcctgctgctgtgcagctccaccacccactcttccacgtgtttactctccttcttgtccaggaccaatgggctatggcttccagacttctctcctcactagtgcctgaagcaagagggcaactctccaggtggtttcctggagtttttactattagtaaccatagagaatcggggtaaaaatgaccatttggggtttacaactgtcacaagaagtcttaatgtttgatttattcaatatacatgtattgaatgtctaccatgtgctagtcactgtattagagacacggaatacagtcatgaatgcgtcactcccctcatcttaaggagtttatagaggggagattcatgtgcaaagaaatagtttcattccaataagaacatttccatttggggatatatatgaggtacagataggcagtatgagtgctttcctgaaggaagggatccctgagttgagacttaaagaatgagcaatttatgagagtatcagatgggggaaggcttccaagcagaggtgaggtgcacagaggtgtgggagggcccagtttgttcaagggcctactaggggctcaggatctctggagttaagactggagatgggaaggtgggagatgagactgcagggaggctcagccaagtcagagggtttgagcttttttctatagcaatattatcagatttgtttatgcaaatggtagtcaatgtagagcagtggttcataaccaggggtgactttgccccccagaagggatattagcaatatctagagaaatttctgattgtcacaatgggtgggagactattggcatctagtgggtagaggctgagaatgctgctaaccatcctgcaaggcacttagcagctcccataataaagcattatctggtccaaaatgtcagtagtgccaatttgagaaaccctggtggagagtacagatcagagggtcagacctctatgagaaggtaatcaaaataatgcaggggagcaataactcaggacagctcaggcctaagtcagaatggtgataatggtgatggaaaggaacagacaaatagagttaatgaggacttacttaatccctggttgattgatataccaggtgagaaaagggaagaactgatttctggctttagcaactgtgtggatggaagagtcattagagcaggtttggaatgatcatgagtttagttttgggctggtcggatttagggtgcctgtgggacatccaggtggaggtgctgagcagccatctggatgtaaaagttgggaaatctcagaggagtggtctagagtgaaagtatagacgatggctgaagtaaaaggcaaggccctgagagaatgtgtggagtgagaagaggccaaggagagattccagggaacagtgtgtaagaacaggcagataaggggagatggaggaagactggcagtgggtggtgggggaagcagtgggtggagaagcaggaaaagtagcatcaagaagtcatagcaggagagatgggcatggtgatgcatccctgtaatccaagctactcgggaggctgaggcaggaggattacttgagcccaagagttccaaaccagcctggacaacatagtgagagcctgtcttaaaaaataaataaaggccaggcacagtggttcacgcctgtaatctcggcactttgggaggccaaggtggaaggactggttgaggccaggagtttgagaccagcctgggcaacatagtgaaacactgtctatgcaaaaaataaaaaaactagccaggcatggtggtgcacgcctgtagtcctagttgttccggaggctaaggcaggaggattgcttgagcccaggagttcgaagttgcagtgagctaggatcacaccactgcaccccagactgggcaacagagagcctgtctcaaaaataaattaaataaataaataatttatgttttgaaaagtcaaagcaggaggtacacctggaaaagaggttgggataggcatatggagtaagtttcgaggctagtaagaagtttagagagttcacagataagtgtctttcttttctccttgaaatagtgcatctgatgagagcaagggatgggatgggggcaagagaagagggatgaagtttattatggctttggggcagaatgggagagggagccgaccaaggtcggactgagacgctgagctgagaatctgctgaaaatggagactgtatttgcagtgaaacctctgagcaggggttgtacaggccaggaaattcacttctgccttgctcatttccagtcagtggcccctgtgccttttggggtcacttcctgacaacttccccagaccactgtttattgctttcttcctgcagcgagtcagagggcaaaggtcgttaacagcttctggagatggtgccgcagctgtgctgctgcctgccaggattgatgtaggggaagtctgtctcctgggatatccgggcccacagccacagtagagagttggagcagaagctgtttccagggttcagccatggcagggtcttggtgtctctcaggagggtaaacaatggcacagatcatttctgtcaagggtctgggccacaatcagaagtccttggccagctttctctctaagcacattttctggctgagaaaggggaactctccagcttcctcttgcagcatatcctgaccctgaggtccttatatccacaaagagcgctttgtcacaggctacagttgtcagcaccagctaacccactattgagggcctaatgtgtacccaatgtataaaacttagtgtgaaagaaggttttgttacaaagcaggatgatcagaccgtcgatttactcggtgaaaaaatacacataaagcacctactatgtaccttgcactgtactaggctaacgatgcatgagccacacacccataaatctatagaacagaccctatagtgatcagatcccagtattaatcagatcccactctgtaataatcaaactcaataaagatcaaacctataaatcagtctcaataattccactgtcggtgagttcttggtttggggtgattatgagacttggtgagggtattaacttcctggacccacctggaatttgaggtcacagccctttcttctttctaagtacagttggtcctcattatttgtgaattcacttaatctcgaaaatttatttgtaactccaaaatcaatactagcattcctggacatgggcagagagatgaaaaatttgagttacctaatgttcacattcccagcacagggtgaacaagacgatgttctgccttctcatttgggctctcatgcttgtaaacaaatgtccctttcaggtctatttactgcaacttttttttttcatttttttagtgcaaaaagctgatgatttcactgtttaaatggtccccaagtgtagtgctgaagtgtggtctaatgttcctcagtacaagaaggctgtgatgtgttgtatggagaaaatacatatgttagataagctttattcaggcatgagttacagtgctgttggctgtgagttcaatgttaatgaatgaacaatgtatattaaacataagatgtctttaaacagaaacacacatcaaacaaggttatgtattgaccagctgacaaaaaatgttatggctagaggcacttaggaacctaactaaatggtgaggtacaggctgaggttgggtttgggcccatgtcctactagtcctctctgtgtgtccgccatccagagacttagcaccagttgttcattctaatggccacctacctctggcttttctggcaaagaagaggggacaccactcaccccagcctctccctaggtgacagccacagacgcggatagtggcccatttggcctcctctcctattccttgggtgctggacttgggtcctccggatctcccccattccgcattgatgcccacagcggtgatgtgtgcacaacccggaccctggaccgtgaccaggggccctcaagctttgacttcacagtgacagctgtggatggggtaagtcagtagaccaagggcaggttgggatgttggggtagggcactcaccagggccagatgaggcccacctgacctatggctgcatgtcccaccagggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcaggtgaggatcctcccattcccggggccttcccccaggtccccctccccacctgcctaaatgatgtcctacccacctcctccataacctttctagccctattatgtttccttatatatctctgcttctattcttcctctcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtatcatttagctttatacccacttggtgtcagacccaaataccccagtataaccctccagcaccatccgaagataccttagagtatcacagggcagatagccccagtataaaacactcctgtaccaatgcccaacacctccttaggcacagtgcaggcacactgcttcatgaggcataggaatgtcacctcagtgcgtgccaaccaacttctttgccaacccctgcccctcctcctaatattttgaaaggcatgggtgtgggcactgcccagtccttctcgggatcagactctgggtcctgactcaataagtgcccctccatctctttcctgatccctttttcatcctccctaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggcctctggggccctcaggagggccagcccatgagctggagctggaggcccgggatgggggctccccaccacgcaccagccactttcgactacgggtggtggtacaggatgtgggaacccgtgggctggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggtgagcacagagacccaaatcctgagaccgcatagccttatccccagcctggtgaacattcagacaggatccccaacccccagctcccatctcgcccctgagaatgaggatttagccctggcattccctcccccactccccaaacaccagcttcttaggtgcaggcctcaggctctgcatccttaaacatctcgtacatgatcgccttcttgcactcccaggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtatgtgaagtggcaggactttgtcctgagaagtgtgagagggagtggggatctccccatagagctgtaggtgtaggtaagagactgcctcctggattgggtgtgagagccgaaaagaggttctgcctgcccacaggtgagggaagctttatcctgagttgtctgaagaacaggaaagagactcactaggtgagttgtgttcccacaggtaccagaccgcgtgcctccgggaacactggtgacgactctgcaggcgaaggatccagatgagggggagaatgggaccatcttgtacacgctaactggtatgggagtggagagaggagaattggtgggtgatggcatgccctcatggcctgcccagctctgggccccaagccctcatcttcctctgcctgtccccaggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtatggctgcccttcctccccttggctaccgctgtaggtccccttcagtagctccagcttcacgggaatcctttggctccactagcagtcaggctactctgaccactttcctaccacctgggaagccagcccagatccccttttacacgggccctcacaattctgttctccctccccggtccacaacaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgcttacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggtgagagttaggtctgggagtgagggcgaggaaggtgctgatgtggagtgttggggtccccaccaacctgccttaccgctcacctaggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggtaagacctgggggggtgaattatgagtgggatggactggggcaagaaacagcatttttaccctctgatcgccctccatgctgcccctcctcaggggccaacgggcaagtgacttatggaggcgtctctagcgaaagcttttctctggatcctgacactggtgttctcacgactcttcgggccctggatcgagaggaacaggaggagatcaacctgacaggtacatgttgacaggaccccaagagcctgagtgaggtgttgtaaacaccagtgttacctggatagaatacccaaagtactaccttttagaagtttttgcctattaccacaaagctcctgttatgtttttggacccttttggggagtcgagagtttggcagggtgcaaggtcaactgacttctagactgtcacaactgtgaccgtacaaattctaaaatgcataatgtcacagctatgccctccaggcctccctcagatactgcagccatttaacagaggagcattttgatactgaatattggagaggtcaagtgacttgctcaagctcatgcagcttggaagtggcagggctgggacttgaacccagatcttttcatacctcatttagtgcctttcctgttacaccaccactagtccaagatatatcttgcatgcaccaagcatgggaggtaggacacatgtatgtttatgtatgcatgacacatgtgtgcctgagaggtatggagagatggacattttctggtttgtgtgcacctagtgaacatgtatgaacactgtgtggtgtggatttctccatgtggtgagggcagactagacctcattgattttgcttccccacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctaggtgagaaccttcccactcccacttaattcagcacccacttgcctggttcttgctccttcttggctgctgtcagcctcagtgcatgtgtctgggtctccttttccctcttgatgtcgtccaccttttctttcatgcttatacccagtgtagctaggtatctcattccatgctctttatctccctgtgtgtctctgtttctatcttcctatttcttttctttctcatttgtctctccctgtagagcagtcgttctcaaatttttggtctcaaaaacccttaacactcttaatttttgagaaccctaaggagtttttatgtggattatatcagtatttactgtattagataataaaactgagatgatgttaaaatatgattgtgaaacaagccaatgaagtatacagcttgccagtatttctgtgtaagcacaaggaaatactaagatttcaagtaacaatttgttggaaagtagttaatttcagagattaaagcaggtataattgaagatagccagaacaaactgaatctctgaagacacacagattcatgctctaaactttctgtctagaatattctagaacacacaggaatacataagcacacattcccttaaccaagacattatatcatcacgtcatagagcatctgtaaattctactgtacatctgtgagatgagaataaaaaggccatataatggcttagtagtgctatgaaataattttgatcttatgcacatgaaaaggacttgggggactcccggggttcccagaccacacacaaatgataccagctgctttatagtatcttcttttactttctgtttctgtttttcttcctttctctcataaggttcacttgcttttgtgcacatgctcactctctcctgttgtctgtaaatcacccccatccccacgacacatgtatatttatatgtgcatgcccttctctgcagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccaggtgggtccccagccatttcttccagattcagactcccaaatgggctggggttgtgctttgaaaatgtcccccaaactctcccagtctcgcgctcacagtccaacaataccgttctttctgcagggactcctattgtctcccccagggccgtccatgcaggaggcacaaatggacccatcacctacagcattctcagtgggaatgagaaagggacattctccatccagcctagtacaggtaagaaataggagcaggggctctgtgcaggacaggctactggggaagcaggttctttgcatcagaggagcctttgatgggtgaagggctgtccttgagtaaggggtcttagagaaggaggctccagggcaagcaaagggggctatcactgatgcattctatctcgcccaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtgcggggtgtgatggaaagattgggcgggggagcagggctagtcagacttgtctgtggccagaccagtcccagcagcctcctaccctcaccaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggtgaggcctggccctgtggacccaagaccccatcttgggcctgtccagtttcaagccctgccttgaactcatctggtcccttggccacatcctgaattccccagccctaagctctgtcctgagtcctcctggccctgcccagagttcccccttattgccatgtcccacccgatgattgtgctttgtgtccaggttggtgctgatggccacagacagagggagcccagccctggtgggctcagctaccttgacggtgatggtcatcgacaccaatgacaatcgccccaccatcccccaaccctgggagctccgagtgtcagaaggtgaggctgggtaaagtgggtggcataaagggtggcagagagacatttttctccaccctgcagctcaaggtggggctgtgtccattgccaaacacactagtctcatgtattccagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggccgtgccaacctcacagtgcttgtggaggatgtcaatgacaatgcacctgccttctcacagagcctctaccaggtattgacacccatggatccacctacacctgggcctgggttgttcctgttggagggaagtatcagagctagcagctgctgaggtgggctggacgttggagctgatctgggaatgggaaggtcccaagtcctgtgaactacatcctggttttgcatcctgtacccagaaaggggagaaggtgggcatttcccattcgaatacttaggagtaggggctccaagttggaatagacgccaagcagggcacaaggaaccaagctccagaacaggctgcatggacagcagggcaaatgggaagcctggcaataagcacttttcctcacacttcaggtaatgctgcttgagcacacacccccaggcagtgccattctctccgtctctgccactgatcgggactcaggtgccaacggtcacatttcctaccacctggcttcccctgccgatggcttcagtgttgaccccaacaatggtgcgtctttcccaggatctgccccttgcctttgactgtgttgggctgtaatctgacctcattccttgaatttgttactcaaactctttaactcctggatctctggcctagggaggacatttcctcccctctgtcttcattataagccccttgttgactgcatgtctagaagctgttccctaagctgtgaatccttgaggccatccccttgtctcccagcagataggccattccctgagtctgacttccaaaaccatttcctagatcctgaagggtcactcttctgttcactcacagcctttgctgaatatatttctttcccttccgttctcatctcagggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgaggacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatcc

SEQ ID NO: 38460 - DNA, 8657 bp, Homo sapiens
cctaacgaaacggtaaccagccctgggaagcccgcaagaggcctcagcggtggccgtccgagagccgagaggtgagggtgcccccgcctcacctgcagaggggccgttccgggctcgaacccggcaccttccgggtaagtcctctctcgctgctggcgctatttggagaccgaccttaccgcctagcagatggggaaactgaggctctgcctgggcgtcccgggccaaggtcacaggaccagaaggaggactccacctggccccgccagaattggctggccagagattggaagcgtccccgggtcgcgcctgccgcctctgtaacagcgctggggggtgggcaggtttaatccccatttctccgacgagaaaactgaggctaagacaaagagaaacttgcccaaggtcacacagccaggaagtccgggctccaaggccgggtttccgagaccgggtggggaaatcaacggccctaccccgccccctgttgccgcccacctccagccacgccccctttggccttgggtaccctccacccaggctgaatctctcctcgttccgcaggacacgcccaaccctctccagcccagacctccccttcacatctctctctctcacacacccaccctcaccccaatttttcatctcccaaaaaccagttcccctccccgggatcccctatgaatcttcagatcatgcccctcgctcgaccagaaactgggggcctttctccccgactttccccaccgtcccagctgccccttcctgactctcccctgtcccactgggccccagcgccgacctcctgctctctggccttttgcctccagttcaaccgcacggcgggggcctgaagccatctttgtattttgcattttgaacactttttctggaataataccacaaacgcagaaaatcgaacggtttgcaaatacacagcttaaataaatatttataaagggagcaccctggtgtaaacaagtatccaaagaaaaaagtcaaacatgcgccacatcccaggatctcccgccgtcgtcgtttccatcactgtggtccaagggcagtcactgtcctggcttctgacgccatagatcagttttgccgggttttggctttatgccaaccctttattgtatatagtattgactagacaacttgttgcacattgtccagaattcagaagaaacagaataggacccagtgaaaaggctcctacagacttccccggtgcctggttcacccgcctgagtctcccgtttcttgcttgtttgccagagatagcagatatagatataggcaacacagacacattttcctctcccttttttctttggcacaaaaaggagcattccatacacactgttctgcttctttttcacttctctcaaacatgttttcgtattgttacttaaagagcttcctcgtaattttttctggctgcgaggaataacagagtatagttatggcatgacttacgtaaccagtaccctcattgtggacattgatacttaacttctgctcctttgctctggggaagagtcctgtaatgaataatcctgtgtcgtttcacatgaatgtctgtaggataaatgcttaggagcagcttttgaggtcagagggtttgtgtatccatcattttgagaaatgcagctgctcggctgtccctaggagttgttgtgacccacactcctaccaggccagaggggagttcctgggtgctccacatgcctgtcctaggcttttggacatgctggcccccagatctgcccctccatggctcctcactgccctcagcagagagactccagggcccttgtgacccacctgtcagctctccagctcctggttccctcagaaccatcccttggggcccgggtgtccaggtcccgcctcctgcacaggggaggaagagttagcacatgagtggccgtgagagggtcactccatggggaggaaaccgcaagggctgtttgagaggagggagtggctgggctgaggctggagggtcttcagagcagtgcggggcgggggggaaaggggcgcctgcatcttagtcctgaggacagagagaatccacgggggtcaggggacagtttgagacaggggagtaatagctttgtgttttgtgaaaagatcatttttctgtcgtcagtttctctaggagaacactgcagcccctgccaagctgtatctgactccctccaaatcccacttatcacagttgtaattatgggattaattcactgtggttttgtttcagagggagtttccattcaattttatttaatgagataaaatttgcacaacataaaattgaccattttaaccatttattcgtttttaaacttgagatatggtgcacatagaaaacatttgctatggtagatggattatgttcaaagaataataggccaggcgcggtggctcacgcttgtaatcccagcatgttgcaaggctgaggcgggaggttcgcttgaacccaggagttcgagaccagcctgggcaacataggaagaccctgtctctaaaaatataaaaatacaaaaattagccaggtgtggtggcatacacctgtagctctagctacttgggaggctgaggtgggatgatcacttgagcccaggaggttaaggatgcagtgagctatgattgcgccactgtactccaacctgggtgacactatgagaccctgtctcaaaaagaaaaaatagtacagggaggccaaggcaggagggttgcttgaggccaggacgagagagagaaagaaagacaaggaacaacagtgtcctaactacccagctttgaaaatagcagctcaaggccaggtgcggtggctcacacctgtaatcaccagcactttgggagactgaggcgggtggatcacgaggtcaggagttcaagaccagcctggccaacatggtgaaaccccatctctactaaaaatacaaaaattagccaggcatggtggcacaagcctgtaatcccagctacttgggagactgaggcaggagaatccttgaacctgggaggcagagcttgcagtgagccaagatcgcgccactacactccagcctgggtgacagagcaagactccatctcaaaaaaaaaaaaaagaaaagaaaatagcagcttcttgttgagtgccctgcctccctcagcttcccagaacaccttctgtcttgcctccaatgagcctccagggtctcccatttccctggtgaattaatgaataaatgagttaagtacaaacaaattgtacacacagacggggagagagctgcagacaaaagcccagcccaaaccctcacttgtgcagcaaactcggagacccaaaagcacaagcctcccagggacgtaggccaagacgtgctgattcagggcccctgcggtgtagacgctctgacagcgtagacgctctgaccgagtggaagtcaggtgtgccctgtatggctgcaggacttagggcaggttaacgggccctctgggtcgaggtttcctcccctgcaaaagaattgctggccaggtggcttcaccagcctgtcctttttttctttctcttcttttctttcttttcttttttttttttaattgtggtaaaatgcacttaacataaaacttaccctttcagccatttgaaaatgcagtggagtggcattcatagtcatgctgttctgcagccgccaccaccaagtcccagagcattttcaccatcccaaactgaaaactacaccccccagcagtcaacctgaattcctcccggccacagcccctggcagccaatcatctgctttctttctcttttttttttttttttgagatggagttttgctcttattgtccaggctggactggcagtggtgctatctctgctcactgcaacctccgcctcccaggttcaagtgattctcctgcctcagcctcccaagtagctgggacaacaggtgcgtgccaccgtgcctggctgatttttggtatttttagtagatatggggtttcaccatgttggccaggctggtctcaaacccctggcctcagatgatccgcccgcctcggcctcccaaagtcctgggattacaggcgtgtgccaccaagcccagtctcttttttttttgagacagagtcttgctcagtcacccaggctggagtgcagtggtgtgatctcggctcactacaacctctgcctcctgggcttcaagcgattctcctgcctcagcctcccgagcagctgggttacaggcacccgccactgcctggctaatttttgtatttttagtagagacagggtttcgccatgttagccaggctggtcttgaactgacctcagctgatccgcccacctcagcctcccaaagtgctgggattataggcgtgagccactgcgcccggccccatctgctttctgtctgtggatttgcctgttctgggcatttcaggaaaacgggatcgcacgctccgtggtctttgtgttgagatctatccaggttgtggcctgtgcagggtcccccttctttcctatggctgaagaatatggcctcagtttcctcttggagcagggtgaggatcagggtggacccttcattcaggaggccctggggagtgggctggcccaacacaggaggacgcccagcagagcctccgttttggggctgatggtaaccagggctgacagtaaccggggctgatgtaaccgggatctgatagtaaccggggctgatggtgaccagggcggatggtgactggggtggatggtaaccagggcagatggtaactgaggctgatggtaaccgggactgatagtaactggggtggatggtaaccggggcggatggtaaccgggatcatgaagcactccttgacgttgtgcacagtcctcagcaaggagaacacagggaccaggagagggacacccggagccacgtgtggatgtggcccagaaggcttcccaaggaagtcacctccctgccgaataggacagaaataagaaagaagcccattctaggcccggggaacagcagacacagagaccttgaggtgggaagaaggttggcaaggtgccccgggccctgccaggctctgagtgtgaggacctggacgccagctggagacactgagaggagccctcgggcctgacccaccgtccctctgcccacccccagaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtatgacctcagccccccaccctcagacccaggatccaggctcagccctccaccctcagacccaggatccaggctcagccctccaccctcagacccaggatccaggctcagccctccaccctcagacccaggatccaggctcagccctccaccctcagatccaggatccaggctcagccctccaccctcagacccaggatccaggctcagccctccaccctcagacccaggcgtccaggcccaactcctcttccttcagacccagggatccaggcccacttcctcttccctcagacgcaggagtccaggcccagctcctcctccctcagactcaggagtccaggcatagcccctcctccctcacacccaggagtccagacccccagcccctcctccctcagacccaggagtccaggcccagcccctcctccctcagacccaggagtccaggcccagcccctcctccctcagaccctgacctttcttccccatcactggcacaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttggtgagatgctgactgaccccaggggtccctcgttctaacctgggacccccatcctaaatagaacctccttccctgaccagaaacctccacttccctgcaggacccccatcctgacctgggccctctctcctcacctgtgggccccatcctatcttggatcccctcctgacctgggggccccttcctctgatccgagcctccctcctccccattctgggcccctaattctgactcaccatccccaattccttacccaggacccccgttcttatccggggttggccctgacctctctctacccacagaacacgaccctggacctcctagaccgggggctgcaggtccatgtggtggtggacgcctgctcctcacgcaggtgagagggcccctgcctgggtgggtgcacgtgggggccatcaggggctcccaggaagggccacaggcggcattcccaccagggtgcctgcgtgtctgggtgtccagactgcggcgtccacaccaaccttccctccctccctcccactcacagccaggtggaccggctggtggctctggcccgcatgagacagagtggtgccttcctctccaccagcgaagggctcattctgcagcttgtgggcgatgccgtccacccccagttcaaggaggtaatgcccgcctggccgcccccacctcccctgcatctgtcaaaggtcttgtctttgggctctgagaatacatctcggcaccagcaggctgccgcctccagggggagccaggttcttggaggggaggctgctggtcactgtcactgccataaatccatgaaaggagcccacagatggaccataagggccacagagaacaataaaatgggggaggcaatccagagggtcagggcacagaggagggggtttgtattggagggtctggggggcatcctggagcaggtgactttagaatgaactgaaggagggagtgaccaggcggacactggggaagaacaggtcagcagagaccctctagatagaagccccttgacccgtccacacccatctccaactctccatctcctccgcctctgccccttccggcccgggtgcccctcctccagtttctcagactccactggccaccctgctaccggggtcagccaggtactgggcccccctgcttcaagccattggccctcaggatgctggagaggccccagaccttgacattcccaggccctcccaggtctgctccttaccttccttctagttcagctctgtgggacattcaccgagcacccactctgtgccagccactgtggtgagccctggagtctgcagcaatccatgttcagtgacacattgtgacccccagctggggcaggagttgcagagggatgagcaagagtggcagaggtggccctgaattctgagctgccggggaagggggcatcaggcactcacagtgttcccaggggagggggactgagctttctttgaggagctgtagcaggccagggtgagcaccacgcgggaggagccagcagcctgtcttcacgcaggagtcagagcccagaggtttgagatttcagccacgggcagccatcagggtttgatgcaggggagctggccatatcagatcggcagtttacaaagttctttctggccctgtgtgaccagtggattagggagtgtggcatagaggggaggagggagacctgtcagtaaggaggttaatttgggcgcccaggcaagcggtgatgaggcaggggggatgcaggcttttttgttgttgttgttgtttatttatttatttatttattttattttctggagataaacttgctgggacttgctgatggatgaaatgcggttggttgctcatgtctatctaagaggcagttagatagatgagtcgagttcaggggcaaagtccaggctggatttgtgagctgagggcccagaagagggatgggagaaatgaggttacttaagaagaggaaggtgtagacaggaagccccagcacagagctgtccacccttagtggtccaagcccgcaaagcacaccaagatggcaggcagtgaggagctcaaccagtcacgtgtaatgaaagggaggccccaggaaaagtcttgagaagagggagtgttgtcttgggcagctgctagccagaaggtccgagagatgaagacggagaggtgtccctcagatttgtcatccatggagatcgggaccctagacgcttcctgacccatcgccccctgcccttacagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgcccccttgtggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggc

SEQ ID NO: 38461 - DNA, 2952 bp, Homo sapiens
ggcgtgctttgcggccgccctgccgcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgatggccctagggacgttggactttggtccagacctttcctttcttagcctcactttccgcattgggaaaaaaaaaaagcccgaatgataatgattcttataggagttcttgattaagataggccaagcggtaccctgcgtttttgtttgcggcaactcattcgttgctcattaagcacttttcacggacaggaatacagtaagtttcaatcaaagtgaaataattgtgaatttttactgacgtattcacggatgaagtgataggatgcccggggatgtttcaaaataaaccagttggacggaagtgtggtggaaagagaaatcaaacaagattggccatgagttgatgggattgaagttgatggatgtactattttgtctactttggtatatgcttgtaatttggcataacaagttttctaaaacaaaaagtttgctgtggacacctgactatgcctgtgttagcttgctagagctgccatgccgaagtaccggagactgggtggcccaaccagcagaaatttgtcctctgggagttatggaggctggaagttcaagaccagggtgttaacagggttggtgtcttctgagacctcccttcttggcttgtaggtggtagccttttccctggatcctcacatgatcttcctgctgtgcctgtttgcatcctaatctcttcttataagtacaccagtcaaattggattaggatccatactgatggcctcattttatcttaattatctccttaaagaccctgtctccaaatacagccacagtctgaggtactgggggttaggacttaaatatatgaactggggaggaggaggagacacagtgcagcccataacactgtcacttcactagcttaggattttggccatttaagttttcacagctttgaaatagggttagctgtagtaattaggtcatggggttgtgagggttcaatcggtaagagtgctcagaactgagtctagcatatagtaagcactcaataaattgaacacgtttttccttataaattagtaatcatagggctttaccatgggatgagtggaatgaggcagttggagtgccgtgcccagcgatgggaataaaagtcattacagccattattataaggaatatctgctgctgtgccagacactaaatgttttatgtatgtttattcatgtgctcatcaccgccaccctagaggtgggccattacgacacacctgtttggcacatggggaaattgacgcacagagacggagctgggatttgaacacaggcactctggctctagagcccacactcttcaccactatgctgtgttactttggtttaaaaaggtggtgtggaccctggaggatgttcagtctgcaggctgacccagggaaactggctgacttctctttttcttggcccagattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagacggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcacggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctcctt

SEQ ID NO: 38462 - DNA, 10283 bp, Homo sapiens
cggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggtaccggcgccgccgagacgccccccgaggcccggggcgctgcccaccgcaccccacccggccgcggggcccagggcggaaaaggggggcggcaggaagcccgggggctgctccctccgcgtcccggcggcccgagtttccgaagcccctccgcgtcctcccctggcgggagcggggccggggcgggcgggaatggccgatgagcctccggagcccgctccccacatctgcctgcggctggggagagtcaggccgaagggccgggccgggctccctgcggtcctcggaccggactgagcgcgcgcgctgttctctccgcccgcgctaggctggtttcctcggtgcacgccgtgctggccaccggctcggggatcgtcatcattcgctcctgcgacgacgtgatcaccggcaggtaagagcccgggccggggccttgttgcaaatgtcacatttcagtagctcgcaggctctggctctcgcagcacacgcgctcagaaagctgactaatgggaaaagctggcaccacaatgggctccttcttcctctccggagtcttcgggcacccccagcttaggagaaagtccacggaaatgagggaggacgacagagtcggagtctgatttcaggtggtgtgagccagggatccaggtccttcatggaagagataagcgtggaagcatttacgactgggagtgtggcttgattcttgcagttggcttcactgggttctcactctggagcatcactggctaacagacgtccagtgtggttagcagagccccctccatggaaaggaaccaacccaccacccccttccacgcaaacgccgctcttgcttttcctgcagatttgctaaaggtgattgagaggttcccagcgcttagaacacggacttgtacgtctatcagaggtcagtccagaggcaggtcaggaaatgtgcacctatctgcagttccagtgaaacaaatcataaattaagaccagaatagtcgactttgtacagtagttagacctggacaatggtggtgcttttattatttcaagccttttttttccccaccggtcttgctggaatcacactcactttctcccaagttgaaggaccacagtcggatgtgcaggaagttgaacggcctttccaggccctgctctcctgtgggctctgccaagtcctgcttctcacctgctgagactgaactgcgaggggcctgagcaagctgtccgtctcactctagcctgcggtcttacctgggatcaatcctgctgtcatgatttttgtgcttttcttctgcctttttaaaaacaaaactggctattggcgatgaataagtagatgctacgatagatcaagtgacatcgattgtagacaccaaaggttaatattggtgtggctgggtacaatttttcttcttcttcttcttcttttttttttaaagacagggtctcactatgttgcccaggctggtcttgaactcctgggctcaagtcatttttctgcctcaccctcacaaagtgctgggattacaggcatgagccaccacacccagcaaattttttactttttttttttcctgtcgagacctcaggctgaggtgcagtggcataatgacagctgactgtagtcttgaactccagggttcaagccacccgtcttccttagcctcccaagcttggactacaggcacacactactacacctggctaacttttttttgttgttgttggtagagacaggggtctccctgcgttgcccaggctggtcttgaactcctgggctccaacgatcctcctgcctgggcctcccaaagtgttgggattataggcgtgagccactgcacccagccaaaaaaggcctttcagggttcatatactatatactgaatatttttctattatatgccttctcattttatgccttcacatagaatgcgattagatagaaggagttaaaaatccccccaaattataggcagaaggtggtatggggccaaggatttagtcagattcttaaaggattcagacactaaaatgacaaagtcacagctccaggtggttttctcaatttaagtacttaattcagatagtacgttgttgttttagacagggtctggctctgtcacccacgctggtctgaactcctgggctcaagccattctcccactcaggcctcccaaagtgcagggatcataggtgtgagccaccgtgcccagcctgtatagtaccttttaacatttaaaaggactccccctccccgccgcctttctttttattgagatggagtctcactctgtcactcagactggagtgcagtggtgaggtctcggctcactgcaacctccacctcccaggttcaagtgattctcctgcctcagcctcctgagtagctgaggttacaggcatgtgtcaccacgtctggctaatttttgtatatttagtaaagccatgttggccaggctggtcttgaactcctgacctcaggtgatccatccgcctcggcctcccaaaatgctgggattacaggcatgagccaccgtgcccggccgactttcccacatttaattatttaatcttcactgcagttttgacaggtaagacagacaaggattatcatcttcattttacaaagaaagttaaatcacaggctagtgatagtgaagattataatccagatctcttgctaataaatcttcagaggattctactcatgagtcacaatttcagatctcttctctgaattggtgaaaacatgaaaaccctaggttcccttcaaggggagaggccagttatatttcagctaaattttagtagctgtttataggtattttacttgaaattgcttgaagaaagcacctgagaccatagatgggcattggaataagtatggcatctttttggccaaaagaaacctagctaggtcgggtgcggtggctcctgcctgtaatcccaacactttgggaggccgaggtgggcggatcacttgaggtcaggagcttgagaccagtctggccaacatggtgaaacccccatcgctacttaaaaagaaaaaaaaaaagaaaatagccggacgtggcggcaggtacctgtaatcccagctactcgggaggctgcggcaggagaatcgtttgaacccacgagtcagaggttgcagtgagctgagatcgcgccactacatccagcctgggcgacagagcaagattttgtctcaaaaaccaaaaccaaaaaaaaaaaaaaaaaaaaggaacctggctaatgaattcacctacaagtgtgttatacttgccattacttgcttgccttatttgtttattcattatttacgccgtggtaagtgtggagttgctcaagagcacaaattcagatggcgcctccgtagactgtatttccagtgttgcagttcagcggactggctgcgtccgaaatcagagacaaagttaatacagatttcagggccctcggcttacaatttagaatctctggggactggagcgcttaacaagcactgcaggtgattctgatgttcaggtagtttgagaaccataaaacgaaatggttttctacctaatacgtggatgcgcatcaaacgtttgctgaccatgtgaatggaatcctcaaatagtacatgatttcaatttagatgtttcttcacagaaaacatctgtggaatgcttatcactgggaaccacattgtatgaattgtagaggcttcccttctaatctgctctaggacggtgatcaactatgatttccattcagcaaatactgattcagcccctttggataagtaaatgggaaaactgtcttttgacctagcctctctcctggtacctaaccgctgtaatgtggcccttgagctccaggctcatttccagacctgcttttttttgttgtgttttgtgtgttttttgagacggagtctcactcttttgcccaggctggagtgcagtggcgcgatctcggctcactgcaacctctgcctcccagattcaatcgattctcctgcctcagcctcccaagtagctgggagtacaggtgcacaccaccatgcccagctaatttttgtatttttagtagaaacggggtttcacaatgttgataaggcgagtatcgaactgctgaccttgtgattcacctgccttggcctcccaaagtgctgggattacaggtgtgagccaccacgcccagcctccagacctgtttttcttaatggaattgagattatctctagaattgctttttgggtttttttgtttttgttttttttagatggaatctcactctgtcgcccaggctggagtgcagtggcgcaatatcggctcactgcaacctccgcctcccgggttcaagtgattctcctgcctcagcctcccaagtagctgggactacaggtgtgcgccaccacatctgactaatttttgtatttttagtagagacggggtttcgccatgttggccaggctgatcttgaactcctgacctcaagtgatccacccgcctcagcctcccaaagtgctgagattacaggtgtgagccaccgaacccggccagctctagaattgtaaagaaaatggccagggttgcctcccagaaactccatagagtggggttgcatgcagacaagagaaaactcacaggttccaggatttaagttagtaaaacccccaactgttgagcagctaaggagttaaactagaaatgttggatttgtgatttgggacactttccaaaccagcttcttggtggggccgttgaatcatttgtatatctatctatatcaaaatcagttttatcacaaaatgccagaacatctactacaaattagtagctaagtcaggcaagtagtgacagcaagctgcttcaacaggcagggctgagtgaatgcctgctttttgcctttgacactcacgaattggccctgaaactgagagcaagtggtctactctccctgtttatcagtttcaacatctttattgtaaagtatttggaataataatagctgatcaagcaccaagcttggctgtgagccttcataatggatatccacaatgatttcacgggccattcatatgctttctttcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacaggtatggccttccaggacagcagaccagcagctgggttgagctgggtgtctttttttttttttttttctgagacagtctcactctgccgccccagctggagtgcagtggtgtgatctcagctcactgcaacctccgcctcccgggttcaagcgattctcctgcctcagcctcctgagtagctgggattgcaggtgcccaccaccacgcccggctaatgtttgtatttttagtagagatggggttttgccatgttggccaggctgatttcaaactcctgaactcaagtgatccgcccgcctcggcctcccaaagttctgggattacaggcatgagccactgcgcccggcctgagctggatgtcttgaccgttacttaggagtcgggattgcccctcttttctttgccactcataggcacccattctccttgtgcctgctgcttcagagccacctcccccaggtgaatagtggaggaacaccattacacatgaaacgttcatgatcctccttaccaacatcaacatcaacatactttttcttttttgagacagggtttcactctgtcaccccgggtggagtgcagttgttggatcacagctcactgtagcctcaaactactggcctcaagtgatcctcctgcctctgcttcccaggaagctgggaacacaggcacacactacaacgtccagctaattcctgtaatttttgtagagtttctccatgttgcccaggctggtctcaaactcttggactcaagtgatcctcctgcctaggcctcccaaagtgctgggattacaggcgcgagccactgcacccggccccaacattctttttaacaaacccccagcgctctgtgattccctagcgtttgtcagaggttctatccttagttcaatacaagataaaaacaatataaaatacaaatataatacaaagcaacataacagtgccagagagcactgtgtggattattcttaggtcacaaaacacagattctcaaagcaaatagcctcctactttctccccagatccatttccccataaaagcccacccaacaaagaaaagcaatgggaaagctgaggggaaattcctcactcttgagtgcctggccaggggaaggcatgcgtttttttttttaattattcatttatttagttattcatttttttgagatggcgttttgctcttgttgcccaggctggagtgcaatggctcactgcaacctctgcctcccgggttcaagtgattctcctgcctcagccttccaagcagctgggtttacagatgcacgccaccatgcctggctaatttttatatttttattagagacggggtttcaccatattggtcaggctgatttcaaactcctgacctcaggtgatccacctgcctcagcctcccaaagtgctgggattacaggcgtgagccactgctcttggccggcatgtagttttattttattttttaaataaagagatgggggtctccttatgaggcccaggctgatcttgaactcctgggctcaagggatcctcccgtctcagcctcccaaagtgctgggattataggcgtgagccaccgcgccctgccaggcatgtgatttaaaagttcatagcttgctaaatattagaagctattagtcttatgctgtagatgaagaaactggggctctaagagtattcttatatctctcagtggtactaagtggcagagctgatattttaccatgcttactgctttcttgaaaaaagaggccgggcgaggtggctcatgcctgtaatcccagtcagaagttcgagaccagcctggccaacatggtgaaaccccatctctactaaaaatacaaaaattagccgggtgtgatgctgtacatctgtagttccaggtactcaggagcctgaggcaggagagtcatttgaacccgggaggcagaggttgcagtgagctgagatcacgccattgctctccagcctgggcaacaagaacaaaactccgtctcaaaaaataaaaataaaataaataaataagggtaacgtgcattaaattctttaagaagtgtctgggacctaccatctaggaaccagaacatctagggtgctttgagaccctaacatctagcacagggcctggcacattttgttgaaccaaacaggctgagtgtcttggcatgactaagttcgatacacaaaagtaggcttgcagccttccttccggctgtcatcaaaattcagagcttggtgtgggacgccgtcatcctgtctgaatttgcctctggatcctagggcttggaccatcaaagtgctgttgccacggaagcagcggtacagtagtctgcgcttgcctattgagcgtcctttgcccgtcacagttacccttttcagtagccctcgttggaattttccttctggtggtttcttaacctccacttacttccccttttcgtttcgtcatccgcagaggctccggggagaccttggggacttctttgtcggctgcatcttcacggcagaactgagcactccgtttgtgtcgctgggcagggttctgattcaggcatgtatgaatgaaatgacagagagtgtgagggttctgattcaggcatgtatgaatgaaatgacagagagagtgagggttctgattcaggcatgtatgaatgaatggcagagagagtgaaggttctgattcaggcatgtatgaatgaatggcagagagagtgagggttctgattcaggcatgcatgaatgaaatggcagaaagagtgtgggagggagtggattctgcttttccttcggagatggtgggtgtggagaaatccctagtgccaggagagtgggatgagagatccttcaacagccttaaaggtcagctggtcatctcagccagtgggggtgaaattgtaggtttgatctaagtttgatagtttgatacagctcattctattttttccctggttacacacatactttaatccacggttcctgtactcctgtcagctgggtggcctgggtcaaattcaaaatcactattggagaaaatgaggttatttgcacatctcaatatgatagtgttcaagaatgtcttctccaagtgttagaaaactagacaaacgtctgggcgccagggaatctgacagccaaggtcttgatgagcacctgcacctgtgtggcatttactgtggtgggacttgggcccgtcgctccctgatgcccagcttcttggtgaccttacctttttccttcctcttctattgcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttg

SEQ ID NO: 38463 - DNA, 11682 bp, Homo sapiens
gttgccgctgcgcacctggctcaggtgagctgccccgcccccgcccggcgcgagccccaggtcctggcagcaggtgagtggcggtcgccatcagacccgcgaaggtgagtggaggtcgcagtcctcccagagccgctgcaggcctggagtcggggcccggggcgctgcttgtccctgggcgcggtctctcaggaaatggctcggggccggggaggttcccgcgtcgcccggaagcccgagctcgcccgcgtcctggccctttccagggctgggggaagggaggaaagtgggcgaagggggcgggggccaccctttcctctgcccgacgtggtcagcggctttttggtgaccctcgcgcagaacagagcggggctaggagcgccgaggcgcgcagggatcccacctcggtcgcccaagcctggatcccagctcgaggcttcctgaggcgccgagggcggaccaagagtcaggctggggcccgagctcgcccggcgccgggtggagcttccgccatccgcgcgcctctgccccggccgagcgccccgagccgcacccccgtgcccgcctcccgcgcgcgtcctcgttctccgccctcctcacttggagggcgcccagggcgcaggtgggcgcggggtaggggagcgaaccagagcccctcggcctgcggggccgcagccttttacccacgttcctgcttcaggacaggcgctgggggcccagcgcgcacggggagcggaggggcggcgcgtccgagctgagcgggagtcgcccgcagggtgctgggtgctgagcgtcgaacccaccgggcaggggcggccgcggaccgaggacgctggctgggtctgagggcgggaggagctggcgctttctaagaacctcaaggtgcccagcagagtgcggtgggcagtgcgaggcgaccagggccaggcttggactgagattctgggcgcctcggaagagctgtgcgggcgagggtcggagactttgtgggtgttcatgctcaccctggacggtggacctgggggctcgggggtgcaggacgttagcagagagagggaaggagagggtgccaagccagccctgagagatggtgacgctgagaccgggtgcacagagcagccgccgagccggggcttcacagttggcggctgaccccagggcctgtgctggaggccctgctcctgcttcctgcgggggtgccctgggccctgctgtgcctgcttcctgacctgcagtgtggggagaaccttcttgaggggcttccaaggacccacttcaaggaggggctggtaccaggctctgtgggggaaggggtgctgtctttgggaccctgagcccaaggcccaccatcacccaaggctgagtaccgggacaaaggaaggtcctagcagggctgggactcagtcagacaagtacctgtagaaagcctgctgctgagagggtgctcagccagggccgggaggctggatggcagccctccacaatgaagccctgcccccatgtggctgagggcagggccagggtccaaaggagacccttgtctgattctgtgggcaataccagccaccggtcactgggtccccagtcccaggtcaacctggggagtgtcagtttggtgacaacaggagatgccatctgcccctcatctgctctgagccaggagcctcggccacctgtgtttgctccttatttggaaaagggggcgctgccctcccaccccagcctgaagggaaggtccacaagatgccatagtcccttgtaactgctcacccatcgggggagctatgtctgggagagggacggggagagggcggaagagttctgctggagccccattgttgaccgggagtttctgaaggccctgttccccggggtcagaggtcaaagacacatgggggagcaaaccggccccttggctcctgagtgtgagctctagtagcgtctggaaggcatgccgcgcggtccccggtcctccttgtatgtgtgcagggtggccctggcgggggtctcctggctggaggaccccccatgcattacccctggaacctgcccctttgagcaccccccaccccacaacacacacgcacacacacaaacgcacgcacacgcacatactgcacacacattgcacacacgcagacacactgcacacacacacacacacacacacacacacacacacacacacacgctgcacagaggaaagtgccgtgcctgggtgggttggggcgggctccagaggaaggagccgcttgactcagagctacaggaagagccggggcaggcggggtgagaaccaccaactgcccgtcctcccgcccgcctagggaaggggtgggtgcctgggtggggtttagggttaggagaggatgtgactgcaaggccaggaagctacagggaaagttctgatcaaaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccaggtgactgccttccccgctgctctgagtgagcctgtgtcagggcctggctgagaggaggcccacggcgcccaagacccatatgcatgtgtgtgcatgtgtgtgtgagacagagcgaggggcagcaggaggctgtgtcgcatcagcggccaagggtgggtgtcaggtgcagtgtgtgtgctgtggggtgcctgtggtcctaggctctgtgacaagcgttgcaatgggtgttgtatatactcaacagttgtgtgaggggtctgcagcctaagctgtgtgcagtggtaatgggaggtgtgtgtggtaggaagtgtgctgtgtaggaggtgcaagtgtgcacacgggctgagactgaagctctgtgcaggtgcacatgggccagagggctgtgtgtatgtgatgtgtgcaggggaggaggggcagaggagagggtgcaggggaagttagggaggggagggggtacaaggaaaggtgtgcaggggagagggtgcagggaaaggtggggaggggagagggtgcaggggaaggtaggcagaggagagggtgcaggggagagggtgcaggggaaggtgtgcagggaaaggtggggaggggagagggtgcaggggaaggtaggcagaggagagggtgcaggggaaggtgtgcaggggagagggtgcagggaaaggtggggaggggagagggtgcaggggaaggtaggcagaggagagggtgcaggggaaggtgtgcagggaaaggtggggagggagagggtgcaggggaaggtaggcagaggagagagtgcaggggaaggtgtgcaggggagagggtgcagggaaaggtggggaggggagagggtgcaggggaaggtaggcagacgagagtacagggaaaggtagggaggagagaaggtgcaggaggaggcaggcagaagagagggtgcaggggaaggtggggaggggagagggtgcagggggaggcaggcagaggagagggttcaggggagagggtgcaggggaaggtgggcaggggaaggtggggagtggagagcgtgcagggggaggcaggcagaggagagggtgcaggggaaggtgcgtaggggagagggagcaggggagagggtgcgggaagagggtgcaggggagggtttgcagggagagggtgcaggggagagggtgcaaggagaggcaggcagcggagagggtgcagaggagggtttgcaggggagggcacctgctttcttgctgtgctcgtatcctggcagtctgcccttgacttccagaaggctctgaggctgcttttggagggaggactttgaggtctgagcttggggcggtcacggaagcactgcaggagatgccaggggttctgctgggctggcggtgtgacctcccgggcttgctgtgaggggttggtttcctgggaagtgtgtgctttaaggaccctcagtgggtggttcccctgggtcaaggactttccttggagtgtcctccaccgcaaaggacttcttcaaggaccccctggccatcccccatgggtgtgtgcctcatgctgtatcggttcccgaggaaactgccaaacagtcaaacctggggcctctggctgtgcttcacccatggagagggaataggtggcaggctaagaggactgtccctgccactgcctctggggccttagcggggaggaatcctgagggagctggggtgcagaaacttaggcttgatccccacatccccacttccactgtgtccctgcagcagggaggggagtagacagtcagtgcctgttggataaacagggtgaccctgtggcatccagtgaggagaggcccctggggccctgggctgccaaggaagaggctctgggcttctccctgcagccacctcactgaggagctttgggagacttgaggtgtgtgtggctgctgctacgggctgggaaaggacatgggacccgagacctccatccccaccgggcgctgttcaccctccggcctcacaaccgcagggcgaggctaagctgagggttcccgaggtgtttcccgaggtgtttcgaggtgtctgtgctcacgtgcactcctgactgtaaccagacgtgggccagagctgggcaccccccctcgactgcatccagacatggttagagctgggcaccccccccccccgactgtatccagacatggtcagagctgagcacccctccccgactgtatccagacatgttcagagctgggcacccccccccgactgtatccagacatgttcagagctgggcacccccccccgactgtatccagacatggtcagagctgggcacccccccccgactgtatccagacatggtcagagctgggcaccccccgactgcatccagacatggtcagagctgagcacccccccccgcccgactgtatccagacatggtcagagctgggcaccccccgactgcatccagacatggtcagagctgggcacccccctccccgactgcattcagacatggtcagagctgggcacccccgccgactgcatccagacatggtcagagttgggcaccccccccccgactgtatccagacatggtcagagctgggcaccccccgactgcatccagacatggtcagagctgggcacccctccccgactgtatccagacatggtcagagctgggcacccccccccgactgtatccagacatggtcagagctgggcacctccccccgactgtatccagacatggtcagagctgggcacctcccccgactgcatccagacatggtcagagctgggcaccccccccgactgcatccagacatggtcagagctgggcaccccccccccccactgtatccagacatggtcagagctgggcacccccctccccgactgcatccagacatggtcagagctgagcaccccccccccccgactgtatccagacatggtcagagctgggcacccccctccccgactgtatccagacatggtcagagctgagccccccccccgcccgactgtatccagacatggtcagagctgggcaccccccgactgcatccagacatggtcagagctgagcacccctccccgactgcatccagacatggtcagagctgggcaccccccccccccaccgactgtatccagacatggtcagagctgggcaacccccaccgactgtatccagacatggtcagagctgggcaccccccgactgcatccagacatggtcagagctgggcaccccccgccgactgtatccagacatggtcagagctgggcacccccctccccgactgcatccagacatggtcagagctgggcacccccctccccgactgcatccagacatggtcagagctgggcacccctccccgactgtatccagacatggtcagagctgggcacccccctccccgactgtatccagacatggtcagagctgggcacccccgccgactgtatccagacatggtcagagctgggcaccccccgactgcatccagacatggtcagagctgggcacccctccccgactgtatccagacatggtcagagctgggcaccccccccccccgactgtatccagacatggtcagagctgagcacccctccccgactgtatccagacatgttcagagctgggcacccccccccccgactgtatccagacatggtcagagctgggcacccccctccccgactgcatccagacatggtcagagctgagcaccccccccgcccgactgcatccagacatggtcagagctgggcaccccccgactgcatccagacatggtcagagctgggcacccccctccccgactgcattcagacatggtcagagctgggcacccccctccccgactgcatccagacatggtcagagctgggcacccccgccgactgtatccagacatggtcagagctgggcacccccctccccgactgtatccagacatggtcagagctgggcacccccgccgactgtatccagacatggtcagagctgggcacccccctccccgactgcatccagacatgttcagagctgggcacccccccccgactgtatccagacatggtcagagctgggcaccccccgactgcatccagacatggtcagagctgggcaaccccctccctgactgcatccagacatggtcagagctgggcaccccccccggctgtatccagacatggtcagagctgggcaccccccccccccgactgcatccagacatggtcagagctaagcaaagccccccgccgactgtatccagacatggtcagagctgggcacccccaccccaactgcatccagacatggtcagagctgagcaccccccaccgactgtatccagacatggtcagagctgggcatctcccatggtgtaggttacatcactcacacccctgccccaaggccaggctgtgtctctggcactgcagcaccccctgcagtggcagctctgttgaaggggacagccaggagtgaggccaactgccatgtcgggagacagggtcccacctagtgttcgtccactgcaccctggggccgtcatggtggccccagggccggtggaggtgatcctggacttgatggcccctccccgtggtcctgggctgcgtgaagtggtgcccattctggccacgtgtgaggggctcaaagagacaccctgctggcctccgagaactctgccagcatccatgcggctgctcagggtcgcatctggtcagggccagtgctgtctgtggccggcagttactggttaactcatcctgttcctgtttaacttgttccctggggatggcggcagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtaggcaggtcagagagggatgggcttgaattccccactcccacctcctgcccctcaggctggctccacattgtgcatcctgctcttatcccaggcactctgcctggccacatgccgggggtacaaaggcccctgctcacccctcccactgggcccttggccctgaaaccagggcgagtggtgaggatgagccctgcaccctctcctgccccagaccaggctcatgagggtcagtaaagcccaggaatgctaggagtgggcactgctggggcccacagcagggtgtggccgatgtgagctggcaggagaccataccctactgagaagatggtggtttgacctcccgctagggctcatcaccctgatgtaaagatgaacaagttcaggcctcaggtggtggggagggcttgcctgtggccaggagcagagggccccaagacccccaaggcaggaatgaggccaactgctccaggctcccagctgtgcccatccaggtggaaggtgctggcacactgggcatctgggtccccaaacccactggtgcccacactctctgcagattccccagcagaggcaggccaggctgaggggtgcagtgcccggcccctcctatgagacaggcatcatggtgtcaccaggggtgggcaacaggtgcatctgggaaatggggggctggactcacatcctgggtggacaagcagccagatggggcttgagcgtgggcctggggcagctcaactgtggccactgctctctgtcccctcagcacagggtgggcggaacacccaaagcctggccactactggggaaagacgtgccaagtgctaagcctgtccccatgggactcgtggacagacatggtgtgactgccaagccacacagaggccttatttcttcctgcaccacggaccactgtggaggtggtggggccaggcaccctggcacagctgacccactgtgtcctctctcttcaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctggtaagagacccgggtatccagggtcagagtgacctctcagacatgccaagggcagtggtctccctgacctatgcctgggtctgtaaccacctggccagacatgtcacgagcagagtgcctctgtggacccagacggagggtcagtaatgtcagggacagacccttgggtctgcatggcccctgtaggcacacacctcgtaactgcccagggctacgggtgtcagcaaagtctagggtctgaatgaacaccgaccagctggccaagtctgtgatcaaaggacctccaggccccagacccaggactgggacggctgttctgaaacaaatctgcatcccctccaggttcaggtcacttctcttggcttaaggcccaagaaccacccaggaggcccaattctgcagcctccctgggtgaacccagacaggtggggttcgggggtgtccactggtatccccagtcgaccctgaccctggcttggtatccccagggtcaaggccaacctgtcagaggtgcttgtgtccagtgtcctgggggtcaacgtgaccagcactgaagtctatggggccttcacctgctccatccagaacatcagcttctcctccttcactcttcagagagctggtgatgggggttccccaaggtggagggtagaaggggacctagacctagtgaggcccagggatcttgaggcttgggggctgctggaggggcagcggctcaggcaacccatccgcaggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacggtgcgtggggcccgcgtgggcgcgaggaggggtcgccacggcctccctgagagtgcgctgctgagctcggctttggaggcgtgcggcggggaggggttagcccccgggtgctctgtgcggcccggctggggttaaagtccggggcgggtctgcccctgtgcacgtgggagatggttaggggtgttggggaccccgagggctggtgtgaggcctcgggagccatcggggtgactggccgccgtccgcagacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctggtatcccgggccccaccccgtgccccgcccacccggagggcccgccccgccccgccccatgctccgtcccacccggggccccacccccaccatcgagctccgcccccatccccgcccacccgaggccccgcctcaaaaacccgcccaccccgcaggccccgcccctcccttagagctctgcgtccggcaccgcccctgagcctccggccccgccctcccccgcccccgcccctgcgccgccgacgcccgccctcccgcagagccctccgccgacctcttggtgaacctgagccgctgccgacgcctcatcgtggtgctttcggacgccttcctgagccgggcctggtgcagccacagcttccggtgggtcccgcgcggggttgggtgggccccagcgtagcacccacccccctgacggtcccgccccgcagggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtggtgcggagcaggcgcgggagggtccggggctagcggcgggttagagatgggcggtgcccgggctccaggctgggacccctccgtggggagctctgcggcaccacgctttgtgaatgggccctggggggaggttccgctgcctggggccccgatgcggggagccgcccttgaggcccccggagccacggaatagctgtcgcagggcgtggaacccgtgggcagccgcaggtgtgctcttgggggccaggacgccaggggcttccgaggtgttcacacctgcaaaccgccccgacctggcccccagactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtatgcccgcccagccccactccccaactggagaagctcagcacagggcggagtgggggcaggcacagggcacagggcctggaggggctccaggtgttgaggactcttcccggcaccgggagcccctgcacggcctctgccctggaggtgctcggccctcggtctgcctgggaacttcctgggcctcacaggccatcacagcagggggtgagcaggggcagcccctggcagtgggtctgggccaaggctgtgggtggccacctcaggcgtctcggtctccccaccccaggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctg

SEQ ID NO: 38464 - DNA, 53046 bp, Homo sapiens
agcagagtccggctgcctggggcgggcggcgcgtgtctgcagctgctccgggtagcccgctaggcgcgccgtccccagccccgccgccggccctcggtgcgcccggccgcctgcacccccaggtaagcgagcaccccgcgccgcgaacaccgccccgaacgccaccctcacggcggtccccggccccgcctccgcggccatggcggccccagcccggcccccactcgcagctgggctccagcccccatcaccccgccggggactgtccccctcggggcttcccatcatggccgtctccccgagctatccgcgctcccccacgagggccggggcgcaacgggtgcccgaggacgcggctgtgaaacgggctggagcgagtaggggcgatcctggcctcgtgacgcgggggaatccggatgtgtgagccgggggagcgccccgtttccccgacgtgccagggctggggacgcagctggggccctggcctcggagtccgcagcccggccgcgtagacggcttctgagaaccgcttaaacacgtcattccaagcccgagctaacccatcaggcggccggggtgaggtggaggtgcccaggcggggataatgtcatttggcctggttggaccagccagcgagggctttttaggcccagggcctagccgggagtgtgtgcggagcagaaaagaggccagcctggctgaaacgcggagagggagggtctgaggtggagagaggttggccggggcctgggaagcggcgaggagagtgtggaacccgttctcggggcggtggggaccagggaggcttggaacagcaggtgcatggcgtgatcggattgtgtcttaagaacatcccgtagccgctgtgggtaggagagatggggatacttggaagggggcttctggcttgacctggctggaaggtgtgataggaagtgggtgaactgaaaattcgctttggcagagtaacatcgtctaattctgtctgtttgcaagtggagcgtgggggaccgatgtttctcctgggtagttaggagtatatagaagaggctttcattgctgggttgggagacttgaggagaagctgctctgggggacacaggaaggtgggcagggggagaggctgttgtggtttgcaaaacctaccagatgggggaatgctcccatcgactccagtctgagctcaggcaaggtctcaggcatctgagcgcagaggccagggtgaccccactggggcgacctgggtctgttatatggggatagggttcctggactgtggaattgtctttgaagccctcggcctcccccagcctcaaatgggtctgccttccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagaggtactttgagcctggggtgtggggggtggggggcggccttggtcgttgaactggctgtagggcccccagggaaaggtttctgagcttcagtttacccatctgtaaaatgggtcagtagtatctgagcctgggagtgttcatggatcgatgaaagccgaggctaggcagatctcggtggcagccacacccctaaggaaccggagagggttctaacgcccggtgggagttcagggggatgtatgggcttccatttctcctctgagaaattcacaacagtgtccacctcctgacccagggctgtctgcaggttgaataaagcggttgacccagtgcgtggcacagaatgtcttggctcaggagccactgggatgcctgtagttggcagcagaagtgggcccaggttccctcctcccacccgtgggatggcacagaaaggcaggtgccttgggagctcgctgccctgtccccttctctgagcaccacaagcttctccctttccgactggctgggcttgagcctgaccaccccccagccctgtcctgccactttgagttgagggcctccgggctactgacttcaccacttcctgcttcagtttctccacctgtaaaatgggataatagcagtcatgacctataggtaaagagctgaacacagtgcctggctggttgtgaatacgtgctaaacaggctattaaaatatcacgagaatatcacagagctggaggctattaaaatatcacggaggggctgggcgtggtggctcacgcctgtaatcccagcactttgggaagctgaggcaggcagatcacctaaggtcaggagttcgagagcagcctggccaacatggtgaaaccccatctctactagaaatacaaaaattagccgggcgtggtggcatgtacctgtaatctcagctgcatgggagactgaggcaggagaatctcttgaacctgggaggcagaatttgcagtgagccgagatcgcgccactgcactccagcctgggcaacaaagtgagactatctccaaaaaaaaaaaaaaaaaaaaaaattcagagtcatgcctggggtcagggggagtccagaggagtcacctgactcagcctaaggaggagtcagggaaggcctcctggaggaggtgacagttggctgggtcgctaagggtaaggaggagttaaccaggccaagagaccagtgggcaaattgcagaggagagaaactgccagggtgcttggatgaaacaaccacaaagccagggttgtaagatccagaagaggggagaggaagaagggcagagccagcctgccagccttgaacaagcatttggcattatttagagctcagggaacagactgcaggggtcgaaggcaggagcctggagaccaggatggaagggactgcaccaggccaggggagtaatggtggggctggaccaggtgaaggcgtggacgggtgagacttgggtggatcttggagagatatggagaggccgggggagggagcagctgctcatgggggagaagctttaggtgtaagtcagcaatctgttctcagcatctggaaattgccatgctgctagacacccaggtggtacggcgtaggatgggctttaaagcaagctgggagcttgggagacagcagaaagagggcagaaggaaaaccaggagtgggtggcaagctgggagccaagggagctggggctgtcataggaggaaagggtcttgaaacccctgtttgataattcagtagcaggcatcttactgtttttttaattattattttttttattttttggaatggagtttcgttcttgtcgcccaggctggagtgcaatggtgcgatctcggcccactgcaacctccacctcccgggttcaagcaattctcctgcctcagcctcctgagtagctgggattacaggtgcgaaccaccacacctggctaatttttatattattagtagagatgaaggggggtgggtttcaccatgttggccaggctggtctcgaactcctgacctcaggtgatgcacctgcctcggcctcccaaagtgctgggattacaggtgtgagccactgcgcccagcccgtctcactttcttttgtggctgctctttaccaaccctgttctgttccccatgcctttcagtacaagctcttttctttgcttttctttcttgtttttgttttgttttttcaagacaagttctggctctgttgcccaggctggggtgcagtggtgcgatcttcgcccactgcaacctccacctcccaagtttaagcaatcagcctgggactacaggcataagccaccacacctggctaatttttgcatttttttgtagtgattttgtagagttttgccagttgcccaggctggtctgaaactattgagctcaaacgcctcagcctcctaaagtactgggattacaggcatgagccactgcactcggcctctttctttctttcaaaggcagaatcttgctctgtcgctcaggttggagtgcagtggcatgatcataactcactgcagcctcgacctcctgagctcaacctcagcctcctgagagctgggaccacaggcatgcaccaccaggcctagctaatccttaaaaaaaaattttatacacatggacaggggtcttactatgttgcccgggctggtcttgaactcctggcctcaagcgagcctccagcctcaacctcccaaagcactaggattataggcatgagccactgtgcctggccaagcgcaggcttttctttgccatccttgaataggcccctcagacccatcatggctctgaccagagtagcatagagaggcccggcgcggtggctcacgcctgtaatcccagcactttgagaggccgaggcgggcagatcacctgaggtcaggagttcgagaccagcctggccaatatagtgaaaccccgtctctactaaaaatataaaaattaaccctgtgtggtggcatgctcctgtaatcccagctacttgggaggttgagacaggagaattgcttgaacccaggaggcagaggttgcagtgagccaagatcgcactactgcactactgcactccagcctgggtgacagagcaagacactgtctcaaaaacaaacaaacaaaaaacagagtagcatagaagagaccttcccctccctgagtctggactttatacctttgttaataggatgctgtcacacacacacacactgaaccgcctggagctcagctcagctttccctccctaccccctcctggactcccagagacagattttaatccagggtcccatgacactgtgtctgaagagtgatcatttcctatcagctatgccctggggaccccttctgccctgtgcctggccccactttcctcccacccctgtctgtctgtctgtctgtcatttgttcattcagcacagacttaggaagtgtctgcagtgggaggcactggggacagacagccacaggaagccttacggagctgatgtccccgcagggagaaggtgatggggacaaggatgaggcttgaaggagcagctagacatctggaggaagagtgctccgggcagaaggcccagcaggtgcaaaggccctgaggctggaacaggcatggtgtgttggaggaatgcaatgaggctggggtggctggagcaaactaagcaaggagtcatagagtagagagaggagtagatgaagagactgaaggtccttgggaacccccagtccaaccacagcataccctggagagtccttgctcaaggggacttgaggagtgaaaggttatgggaccctactgcttttgcacggttactttgtcgtcctgtatgtgcagtggtcacctgtgctggggtgctcgaaccttgaaggctgaggaagctggcaggaggaaggagaggaggactacgcagtggccaagacttctcctcctcccctccacacaatggggctcagctgaactgggagagggaagtagccagggaagggtactgatgagcgtatggaagcagaggagatgaagggcagtggggaggaggtgggaggggaggaggaagaggaaagggaggaagacgagggggaggagagggaggagggggaggaggagaaaaaggaagaggagggggaggagagggaggaggaggaggagaaaaaggaagaggagggggaggacgaggaggaagaagcaacggcagcagccagtgggcaagcagccagagctggatggaggagccaggacgttctcagataggtgatgggggagccctagggatgcagggatggtagcctcgatcaggggcctagaggacaaacagcaaaagccaagcagcagggccaggcgcggtggctcacacctgtgatcccagcactttgggaggccgatgtgggtggatcgcctgaggtcaagagttcgagaccagcgtggccaacatggcgaaaccctgtctctactaaaaatacaaaaattagccaggtgcagcggtgtgtgcctgtagtcccagctactcaggaggctgaggcaggagaattgcttgaaccaggggggcggaggttgcagtgagcagagatcacaccactgcactccagcctgtgcaacagagcaagactctgtctcaaaaaaaaaaaaacaaaaaacaagcagcgggtgtgtctgggggatgggccagcctctagcctgcagtcgctcccttcccaggcaaaagagagagaactcggtcccctctccctgtaccccacaagagcctgggcaccctccccactcccaccacgaacctgggcttcactgggagggaatttagacacttggatgctggagcctagatctgaggttctgttgagccacggcactgtgacccggactgtcccctccatccccgtccaaactgggagggggcatcccttgtccctggcactcctctgtgatctggcaggtgtgatgagccacagcagggacaggggaataggggctgggctttttagggtgatggcacccagacggtaacaggacgggagggaggtggtcctctgggttttgtttctccatctgggatgttggtgagggcaggcataagccacctctctgtgcctcgagtccaggatgcctggccctgcctcagggcctttgcactggctcttccccctttctagaatgttctatcatcagggtttcctccctcacctccctaccttctcagggagggcttcctgacctccctctttaaaattgtagccctgccaggcaccgtggctcacacctgtaatcccagcactttgggagcctgaggtgggcagatcacctgaggccaggagttcaagaccagcctggccaacaaggtgaaaccccgtctctactaaaaatgcaaagattagccaggcgtggtggtgggcgcctgtaatcccagctgcttgggaggctgaggcaggagaatcacttgaacctgggagatggaggttgcagtgagctgagatggtggcactgcattccagcctgggcgacagagagagattttgtcttggaaaaaaaaaaaaaaagaaaattacagcccccactgcctgactcctcattccttttcctgccttatttttctctccacctgacaataacaaaacaaacaaattatcaaaatgcagggccagatcaggtggctcatgcctgtaatcccagcactttgagaggcaagttgggcagatcacttgagcccaggagttcaagaccagcctgggcaacatagcaagaccccatttctgaaaaaaaattaagatatagagtctttgccactccctcatctccaccatgtccagaatattggctccatggagtgaaatttcttgtctactctgttctctgctgggatcccagtgtgtagttggtatgcagtgggcacccgataaatgtgaagtgatgtcagccatcctgggtccttatggctgcagcctgagaggttggacttggggggcggatggcgttgggggtagcgtacctcgggtggcaggtaacaggcaggttctggagacaggcaggcttgggtccaagtcccagactctactccctactttatgactttggatgactccatgcctcactttccccagttgcaaagtacagatgacagagggacctggcacttaacacatgtcagcttcccggggaccttgctggagtctggaaggagctgggggccaatctgaggcctccagagggtcagactctgagacaggacatttatgactttcccacccactcctagaattttccagaaatgtgatgaagagcaaggagacgttactttattttgggcagtcaggacccctctgaaaaggcgacattagggctggggcctgagtgggagtgagtgatgggctgagacaggaattggacttgtttactgccctcccagagacccctcattcagtggggagacagacgtgtctttgggcagttacaaggcagattaaccagggtacaaggaaaacaatcagagacactgaaggcaaggagaggctcgttttttaatttttttttgagacagagtctcgctctgtcgctcaggctggagtgcagtggcgcaatctcggttcactgcaatctccgcctcccgagttcaagcgatcctcctgcatcagcttcctgagtagctgggattacaggtgtccactaccacacctggctaatgtttttttttttttttttgagatggagtctcgctctttcacccaggctggagtgcagtgactccatctcggctcactgcaagctccgcctcccgggttcatgtcattctcctgcctcagcctccccagtagctgggactacaggtgcccaccaccacgcctggctattttttttgtatttttagtagagacggggtttcaccctgttagccaggatggtctcgatctcctgacctcgtgatccgcccgcctcggcctcccaaagtgttgggattacaggcgtgagccaccgcacctggctaatttttgtattcttttgtagagacggggttttgccatgctggccagactggtctcgaactcctgatctcaagtgatctgcccgcctcatcctcccaaagtgctgggatctacatttggccttctttttgtttttgcttttattttgagacagagtctcactctgtcgcccaggttggagtgcagtggtgcaatcttggctcactgcaacctttgcctcccgggttcaagcgattctactgcctcagcctcccaagtaactgggattacaggcacgtgccaccatacccagctaatttttgtatttttagtagagatgaggtttcaccatattggccaggctggtcttgaactcctgacctcaggtgatctgcccaccttggcctcccaaagcactgggattacaggtatgagccactgtgcatgaccaaggagaggctcttgacccaggctgggagtcttcaagacttcctggaggcagccacaggcaagctgcccacttgaaggtttaaccatgccaggcatcagataacggaatgctgaacagtgatttagagggagcggcccaggcaaaggcctggcatccgggaatggcatcggagcaacattcctaaaattgaagcagactctgggaatccacccgtggagaccctaggctgagaacctcggagtcagggtggctgcgggagggcagacagggaggccaggacagggcagtgcgttcggccaggtcacaaaggcctcgaatgccaggtcaggagccatggggagcctccgaggagatcttgagatggggaagggacaggctggtactcagagccactgctgagagagggatggactccatctgtgtgtatcccagaggaggggcggtcctggaccgtcatctgagaggaagtgctttgcctccagttacacaaacacctccggtccttaaagggacgataggtagcctctgcctccccactgggggcccttctctgtgccaacccatccaacccagagggctgatggaagacgtgtgctctgcaggggctctctgtggcttcttgcttcactgggtggatgggtatcaagatggtgacttgaggccgggagccgtggctcatgcctgtaatcccagcactttgggaggccgaggcgggaggatcacttgaggccaggagttcgagaccagcctggccaacgtggtaaaaccccatctctactaaaaatacaaaaattagctgggcatggtggcgggcgcctgtattcccagcgacttgggaggctgaggcaggagaatcacttgaacccaggaggcggaggttgccgtgagcctagatcgtgccattgtactctagcctgggtgacagagcgagacttcatctcccgcaaaaaaaggtggtgacttgatttcacagagaactccagctgcctgagccaccctgcaggataggagcaggctctgaggtccacagtttgctactgtctcaacccactgcccccagctcctctgagacccaggcaggactgcaggcccatgtaggttcagatggatgcctggaggccggacacggtggcttgcacctgtcatcccaacactttgagaggctgaggctcaagtatggcttgaggccaggagttcgagacaagcctgggcaacatagtaagaccctatctctataaaaaatatatattttaaaattagctgggtgagggctgggcacagtggcttatgcctgtaatcccagcactctgggaggccaaggcggatggatcacctgaggtcaggagtttgagaccagcctgaccaacatggtgaaatcccgtctctactaaaaatacaaaaaaattagccaggtgtggtggcacatacctgtaactccagctactcaggaggctgaggcagaaaaatcgcttgaacccgggaggtggaggttgcaatgagctaagactgtgcttctgcactccagcctgggcaacaagagcgaaactctgtttcaaaaaaaaaaaattagctgggtatagtggcatgggtgcctgtagtctcagctattcaggaggctgaggcagggggatcatttgaacccaagagtttgaggctgcagtgagctatgatcatgccactgcactccagcctgggcaacagagtggaatcctgttgtctcttaaaaaaaaaaaatttgttaagtggatacatacctggggaccctggagctccacggctgctgccctcaccctgttgttttcctccctctcggatgatgccatcttagaattccatgcctggaatttgcccaccggctctcctcgccccctcccacccctcggctgtgtgtccccttattcctgcccaagcaggcagttcccagatctaccccagatactcatcccaatctgccacccccaccccttgaagataccctacccggacctcagcacccctccccgaggctcctgtctctgccaccctccaccttcagcctccctctctcttcttttctggagacagcaccatgctctgttacccaggctggagtgcagtggtgcgatctcggctcactacaatctccacctcgcaggttcaagtgattctcttgcctcagcctcctgagcagctgggattacaggcatgtgccaccatgcccaggtaatttttatatttttagtagaaatggggtttcaccatgttggccaggctgatctggaactcctggcctcaggtgatctgcccgcctcggcctcccaaagtactgggaatacaggcatgagccaccgcgtccggctgagcctccctacctgttctgacccagcttccccactctggctgctgtcacctgcaagaggccagccagcctctgagtgacctccagggatgggacaacctccaagggcagcctgtgttgccaggagaactcccagaatcggtccctcccgaaatctctgccgccttcccatggcatcaaggctgagggcttctgttaccactgctgttttgtgtttttttttttgttttttttttgagacggagtctcgctctgtcacccgggctggagtacagtggtgcaacctcggctcactgcaagctctgcctcctgggttcatgccgttctcctgcctcagcctcccgagtagctgggactataggcgcccgccacggtgcctggctaatttttttgtattttttttagtagagacggggtttcaccctgttagccaggatggtctcgatctcctgaccttgtgatctgcccgcctcggcctcccaaagtgctgggattacaggcgtgagccactgtgcccggcctgtgtatttttttttttttttttaaacagagacagggtctcgctatgttgctcaggctggtcttgaactgctaggctcaagcaatcctcccaccccagcctcccaaagtattggaattacaggtgtgagccactgtacctggttctgctgctgtgtccttcaaggcatggtaacagacacttggtaacctccccttgaatctggagtgcccgagggcctgggctggcagccttgccaacatcgggaactggtcaagactgcactttgttttgtgttcattgtatttgttttcacggctagcctctgcacgtgatgccaatgctggcttgctctttcagggagagagggagggagagaaagtgtcttctgaaaataaatgtatttcggtaaacaaacaatgtgagccttttaacttttttttttcttattttttttttttgagacggaatcttgctctgtcacccatgctggagtgcagtggcacgatcttggctcactgtaacctccacctcccaggttcaagcgattctcctgcctcggcctcccaagtagctgggattaccatgcccagctaatttttttgtattattagtagagacgaggcttcaccatgctgaggtcgaactcatgacctcaagtgatccgccctcctcagcctaccaaagtgctgggattacaggcatgagccaccacacccagcctaaaattttattttatatttacttactgacttatttatttttttatgtttttttttttttttttttttttttttgagacagaggcttgctctgtcgcccaggctggagtgcagtggcatgatcgtggctcactgcaagctccgcctcccgggttcacgccattctcctgcctcagcctcccagtagctgggactacaggtgcctgccatcacgcccagctaattttttgtatttttagtagagacggggtttcaccgtattagcaaggatggtctcaatctcctgatctcgtgatccacccgcctcagcctcccaaagtgctgggattacaggcgtaagccaccgcgcccggccctatttatttttttttgagatggagtctcgctctgtcacccagactggagtgcagtggcgcaatctcggatcactgcaacctcggcctcccgggttcaaacgattctcctgtctcagcctcctgagtagctgggattacaggcacccaccatcatgcccagctaatttttgtatttttttgtagagatggggtttcaccatgttggccaggctggtcttgaactcctgacctcaggtgatcctcttgcttcagcctccgagaagtgctgggattacaggcgtgagtcactgtgcctggccagcatgagccttttttatttatttatttttgtttttgagacggagttttgctcttgttgcccaggctagagtacaatggtgtgatcttggctcacggcaacctccgcctcctgggttcaagcaattctcctgcttcagcctcccgagtagctgggattacaggcatgcgccaccacacctggctaattttgtatttttggtagagacggggtttctccatgttggtcaggcggatcttgaactcctgacctcagatgatccacccgcctcggcctcccaaaatgctgagattacaggtgtcagccactgtgcctggccagcacgagccttttgaaggagagcagtgagtgcctcacagcacaggtggaagacggacaggtggccatgagggtggtgggaaagcctgaaactggagcttggttgttctctggaatcctgggtgcccggtctcagttgagccttttactcatttgtgcagtcggtggacagtttcctgctacccgttgtgtgtcaggtgctgggaaaatggagaggtcctaatcaccaggatatgggggaagatagttgtccctggctgggtgcagtggctcacatctatagtcccagcactttgggaggttgaggtgggaggatcacttgaggccaggagtttgagaccagcctgggcaacatagggaaaccctgtctctgccaaaaaaaaaaattagctgggcatggcggcatgtacctgtaatcccagcactttgggatcctgttgaggcatcaggatcacttgaacccaggagtttgagactagcctgggaaacatagtgagacctggtctctacaaaaaaattttcttttttaattggccgggccgggtgcagtggttcatgcctgtaatcccagcactttgggaggctgagaggtgggaggatcacttgagctcaggagtccaagaccagcctgaccaacatgttgaaaccctgtctctactaaaaaaatacaaaagtagctgggcatggttgcacacgcctgtaatcccagctacttgtgagactgaggcaggagaatcacttgaacctgggaggcggaggttgcagggagctaagattgcaccattgtgctccagcctaggcaacaagagagaaactctgtctaaaaaaacaaagacaaaattagccgggcgtggcagtgcacgcctataatcccagctactcagaaagctgaggtgggaggatcacttgagcctgggaggtcgaaactgcagtgaaccttgatcatgccactgcactccagcctgggcaacaaagcaagaccctgtctcaaaaacaaaaacacaaaaaacagttgcccgtggctgggtgcagtggctcatgcctgtaatcccagcactttgggagaccgaggcgggcggatcatttgaaatcaggagttcgagaccagcctgaccaacatggtaaaaccccgtctctactaaaaatacaaaaaaaattagccgggcatcatggtgcgtgtctgtagtcccagatacttgggaggctgaggcaggagaattgcttgaacctgggaggtggagggtgcagtgagctgagatcacaccactgcactccatccagcctgggtgacagcaagactccgtctttaaaaaaaaaaaaaaaaaaaaaaggccaggcacggtggcccatgcctgtaatcccagcactttgggaggccaaggcgggcggatcacgaggtcaggggttcgagaccagcctgaccaacatggtgaaaccctgtctctactaaaaatacaataattagccgggtgtggtggcacgcgcttgtaatcccagctactcaggaggctgaggcaggagaatcgcttgaacctgggaggcggagattgcggtgagtagagattgtgccactgcactccagcctgggtgacagagcgagactccatcgcaaaaaaaaaaaaaaaaaaattgttgccccaaaagttctgagaaagatgaggtaggagaacccaggaggggagtgtcccctaacccagcccagcggcgattggtcggccctcctagaggaagtgtctgttgaacagagtcgtgaagagctgggaggaatttggcaggctgaagggagggcattactggtagggaatggcatgtgccaaggtccatttgctggggagcaccgtgccaggccagtgggagcacttgcaggattcaaagctgcgggtctgatttgcaggcaagaagaaagacctgggtgctgagtggggaggcggccaccatgattcaatcaagaaatgggagccgtggaaatcgggcagaggagggactgtcgcgggaaagacggacgtaatcgtagggcttaatgaggagctgagtgccgagagggtgtgagatggagtcagagatgactctcagaattttgtccctgaagactgggtggagggtgggatcttggccaagaagccaggggaggaggaaagaaggctctgtgggagatgacttcagccctgacgtgtctggacagcgcgcagacgggaggtattggggcagcaggtttggctttggcgggatggtgacctgggagcagcagaaatctggaaactgacagcatggacgtgctggccgcagcttccaggcaggtgaatttcccagggagagcagatggtgtgaggggatccaggactggcataatttagggagaaaaaccagcacaaattagagaaaacagcagagaggaggggaaccaggaggtcatgattctgggaaggagggatggacaaggggaggagatgctactagagggtcccagtttcatgcttagaggaattgaccacttgggattggccatgggaggctgcgactgatggccaaaagccaaaggctggagtagtagggtggggacagagaggtggcagtggacagtgaatagaagcaggaaggcaagtcctgttttccaataattcttttttttttttttttttttgagacaaagtctcactcttggccccccaggctggagtgcgcaatggagcgatctcggctaactgcaacctccgcctcccgggttcaagcgattctcctgcctcagcctctcgagtggctgggattacaggtgcccgccaccaagcccagctaatttttgtatttttagtagagatggggtttctccatgttggccaggctggtctcgaactcctgacctcaggtgatccacccacctccgcctcccaaagtgctgggattataggcgtgagccaccgtacccggccgtgttttctgataattctgaggctactgctgatgagctgagtgtctctgggcccatgtctgtctggaatgcctggtgccacagagctggggtcaaattactgcctggccatttgtcagctatgtgaccctgtgtaggtgatccggcatgtctccaagactcagtttgttcatctgtgaaatgagaatggtgaccgggcaaggtgactcacgcctgtaattccagcactttgggaggccaaggcgggcggatcatttaagtacaggagttcaagaccagcttggccaacatggtgaaactccgtctctactaaaaaatgcaaaaattagccaggtgtggtggcgcatgcttataatcccagctacttgggaggctgagacgggagaatcgcttgaatccgggaggcagaggttgcagtgagccgaagtcacaccactgcactccactccagcctgagtgacagagcaagactctgtcttaaaaaaaaagaatggtaacagtatcttcctcagggtgtgactgatatttccaatgcagggaggtaagggcttgtccctgggtaagcgtctgatggataatacctgggatggtaccaacgctattggtcactggtgccttaggataatcctggtgtgggtgtgggcaaaagcctgctctcccacagaacagtctggctttgcacctgcttggccctatatgaatctacctccatgtatgctgtcaccagggagcagcacaggggcccagccaacagctggtgggaggaggggcagatgttagagcaggttgagtgaaggaaggatcccatcagagcataacccagatttcacaattatctccaccctggaaggtgggcagggacatcaccaaaggggctgatcttgatggaaaattggtttcttggcccgtgtagtggctcatgcctgtaatcccagcactttggaaggccgacgtgggcagattgcttgagcaaaagagttcaagaccagactgggcacagtggctcacgcctgtaatcctagcactttgggaggctgaggcaggcggattgcctgaggtcaagagttcgagaccagcctggccaacatgctgaaaccccgtctctactaaaaacacaaaaattaggccaggcgcagtggctcacacctgtaatcccagcactttgggaggccgaggcagacggatcacctgaggtcaggagttcgagaccagcctgaccaacatggagaaaccctgtctctactaaaaatacaaaatcaactggatgtggtggtgcatgcctgtagtcccagctacttgggatgctgaggcaggagaattgcttaaacctgggaggttgatgttgccgtgagccaagattgcaccattgcactccagcctgggcaacaagagcgaaactgtctcaaaaaaaagagaattggtttcttaagtagtgaggtgggggtagagggctcattccctaccaaaaatgccccctctcctgtatcaaccctgtctcctgtatcaaacacaccttcagtggaaatcttttcattttcatgtactataattttctatttaaaaagtcacccttaatatatatacatacactggaatatgattcaggttttttttcttctttttccttgagacagagtctcactctgtcacccaggctggagtgcagtggtgcgatctcggctcactgcaacctctgccttgatcttggctcaagcaattctcatgcctcagccttccaagtatctgggacttacttggaagtaagctggccaccacgcctagctaatttttgcatttttagtggagatggggtttcaccatgttgcccaggctggtctcgaactcctgatcgcaaatgatccacccgtctcagcctcccaaagtgctcggcttacaggcatgagtcactgcacccagcctgattcagccttaaaagggaaggatgtaacatgtcatgtgggtgaaccttgaggacattatggtacatgaaatcagccagtcacaaaaggggagatactgtgtgattccacttacatgaggcccctagcgtcaccagattcacacagagagaaagtagaatggtgggtgccaaaggagagggaacagggaattattgattattaggcatggattttcaggtttttgttgctgttgttttgagacggagtctcactatgttgctgggctggaatgcagtggcgtgatctcggctcaccgcaacctctgcctcctgggttcaagcgattctcctacctcagcctcccgagtagctgggattacaggcgcccgccaccacgcccagacaatttttgtatttttagtagagacggggtttcaccatgttggccaggatggtctcgatctcttgacctcatgatccgtccatttcggcctcccaaagtgctgagatgacaggtgtgagctactgtgccctgccagagtctcacgatccgtccgcctcggcctcccaaagtgccgagatgacaggtgtgagccaacgtgccctgccagagtttcagttttacaacatgaaagaattctggagctggatggtggttatggttacacaaccatgtgaaatatttaatgccactgaactgtataattaaacacgattaatggtaaatgttgagtattttaccacaattaaaaaaaatttttaaatatgtcagccgagcatggtggctcacacctataatcccagcactttgggaggcctaagtgggcagatcacctgaggccagtagtttgagaccagcctggccagcatggcgaaaccccatctctactaaaaatataaaaaattagctgggtgtggtgtaggtgcctgtaatcccagctacgcagcaggctgaggcaggagaattgcttgaacctgggaggcggaggttgcagtgagctgagatcccgccgttgcactgcagcctgggcaacaagagcaaaactccgtctcaaaaaaaaaattttttttttaagaagtcacccttaaacccactccttataaaaaaaaatcagtgaaggccgatcatggtggctcatgcctgtaatcccagcactttgggaagccaaggtgagaggatcacttgagatcaggagttcaagactagcctggccaacatggtgaaaccttgtctctcctaaaaatacagaaattagctgggcataggggcacatgcctgtaatcccagctacttgggaggctgaggcaggagaatcacttgaacccctggggcggaggttgcaatgagcagagattgcgccattgcacacaccagcctgggccggtgagacttcatctaaaaaaaaaaaaaaatccatgaatgccaggtgtggtggctcatgcctgtaatcctagtactttgggaggctgaggcaggcggatcccctgagtccaagagtttgagaccagcctggcaacatggtgaaaccccatctctacaaaaaattaaaacagtagctaggcaaggtagtgcacacctgtaatcccagctacttggggagctgagctgggagtatcacctgagcccaggaagtggaggctgcagtgagctatgatcagtaaaacacaagacaggttcactggctcccatcccaacccggaccagctccctagtataacaactcacatgcatgtggactatacccttagagccttcttcttctttcttcttttttcttcttcttctttcttcttttttcttcttcttcttcttcgtgtgtcgctctcacccaggctggagttcagtgcgatcccagctcactgcaacctccgtctcctgggttcaagtgattctcctgcctcatcctctggagtagctgggatgacaggtgcctgccaccacgcccagctatttttttgtatttttagtagagacagggtttcaccatgttggccaggctggtctcgaaatcctgaccttaggtgatctgctgcctgccttggcctcccaaagtgctaggattacaggtgtgagccaacatgcccagccttttttgttttttgagaaagggtctcactctgtcagacaggctggaatgcagtggcatgttcaggactcactatagcctcaacctcccaagctcaagtgatcctcctgcctcagcccctaaagtagctgggactacaggcatgtgccaacacacccagctagttgttatttgctgttgttgttgttttaattttagtagagacaaggtctcactgtgtttcccaggctggcctcgaactcctgagctcaagtgatcttcccgcctcagcctcccaaagtgctggggttacaggtgtgagccaccacatctggccttacagccttcttctgtgtgtttatgtgcatatatgtagccatagggaaaaaaatcaaaatcctttggtgttctttcttattttttcaaatatttcacctgccccattctctttcctttctccttctagtactcccattgcatgcaagttagacctttttttttctttttttttcttttttttgagacggagtctcgcctgagctggagcacagtggtgcgatctcagatctcggctcactccagcctctgcctcccaggttcacatgattctcctgcctcagcctcccgagtagctgggattacaggcatgtgccaccacgcctggccaatttttgtatttttattagagagagggtttcatcatgttggccaggctggtttcaaactcctggacccaagtgatccgcccaattcagcctcctaaagtgctgggattacaggcgggagccactgtgcccagccataagttagatcttttgatatcatccagaaaataccaaggctctatacagtttctaaattgaggtaaaatatatgtaatataaaattaaccattttaaacatgtttaagtgtgcaacttagtagtattcagtacattcaaagtgttgtgcaaccattaccactatccatttttacttaaacttttttcttctctgttcttcagtttggatatttgctatcaatctgtctttaaatttgttagcactttcttttatcatctccaatgcgctatcaagcccaaacagtgaatttttaaatttcagattgtgtatatttttaagttttataatttccatttgttttttgttttgtttgtttgtttgtttttgagacagggtctcactctgttgcccaggctggaatgcagtggtgcaatcacagctcactgcagcctcaacctcttgggctcaagtgatcctcttgcctcagccccccaagtagctgggactacaggcttatgccaccacgctcagctaatttttgtattttttgtagagacggtgtttcaccatgttgcccagctgctcttgaacccctgaactctagtgatccacccaccttggcgtctcaaagtgctgggattacagacataatagctgcctcaaacacctttctgctaattccaacatctgggtcacctcagagccagtctcctttaacttccttctttcctgagcatgggccatgttttccaattttgtgagatgtcaagaaattttggattgagtgctggatattgtggaagatatgttgtagagtctctggattctgttatgttcctttgaagagcaatgattttttaaaatttaactatttttttatcaggcagttaacctggctggactcagactccaaagtctgtttctcctgtggtgggtagcagatgaaatcttggcctagttctgttagcctcagcaaggctagttggaatacgttcaatatccatgggctaagagtcagcaagagatgtacacagacttttaatgtagaatatggggctttccatctctggctcttttcttttctttttcttttttgagatggagtcttgctctgtcgcccaggctggagtgcagtggtgtgatctcggttcactgcaagctccacctcctgggttcacaccattctcctgcctcagcctcccgagtagctgggattacagatgcccgccaccatgcccggctaattttctttttgtatttttagtaaagacagggtttcatcgtgttagccaggatggtctcgatttcctgacctcgtgatccgcctgccttggcctcccaaagttctgggattacaagcatgaggcactgtgcccagcattttttttttttttttttttttagagacagtctcccaggctggagtgcagtggtgcaatcatagcttctgggctcaaaggatcctcccacctcagcctcctgagtagctgggactacaggcatgtaccacctcacccagctttttcttttttttttttggtagagacagggtctcactatcttgccaaagctggtctcaaactcctagcctcaagtaatcctcccacctcagcctcccgaagcagtggaattataggcatgagttacgacacccggccctatcctcttaatctttaagccagtttttatctccaatgaatagcaataaaaatgagaaattcacccagtgccatttctttcttccatttatagattcccttccgattgctacttgtttttcctctttagagtgatactgtccagtagaattttatttcttttttcttttcttttttttaagacagaatcttgctctgtcacccaggctggaatacagtggtgcaatctcggctcgctgcaacctctgccttccaggtttaagcgattctcctgcctcagcctccctagtagctgggattacaggcacgtgccaccacacccggcaatttttttgtatttttagtagagacggggtttctccatgttggtcaggctgatctcgaactcccgacctcagatgatctgcccacctcggcctcccaaagtgctgggattataggcatgagccactgtgcccggcctagaattttctacaatgatggaaatgttccatatctgaattctgcaaagtggtagccactggctacatgtggctattgagtatacaaatgttgttagtgcaacatatttattaaaacctttttatttaaacctttttttttttttttgagacacggtctcaccctgttgcccaggttagagtgctggtggtgtgatcacagctccctgcagcctagatctcccaggcttgtcatccttccacctcagcctcctagagagtagctaggactacagggagacaccaccatgcctcgctgattttttttttttttttttttttttttgaagtggaggtgaggtttcactatgttgtccaggctggtcttaaactcctaggcttgagtgatcctcccgccttgacttcccaaagtgctggggttacagacataagccactgcagccagcctgaatctttttattttattttttttaagagatgagggtctctctatgttgtccagcctggtctcaaattcctggcctcaagcaatcctccaacttcagcctgggattacaggcaaaagccaccacactcggctaatttttttttggggggcggagtcttgctctgtcacccaggctggagtgcagtgctgtgatcttagctcactgcaacttccgcctcccaggttcaagcgattctcctgcctcagcctcccgagtagctgggatcacaggcacgtaccaccacacccagctaattttttgtatttttagtagagacggggtttcaccatgttggccaggctggtctcaaactcctgacctcaggtgatccgcctgcctcggcctcccagagtgctgggattacaggtgtgagccaccgtgcctggcccaggtagttgtttttttatatttagctcagtgtttatcattgttatctatgaaagagctggcctgatgtggctgacttcaccattaccagaaggagaattcttgtggttttccattgtataaattatcaggccattagtgtctctctgtactttgcttttattttttttaactccataatcctcccaagccattgaacatagctcttcctccaccccatacctcctttagtaatttttaaaattaaaaaattttttaattgtggggccgggcgcggtggctcacgtctgtaatcccagcactttgggaggccatagcaggtggatcgcttgattccaagagtttgagaccaacccgggtgacatggcgaaatcctgtctctacaaacaaacaaaaacacaaaaattagctgggcatggtggcacacgcctgtagtcccagctgctcaggaggctgaagtgggaggaccacttgagcctgggtggtgaaggttgcagttagatagcaccactgcactccagcctgagcaacagagacctcgtctcaaaataagagagtcggctgggcgtggtggctcacgcctgtaatcccagcactttgggaggccgaggcgggcggatcacgaggtcaggagatcgagaccatcctggctaacacggtgaaaccccgtctctactaaaaatacaaaaaattagccgggcatggtggcaggtgcctgtagtcccagctactcgggaggctgaggcaggagaatggcgtgaacccaggaggcagagcttgcagtgaactgagattgcgccactgcactccagcctgggcgacagagtgagactccatctcaaaaaaataaataagacagtctccctctgtctccaaggttggagtacagtagtgcagtcatagctcactgcagcctccaacgcctgggctcatgcagtcctcccgagtagctgcaccacaggcatgagccacagcccccagcttccagaacctttttgttttccaaaactgaaatgctgtactttacccattcaattttaactccccatttcccttcccctggcacccaccattctattttttttttttttttttttttttttttggagacagagtcttgctctatcccccaggcaggagtgcagtggcttgatctaaactcactgcaacttctgcttcccgggttcaagcaattctcctgccttagcctctcaagtagctaggattacaggcacgcatcactatgcccagctaatttttgcatttttagtagaggtggggtttcaccttgttagccaggctggtctcgaactcctgacctcaggtgatccacctgcctcggcttctcatagtgctgggattacaggcatgagccaccacgcccggccccattctactttctgtcactatgaatgggactattctagagacctcatataagtggaatcatacaggatttgtcctcttgtgacaggtttatttcattcagcataacgtcctcaagatttatccatattgtatctttctctttttctttctttctttcttttttttttttttcagacagagtttcactcttgttgcccagactggagtgcaatggcaggatctcggctcactgcaacctctgcctcctgggttcaagcaattctcctgactcagcctcccgagtagctgggattacaggcacacaccaccatgcctggctaatttttgtatttttagtagaaacggggtttcaccatgttggccaagatggtcttgatctcctgacctcgtgatctgcccccctcagcctcccaaagtgctgggattacaggcgtgaacgaccgcacctggcataatagggacgaggtttcactatgttggtcaggctagtctcaaactcctgacctcaggtgatccacctgcctcggccttccaatgtgctgggattacagggccatctttttgcttttttttccccatttgctgttttaaaacttctagttcaggccgggcatggtggctaatgcctataatcccagcactttgggaggccgagggaggtggatctcctgaggtcaggagttcgagaccagcctggccatcatagggaaaccctgtcaaaaaataaataaaaaatacaacttctagttcaggctgggtgtggtggctcatgcctataatcccagcactttgggatgccgaggtgggaggattgcttgaacctaggagtttgagactagcccaggcaacatagtgagaccctccccccaatctctataaagaattttaaaattaggcaggctggtggcatgtgtctgtggttccagctactcaggaggctgaggtgggaggatcacctgagccccaggtgggttgaggctgcaatgagctgtgatcgtgccactgtagtccagcctgggtaacaagagcaagaccctatcccaaaacaaaaacaaaacaggccgggcgcggtggctcacgcctgtaatcccagcactttgggaagccgaggcgggcagatcacgaggtcaggagatcaagaccatcctggctaacacggtgaaaccccgtctctaccaaaaatacaaaaaaattagctgggcatggtggcgggcacctgtagtcccagctactccgggggctgaggcaggagaatggggtaaaccgggaggcggagcttgcagtgagccgagatcgcgccactgcactccggcctgggtgacagagtgagactctgtctcaaaacaaacaaaaaaatgccttctagttgaaaaggttttacatgtcctatttcatgacttgtcatttggtgtaccagagttttgttagttcaaatcgagaaagacgtttcctaacatgacatatgcgttagtaaggttttctttggagggggaactctgtatatgctaggtgtttcttaaactttcccaagagtttgggtcaaatttctgcttatggctgggcgtggtggttcatgcctgcaatcccagcactttgggaggccaaggcaagaggaacgcttgagcccagcctgggcaacatggtgaaatcccatctctacaaaaaagtacaaaaattagctgggtgtggtggcacccgcctgtagtcctagctacttgggatgctgaggtgggaggatcacttaggcccaagacgcagaggtagcaatgagccgtgatctcgccacggcactctagcctgagcaacagaaccaggccctgtcttctaaaaaaaaaaaaaaaaaaaaagaaagaaagaaaaaacagggctgggcgtggtggctcatgcctgtaatcccagcactttgggaggctaaggcagatggatcacttgaggccaggagtttgagaccagcctggccaacatggcgaaaccccatctctactaaaaatacaaaaattagccaggcatcgtggcatggacctataattccagctactcagtgtggctgaggcagtagaatcgcttgaaccagagaggtagaggttgcagtgaactgagatcaggccactgcactccagcctgggcaacagagcgagactctgtctcaaaaaaaaaaaaaaaaaaaaaaaaacgaaaaggagaaaagaaagaaatctgtttatttcttagcttgcaagtcaccttgctgttagttctctcacagttatctgccccaggaacacagagacgattatagataaagatcctgttaccttggacctggtaaaggctgctggactaggtgtagctcactcagcctccagctttctgttcattatcttgattgagggggtgatttcatgggtgtgtacatatgtcaaaatgtgttggaactgctgggtgccgtggctcatgcctgtactctcagcactttgggaggcggaggcgggcagaccacctgaggtcaggatttcaagaccagcctggccaacattgtgaaaccccatttccactaaaaacacaaaaaaagttagccacgcatggtggtggatgcctgtgatcccagctacttgggaggctgcggcaagaggatcacttgaacccaggaagtagaggttgcagtgagccaagatcattccactgcactccagcctgggcatagagactgcatctcaaaaaaacagaaaaaagtaggccaggcatggtggcttatgcctgtaatcccagcactttgggaggctgaggtgggtggatcacaaggtcaggagattgagaccatcctggctaacatggtgaaaccccaactctactaaaaatacaaaaaaattagccgggcgtggtggtgggcgcctgtagtcccagctactcaggaggctgaggcaggagaatggcgtgaacccgggaggtggagcttgcagtgagccgagattgcgccactgcacaccagcctgggcgacagagcgagactccgtgtcaaaacaaaacaaaaaaaagtgttggatctcacactttaaacacgtacagcttcttgcctgttgattatacctccgtaatgctgtttttatttttatttttttaccattaatagcccaagtgggccccctcacactcccacgtgtatacttaatcctgtctctgtgcgagtaacaatcagatggtaatccccccccacaatccctgctccactactccacctctggggctggggactgctcattttttccctccaaccccccagagaccagatcctctctcctccctcacggacctccccactttactctgggatgctgggggcccctggagatctcaccctggcctgaccatcactaactggggagagacttagaggcagacttgaatactccaacctccagggagccagggctggctcagaagaaaggtctaggggcagggaggggtattggctggggaggggactctgcctagcataggaagagcaggggaggcctcttaaatagggattttaatctgatccaggacttgaaaggcaagtgggaactggcccagggaagagggcggaggcatgttggaaaaagggcactgatgcagaggcctggaggcttggggctggtcttgggaatcataccatctggatggcatggggctgaggtaaccagagcttgaatagaactgcagaagagacagatgattccagaagggtaaggaggtggaggcccctctttacttccttcccacagcaggcaccaggccagagttgggtgggcacctgctgggggatcctcatggtccagtattggttgtaggttttgagggggctgacaggagaggtggttgccagggaatggttccaagaagatgcaataggggaggaggctggggatacccaggggacatggcccagcttacggaggctcctgagcttccaggggcatagacattaagaaattgcacgctgagcccgagtgtggtggcttgtgtcggtaatcctagcactttgggaagccatagtgggagaatggctcaagaccaggagtgcaagaccagcctgggcaacataccaagaccctatctctacaaaaaaataacaaaaattagctgggtgtggtggcatgctcctgtagtcccagctgcttggaaggctgaggcgggaggatcacttaagtccaagagttcaaggctgtagtgagctgcaatggtgccactgcactccagtctgggcaacagaatgagaccccatctctttaagaaagaaaaattgtggccaggtgtggtggctcacacctgtaatcccagcactttgggaggctgaggcaggtggatcacctgaggtcaagagttcgaaaccagcctggccagcatggtgaaactccgtctctactaaaataaaaattacccgggcatgatggcaaacacctgtcatcctagttattcaggtgggtgaggcaaaagaattgcttgaacccgggaggcagaggttgcagtgagccgagatcgcgccactgtactccagcctgggcaacaagagcaaaactccgtctcaaaaaaaaaaaagaaaaagaaaaaagaaaaattgcatgattagcttctagtaccccgaaagcttagagggcaagtagaaggaggagcttgctttttggggaaactttaatcagcagaggtaggcctggggaggcctccgcaggaccgtatgaaccctgagcccactgtgggagcagagcagccccctcctcacccaaggaagcttctatccttgactgtcccccttgctgactgagtgacctgtgatctgtctctagtcatttcttgctttgagccttgggcttcccagttcccacgtttcctttatgggaatgtttatggagatcaagccaaccatgcctgttaagggtgggttatttttctagagagtttgaccacctgagctaacatccttgcaccctcccacctgtccatctgtctattctactcattcatccatgtagcaaacatttatgtggcatctaatgtgtccagccctgtctgaggctctgaggatacagcagtgactcaaacaacattcttttctttcatgaaacttatgccttggggtgaagaagacaccccaatgaaacagatcaactgggacaagagggttgaaggaactacacaggatcaggagacagaataatatggtggcctctttggtggtagtctgagaagtcttcttggaggaggtgacatttgagctgaaataagaatgataacacagtcagacatgtatgtgactgtctggggtgcaaacatggtacaagtgagcttggtgagttggaagcccagcaagcagcagttgctatggattaagctggggaggcagaggtggggaggcagcagggccagaatgtagagggcaggaatgtgtgcagaaataaggggctcaggtaaggcggaaccttgaacttggggtccaccttggggtctttggggggagtggtacctcaaccggcagcatctctggtcactaacaccctgtgggacctctgctcagagaggctcagagtggaagagacaggtccgtctggaagggacagccaggacccggtgcagaggcaggctgtggttatctgcaaacagcccccttccttccagcatgtcacgtgctcccgcctgagcctctggccgcaggaatcaggtgaccccaggcagcgggccaggctgcaggggcgggtgagtgagtcaatgtatgcaagtgtgtgtgtgtgtgtgtgtgtgtgtgtgttttcatctctgggaggcccagacatctggggtctgaattaattgcctttttcacaaccatggacaagtcctgtatttccagctagattgaaagcaaaacaaaacaaacctatgtgcatagctctgatctgctgagcagtgccagggtccttgggggttcggggaagccgtgggaaccagtccttctcactcagacccctgaagaggggcagggatcctctactcatgccccctaacccacctcccgtgtcagtacaaagccccattctctctctttcccccaatctggggctatttttagccactaagaaggattatcagtttggttcccaggtggcaggggccaagctgggagtggggccagggaggcttcaaacagcagccaggcttgggggcgggtggggtgaggggagaagaggctggtcacactggccctgccacccacgcggtggctctgcagatgaccctgaagctgctgtcgtccagcccagcccaaacacttcagctgcagctttaagggaaggtggcaggggcaaggaaagcttccagcagccttaggcacctcagatgctggaaaccgtcctaagggcttggaagaaccatctagaagcctccataggccagcaccccttctttccagaccactccccatcctgcccccacctcctgtctagcagtaactatcacagtctaagctgttttttggggggtttttttccgaaacaggatctgctccgtcacccaggctggagtgcagtggtgtgatcacagctcactgcagcctcaaactcctgggctcaaccagtcctctcacctcagcctcctgagtagccgggattacaggtgtgtgtcactatgcccacctaatttttaaatttttttgtcttgctatgttgccctggctggtctcgaactcctgaccttaagcaatcctcccacttcggcctctcaaagtgctgggtgtgagccactgcactcggtcctctaaattttactaggtgctcactccacctcaggtgccattccgaaccactccatgtggaagaggggctattgtttgttccattttacagataaaactgaggcacagataggccacgttccatgcctggtaaacgggtgaggcaggaatcaggaatcagatccgttgtgatatcagcatggagtgtttataaactgcccgcctgccctgagcctcacaatagcctggtagaacaaggagggaatctagctgtacccatttttcagatgggacaactgaggcccaggaagacagaggatgacagggaacaaacagaagaactggatccaaaagagaaaagctagaaattgaggaacacatccctcagcctcatttcctcccttccctcaggagaagttgagccttgctggcctgaggtgcctggttatagccatgcctgagcccctcccatatgccagactctgcctcaatgccccaggtgcaaggtctctgagctgcttaaccacccttcagggagggcacctgtcccaccaacaggtgacgaaattgaggctcccagggctttgaagcattgcagctaggactccagccagtctgctgggctccagaccctgttcttttctcaaaccacagcatcttttatttatgctttaagagggagaagagggaagggacgagacagagacaggttggtgaggttagtgagagagtaggacctctggggccagacctctgcaatcagggcatatcagtctgaagcctccttggagagctccctggtttagaaagtgcatctgttcccctttctgtgccactcaggaagcaatgggcatgattcagcagaggagaggagagtttagaactggttatgcttccttctccaaccctccctgcaaaaacactggccagctcctgacatcacagtaagacagggttgcgggagggtgctttaacaggatccaaagcagggcaattgggctgctttcaggaggaggtgacaactgagctgggttttgaaggatgcataggagtttgccaaacagagaaagaaagcgtttaagctcttcagggcagagatgttgcttgttttccccaccattttgtgtcttcagcacccaaatactaaatgagcattctaggcagaggccagtatttgtaaaggctaggatgtgtgaaacgatatggtctggtgggagcagagtatcagtcagtaaactggtgggcattgaagctgggcacatcagcagaggcaaggcttgagattgtgagaagccattgctcctgtggttctccctcatcccctacactcatcatgacttgaatgtaccaaggtgtgcaaggatgcatccaagacccttgggtgaggggaaaacatggagctgggggtctggatgcctgggccttcctaggacacctagtccccttccatctgcaccttggggtctgtcagaaaggtagcagggtctctgagaaagctgcaccagtgactcagaaggctgaggtgggaggatggcttgaacccaggagtttgaggctgcagtgagctatgatcaggccagtgcactccagtctgggtgacaaagtgagaccctgtctctaaaaaaaaaaaaaaaaaaaaaaaaaaaaataggggattgcagataccctgcagtggtcatggctttggctgtgagagctgagtacagttgggaccaagagtgccaagctggccatgtgtccttgagcccccacgggcacacgggatcaagccaaccttgtctgctagtgaagatgatttctttttcttgagaaatcaaccacctgggctgaagtccccacatccacccagctgttcatgtgtctactctgtctgggatgcctgggcctcgttgtaggtctagactagctgctatcccacacccttgactgcttgttgggtcactgacttctagtgcccctccccaaccagagtatccaatgctagcaacagcttctaatacttcactgatgcctaaatgtcagttgccccatagcatggtacttagcctgccccttcatgtgcagtctcttccttttttttttttttcccccaaaacagggtcttgttgaccccttgctgatagatagaggattccatccatcttcatggatttcaacagcagccactcactgacaagtcctacccaggccccacccaccccaagcctgtgccccaaacctgagtagctcctgcctcctccacacgcccacgggaacattttagctgccctcccccacacccacaatttgtgttgtctgacacttagcctgactcctgtcctgaaatcagctcatccattctggttcatccagttcttcagactggaaggctgacagcttcagtggccaagtggggtgaggctgaagatggaattaaggttgttaatcagctgagcttgagatgggagatcatctgggtgaacccagtgtcatcacaagggtcttaaaatgaagaagacggaggcaggagagacactgtcagaatgacaaggtgggagaaagacccaactagccactgctggctctgaagatggaggaagggaccaggagctggagggtgcaggcagcctctaaagccagaaaaggcaggaaatggctgggtgtggtggctggagcctgtagtcccagctactcgggaggctgaggcaggaagatggcttgagcccaggagatcgaggctgcagtgagctatgattgcaccgctgcattccagcctggaagacagagtgagagattgcctccctgcagaaaatgtagtctcttagcaattttccagtatatactatattattaactaaaatcatcatgatgtacagatctcttggacttactactgctgctaactgaaatgtcatatcctttgaccaatatcttgccaatttcctctcccaacccttctcttttctggctccactttggaaagcatttggctcttggggggccccacctctaaaatgtctctggaatccccttatctctaccttatctcaactggacatgccagagcaccctcttctggcctccaaaatgctacgccctgcatggcaaccaacacctgagaatccctgcattattcaaaatagaaccaagggcaacggaaccctcacattctcctgctgggagtgtaagatggtgcagtcctgccttggaaagcagtttgcccaccttggcctcccaaagtgctgggattacaggggtgagccaccacccccggctgccccctaggctggtcttgaactcttggctttggccaggcgcggtggctctcacctgtaatcccagcactttcggaggccaagacaggtggatcacgaggtcaggagatctagaccatcctggctaacatggtgaaaccctgtctctactaaaaatacaaaaaattagccgggcgtagtggcgggcacctgtagtcccagctactcgggaggctgagcttgcagtgagctgagatcgtgccactgcactccaggctgggcgaccgagcgagactccatctcaaaaaaaaaaaaaaaaaaaaaaaacactcttggcttcaagcaattctcctgcctcagtctcccaacgtgctggaattacaggcatgagccactgcacctgggtctattttttattttatttatatatttttattttttattgatttactctgtttttggagacaggtatcactctgtcatttaggctgaagtgtggtggcatgatcacagctcattgcagccccaaactcttgggcttaagcaatcctcctgcctctgcctcacgagtagctaggattatggccacatgccaccttgcccggctaatttttgtattttttgtagagacagtttcgctatgttgtccaggctggtctcaaacccctgggttcaagcaatcctcctgcctcagcctcctaaacactggggttatggtatttttatttttatttattttatttatttttgagatgaagtctcgctctctcacccaggctggagtgcagtggcacaatcttggctcactgcagcctccgcctcccgggttcaagcaattctcctgcctcagcctcctgagtagctgggattacaggtgcccaccaccacccctggctaatttttgtatttttagtagagacggggtttcaccgtgttggccaggctggtctcaaactcctgatcgcaagtgatccactcaccttggcctcccaaagtgctgggattacaggcttgagccaccatgcccggcctatttttattttgtaacatggcaaggttatcatgaagaactgacaaaactaagctttgatgacaaaaaaaaaaaaaaaaaaaaaaaaagctggtggggggcagggcaaggtggctcatgcctataatcccagcaatttgggaggctgagtggggaggattgcttgagcccaggaggtcaagtgtgcagtgaggtatgatggcaccactgcactccagcctgggccacagagtgagaccctgtctaaacaacaacaacaacaaaaaaacaaaaaaactggaatggttgttacttttggatgacaggacaggggtggaggttgactgggaagaggtatgagggaagtttctagaggaaatatttgtgataggagactggattagtcaggtacatagttttgtccaaactcagtgactgtacccttaaagatgtgtgcgggccaggcgcagtggctcatgcctgtaatcccaacacttcgggaggccaaggcgggaggatcgcttgagccaggggtttgagaccagcctggataacatagggagaccctctctctacacaaaaatttaaaacattagccagtcatggtggtgtgtgcctatggtcctggctctgcgggggctgacatgaaaagaccacccgagcccgggaggtcaaggctgcagggagccatgatcgctgcattccagcctgggtgacagagtgagaccctgtctaaaaaaacaaaaagtctgcatttcacttgggtaaattttaccttgaaaggaaaaacccataagcaaatattgaaccctagttaatgatctgtgtgctgacatgtgtaggggcgatgtggcctgaggtcagctgcctactttgaaatgcatcgggaacaagcagatagactgatggtggatagagggatggatgggcagaggcagatgggtgatggaataaacagaatggaatgcaaaggggagaatctagtggtgggaatacaggtattcactgtaaaattctttcaacttttgtgtaggtttgaaatgtttattataaaacattgggggaaggccgggcgcggtggctcatgcctataatcccagcactttgggaggctgaggcgggcagatcacttgaggtcaggagtttgagaccagcctggccaacataacaaaaccccatctctactaaaaatataaaaattagccaggcatggtggcgcatgcctgtaatcccagctactcgggagactgaggcacgagaattgcttgaaccctcaaggtggaggttgcagtgagctgagatcgtgccacggtactccaggctgggcggcagagtgagactccatctcaaaatgttgggggaaataatccagattcttccctgcggcccccatgccttgcaggctctgtgctgcccctcatcacctccctgccctcccctcctccctctctcccccttgctcactgcaccagccacacggacctcctcactgttgctccaacatcccaggcatggtcctgcctcagggcctttgcacctgctgcgtatttatctagaaagcccctcccccagccccaccttcttgtgtgaaaaacccacaaccttctcatctttttttttctcatagggtcttgctctgtccctcaggctggagtatagtggtgtgatcgtagctccctgcagcctcaaactcctgggctcaagtcgtactcccacatcagcttcctgaatagctagaactacagatacgtgccagcacacctgactactttttaaattttttgtagagacagggtcttgctatgttgcccaggctggtcttgaactcctgagctcaagtgatccacctgcctcggcctcccaaagtgttgggattacaggcatgaaccactttgcctggcctgacctccgcatctttttttttttttttttttaagatggagtcttgctctgttgcccagtcttgagtgcagtggcatgatttcaactcactgcaacctctgcctcccaggttcaagtgattctcctgcctcagcctctcaagtagctggggttacaggcacatgccaccacacctggctgatttttgtatttttagtagagatgaggtttcaccatgtgggccaggctggtcttgaactcctgacctcagatgatccacccgcttcagcctcccaaagtgctgggattacaggtgtgagccaccgcacctggcctgacgacctcatctttaagtcccagctcaggtggcgcctccttagagagcctctccttgatcacatttaaaatcacgccactctgttatctacccggcccgttatactttggcatctcattcatttatgaatctgtttacttgtttattggctgccttctctgttggtctgtgagctgggcaggaatgtgttggctttattcccctgctgtgtcgccaaggcccagccctgacctgacatgtacaagtcaattggagaatatctcttgcctggatggatggatggacagacagacggatagatgcaacgacagatggataaatggatggatggaaggggaaatggatagatggaagaaaagatggacagaaggatgggtgggtggaaggacacacaagtgagtgatggatgatgagcggatagatgtttagatgggtggacagatggatgatgaatggatggatgatgggtagatggacagatttttggatcagtggatggatgatggctgggtggacagatgtttagatgggtggacagatggatgatggatggatgggtgaatgggtaggtggatggatgatgggcaggtggacagatgtttggatgagtggatggatgatgggtgggtggacagatggatggatgaatggatggggagatggatgaatgggtgggtagatggatgacagatggacgataggtggatggacaggtgtttggatggatggatggatgatgggtggatggatgaatgggtaggtggatagatgatgtttgtatgggttgatggatgatgggtgggtggacagatctttggatgggtgggtggatggatggtgggtgggcagatgtttggatgggtggacatatggatgatgggtagatggatgagtggataggtggatgatggataatgggtggatggacagatgttttgatgaattaacagatgaatgatgggtggatggacagatgtttggatgggtggatggatggatgatgggtagatgagtggataggtggatgatgaataatgggtggatagacagatgttttgatgggcgaacagatggatgatgggtagatggatgatgagtgggtggacagatgtttggatgggtggatggatgatgggtgggtggacagatgtttggatgggtggatggacgatgggtggatggatgatgggtgggtggacagatgtttggatgggtggatagagggatggatcggtagatagatggacagggggatgcgtggacagacgaatgaacgaacaaactttctgagtgggaaccactgtggtaggctggacccttggctcaagatctcagggaagggagcagctctttgggctcctcaagcaggctgggacacgctggccggagctgccccacctcgaccgccactccattatcaggcaagctcagttatgcagtaggctctcttaccctcttgctttgtgggctctgggatagcaagagacccccctgaaattcccacctagagaggagcctaccttccatagatggccaggaaaggaactctggattttttttttttttttttttttgagacagagtcttgctctgtcacccaggctgcagtgcagtggcctgatctctgctcactgcaacctccgcctcccgggttcaagcaattctctgcctcagcctcccgagtagctgggattacaggcgcacaccaccatgcctggctaatttttgtatttttagtagagacagggtttcaccatgttggccaggctggtcttgaattcctgacctcgtgatccacctgcctcggcctcccaaagtgctgggattacaggcagtgagccactgagcccggcctctggatttctttaaatccttcatctttgggggctgcttcagaggcagcttcctgcagtggaaagaaaccttcctggacgtttgaggactcaagttcttttttttgagacagtttttctctgttgcccaggctggagtgcagtggcatgatctcggctcactgcaacctcctcctcccgggttcaagcgattctcctgcctcagcctcctgagcaggtgggattataggcgcctgccaccacgcccggctaatttttgtatttttagtaaagatggagttttgccatgttggccaggctggtctcaaactcctgacctgaagtgatctgcccacctcagcctcccacagtgttgggattacaggcatgagccatggtgcccggccacgactcaagtttctgaccccaagcagccactcccttgacttctggctaccatcttggcatcagttaagtgcagagtaataactactattttgggctgtgttattattactcttgttaaagatcaatcggccaagcactttaggttgagaagcctgggtattactgtctctgtttttttgttttgttttgttttgtttttgagatggagtcttgttctgtcacccaggctgcagtgcagtggcacgatctcggctcactgcaacctccgcctcccaggttcaagtgattctcctgcctcagactcctgagtagctgggattacaggcatgtgccaccacgcccagctcatttttgtatttttagtagagacagggtttcaccatgttggtcaggctgctcttgaactcctggcctcgtgatccacccaccttggccttctaaagtgctgggattacaggcgtgagcaactgcgcccggcctactactctgttttacagatgaacttgaggttcagagaggtcaagtcatttgcctgaggacacacagcccaactctgccttttaacactgaccaggcaatggagtgggagtgatgagaatgaagtggtggctcttctgggaccagaggacagttccaaagtcccaggcaaggggagttccatcttccagtcctgcctcctggttgtcaactgcgctgataggggcccgagtaggagttctgaggctccagcctctcaggccccacttgccccacccattctgcttgcagacctcccagctaactggaacctgtgtccacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagaggtgagtgtctgccctgccgcaatccattgcccccgcagtcgctccagtatgtgctcgtgccctgtgtgcaatttgccattgcagcatgtcccgagtagaagctggctttgcaccaaagcgcgttccctggctccagcctgcccccagccgccaccacccacacttctggcctctgatggctggtttataggaacactgactgcagctggtttataggaacactgcactgcctgcagcctgcagctgggtatgccagcatcttcataaaacagggatgggaggccgggcacggtggctcacgcctgtaatcccagcactttgagaggctgaggcgggtggatcacttgaggtcaagagttcgagaccagcctggccaacatggtgaaaccctgtctctgctaaaaatacaaaaattagctgggcgcaaacctgtaatcccaactactcaggaggctgaggcaggagaatcgcctgaacctgggaggtggaggttgcagtgagccaagattgtgccgctgcactccagcctcggcaacagagcaagactccataaaaaaaaaaaaatgtgagctggggtgttatcccatcccaaaggcatcccagggcctctgtgaaggacagtggggtgggcggagggttttccagtttcaaacgcaggggttttagcccttaaaaaaaatttttttttgaatctaggccagacgtggtagctgattcctgtaatgtcagcaatttgggaggctgaggtgggtggatcacttgagtccaggagttcgagaccagactgcgcaacatggtgaaacctcatctctattaaaaaaaaaaaaatacaaaaattaggctgggtgcagtggctcatgcctgtaatcccagcactttgggaggccaaggtgggcggatcatgatgtcaggagttcaagaccagcccgacaaacgtggtgaaaccctgtctctactaaaagtacaaaaaattagttgggtgtggtggcacatgcctgtagtcccagctactcaggaggttgaggcaggagaattgcttgaacccaggagacagaggttgcagtgagctgagatcatgccagtgcactccagcctgggcaacaagagcaaaactccatctaaaaaaaaaaagaacaaaagcctcatccccaccagtagctgggactgtaggcatgccaccatggctggctaacttttttttttttttgagacagagtcttgctctttcaccttggctggagtacagtggcacaatctcagttcactacaacctctgcctcccaggttcaagcgactctcctatctcagcctcacaagtaactgggattacaggcatgtgccaccacacctgactaatttttgtatttttaatagaaacggggttttgccatgttggccagactagtctcaaactcctgacgtcaggtgatccacccaccttggcctcccaaagtgctgggattacaggcaagtgacaccacaacccagctaaattttgtatttttagtagagacaaggtctcaccatgttgcccaggttggtcttgaactcctgagttcaagcaatcctcccgccctccacctccaaaatgagactttaagaggcaggaggcaggaacaaaaaccagaatcctgagttcaaatttcaggtctttcacctgctcacagtgtcaccttgggcatgtctctgagcctcagtttacccattaggacaataggaactgagttagggttagacgagccaatgtatcacatggacttggccccatgcttagcagataataagcgctcattctctccgcatcatgatttattctgcaatgagttccttgctaggctgctctgagcctttcaccaaatgaggcaggatgttaggagggatggtggatataaaattcggtccccacctgtggtgttggcgcgccctcttgtgggcaacgtggccattgaccagggtccctgatctccaagcctctaccccggaatgggggatgctgggaggaggggcttggagcgggaacagccccagcccctgcccatggggagcccctagactggcggggggtcagaccaggacccaggccacagtgagacaggcagtgaagagactcttgtccctggtttgggattgggcaaaggtacctgggtaccccaagagttggtctgcacaccctcaccctacagacaaaggtccagctgccttttttttttttttttttttttggggagacagagtcttgttgctctgtcacccaggcttgagtgcagtggtgcgatctcgactcactgccagctccgcctcctgggttcacaccattctcctgcctcagctcagcctcccaaatagctggggctacaggggcccgccacctcgcccggctaattttttgtattttcagtagatgcaatcctggctcactgcaacctccacctccaggttcaagcaattcacctgcctcaacctcccgagtagctgggattacaggtgcacgccaccacacccagatgattttgtattttcagtagagacagtgtttcaccatattggtcaggctggtctcgaacttctgacctcacgtgatccgcccacctcagccccaaagttctgggataacaggcatgagtcagctgcctttcttatgtttggtctaacgcagcagccaggccacccctccagggccccaggggatgaggccaggaataagtggaaaatcgagtcctgccccacgagcctttctgactctgggcctccaaaccctctgatcagatggaaaagaaagaccaagtcttaggccgggcgcggtggctcaccgctggtaatcccagccctctgggaggccgaggtgggcagatcacgaggtcaggagatcgagaccatcctggctaacacagtgaaaccccgtctctactaaaaaatacaaaaaattagccgggcgtagtggcgggcgcctgcagtcccagctactcgggaggctgaggcaggagaatggcgtgaacccgggaggcggagcttgcagtgagccaagatcgcgccactgcactccagcctgggtgacagtgcaatactctgtctcaaaaaaaaaaaaaaaaaaaagtcttacacaccctgccatgtgccagctgtgctctctgagcctgtaactttgcccctccgagacttggttatcccaccggcagcatgtctgcccccacacacaggcagtcccatctcttcacctgggctgataggctctgtctcctttgcacccagattcattggcctgcccctgagccggtggctgggtgtgagggatcagaccaggaggcaagtgaagcccaacgccacgctggagaaacacttcctcacggaagggcacaggcccaaggaggtgagagccccccatgccctccgacccgcactactgccctgggggtggggcgtggggatggtgtgtggcccatttgttggggcaggagaagccaaggtggctgcaggcacccctgcaatgcccctactttccactcttcatcctcaattccctgggaaagggctctaccccccagcctccctgggaaacgacgccccacccctcccagcatccctgggacatggagccccacccttccagcctccctgggagatgaggaccccccccttcccagcctccttgggagatggggcccctcccctcccagcctccctgagccttagtgggcacagttgcacaatggacagattctaggagagtgagagtagttgcttgctctcctatcctggggaggaatggaaggtctgagctgatagggaatggagtaacagaagcagccctgtgaccctccctccattcccgtctctggtgtggctgcccgctggacagggtctgtgctgtggaggcgtggctgcgtcctgagtggggtggggaatggtgaagaccacataccctagaggcgacagggcagcttccgcagagctagacgtgactccccctttacttgtcaatttccctcttcaggtagggcttggggctggggcaaggtctcaactgcctgtctaggttggaggtgagaactgaccgttctggagggacgcagggaagcctatccgggggtaggggatgctgcacgccagcatctctcttaatcccatccccgtcagcgacctgcctgccctatgaacaggatttgcttctcttagggcccaagtgttctgcagggccccacgctgggacccccaacactgcccctccatatagacatggtcaccctgtaggcaagatgtgggcctgcagtggagagggcagagccaagtcctgtctggggacatgggggaagccaccacagggcctctgtgacccttgtcctcatcaccccctccccagccccagctgtctctcctggccgcccagtgtggcctcacgctgcagcagacccagcgatggttccggagacgccggaaccaggatcgaccccagctgaccaagaagttctgtgaggccaggtaagcccaggatggggcttctggggtgcagggaagcgggccggggtggggcggggcgggtgtctgctattttcacagctccctccccatccacagctggaggtttctcttctacctgtcctccttcgtgggcggcctctcggtcctgtaccacgtgagtataccagagtatagctgactgctcacctgccccatccacctggcctagatctggcaggagtgggggtgtggagtggtgcagccagagaggaaaacatgcagctgaggagagagcgagctttgcaagatggtggtgaatgttcactcaacaggtatttggatttactatgcaccaaaagttggggttctgcagtgaatgagccccccagtcgagagtgagaagcaggaaaaagcagggctgggtgaaggtagcatctatgtgactgtggaaggagaaccaaagagaccgcagacccagggtgggaggttggattctcacctctgcacagcctgacacccatttccctgcaggagtcatggctgtgggcaccagtaatgtgctgggacaggtacccaaaccaggtgagtggcagagtgtgtgtgaatgcttggagggtgagggcgatgatcacagttgctgcagccatgggcatgggacccgaaccctgacactacactgtcattccccactgagtcccacgctctttgattcctctggggaatagagaggggccagaaaaccaagcaggagcttccaccaaaccactgcccttgattacctccagggatggggagctcactcattgggattcaagtatcctggttttgagcaaacggagtgggcccggagccatacccctgcccgattggagccttcgctccccacagctaaccttgtcctgtcctgctgcagactctgaagccatccctgtactggtggtacctcttggagctgggtttctacctctcactgctaatcaggctgccctttgatgtcaagcgcaaggtgaggccaaataagagtctggaagacccagtctctggccgggatgctggggtgctggggggtagggcagccttacaaccgcaccttgagagctccctggtgcctcctgcaggagatatagaggccatgggcccagaggccacaccaaccccctgaaaggacccacttcttggcccatagggtgggggaccttccagcatcaagcctcgtccccactatgacccaccgtctactgcaggatttcaaggagcaggtgatacaccacttcgtggcggtcatcctgatgaccttctcctacagtgccaacctgctgcgcattggctctctggtgctgctgttacacgattcctctgactacctgctggaggtgggcccgacccctgcctgacccttcccagctgctgtacccagccctcccaggtgccccagagatgaggtcccattcctcccaaccttcctgggagatggagccccacccctcctgtctttctcgggtgatgaggccctgccccctctgtcttccaggctgataaggccccaccccctctgtcttcctgggtgatgaagccccacccttcttggcttccttgggcagaggcccccgccttctcagcttccttgggagatgaggccctgccccccatcttcctgggagataaagccctgcccctctcagctccctccttggaggataaagctacacacatgtgcacacacgcatgtattcacatttttttttttgagacggagtctcactctcttgcccaggctagagtgcaatggcacacactgctcactgcaacctctgcctcccaggttcaagtaatctcctgcctcagcttcccaagaagctgggattacaggcacttgccaccatgccagctaacttttgtatttgtagtagagatggagtttcaccatgttggccaggctggtctcgaactcctgacctcaggtgatctgcctgcctcagcctcccaaagtgctgggattacaggcgtgagccaccatgcccagcctatattcacactctttacctttcctgaaaaggtaggtagttcctggaaacaaggccccaccccaactcacctggtcccatcctatagcaccttctctttgagaccagggccctggtcctgagcccatttctccctgctgccctttccaggcctgtaagatggtcaactacatgcagtatcagcaagtgtgcgacgctctcttcctcatcttctcctttgtcttcttctacacccgactggtcctctttcccacccagtgagtcagccctcccatgggggtcagggaggtgggagggcgtgtctgagattccaggactgcctcaccattggtaccctgccccaaggagctggggatcttggctgggagagttccaggaggaggcagggaagggtgtgccaggcacagggcacggcatatgcaaaggcgcagaggtgagacagagaattattattactcagcgtgcctggaccatgcagtgggaggaagggtcagggctgccagcgcaccaaagtctgcccagtaaatatttgtgggggcctcttgagtgtgctggtaacacagcagaggccacagttcaaagatcccggcccttgtgagcagacattgcatgggtgggagcagatggtaagtgaggcagccacgtgaactgcacagcatgcgaaggagagatttactaacaagaaaataaatttgacgggccgggcgtggtagctcatgcctgtaatcccagcactttgggaggctgaggcgggcgggtcacttgaggtcaggagttccagaccagcctggccaacatagtgaaaccccatctctactaaaaatacaaaagttaggctggccacagtggctcacccctgtaatcccaacactttgtgaggctgaggcaggaagatcacgaggtcaggagtttgacaccagcctggccaacatggtgaaaccttgtctctattaaaaattaaaaattagccggacgtgatggtgcatacctgtaatcccagctactcgggaggctgaggcaggaggatcacttaaacccagaaggcagaggctacagcgaatcaagattgtaccactgcactccagcctgggtgacagagggagactttgtcttaaatcaaattggccaggtgtgatggctcacgcctgtcatcccagcactttgggaggccaaggtggctggatcacctgaggtcaggagatcgagaccactttggccaacacagagaaaccctgtctctactgaaaacacaataattagctgggcatggtggcacacgcccgtaatcccagctactcgggaggctaaggcaggagaatcacttgaacccaggaggcagaggttgcagtgagctgagatcacaccactgcactccagcctgggcgacagagcaagactctgtctctaaataaaaaaaagtcaggaagggagcaggaagtatgggagaggtgggtagttggaattagaatggcaggtaatgcctcgctggcagcgtttgtaccgagagatgggagggaggtgagggacagaaccacgttgatcagaggggaagtgtgttccaggcagagaatagcatgtgcaaagggcctgaggcaagaccatgcccggcatgttagaggaagagcaaggaggcctgtgtggctggagcagagtgggtgagggggagggtaggcaggagatggagtaggccgtgcaggtccttgagggctgtgggcaggactttggctttgaccccgggggagatgggagccatggaggttataagcagagggattcaatctgacctaggtgttctgggtgccctttggcagctgcaggggaaacatcatgggaagtgtgggcaggagtgaggggacccagggtaggcgagagaagtgggcagacttaaggggatgcctctgggatcaggaggtgggaacaagcacagaaggaactgctcgaggcagcaggagctcagccctgctgggtttgaggggtctgtggcctcagaggagacatggagaaggcagtgggcatgccagtctgggcttctggggaaagaggtaatgtaggagttgtcagtccatggctggtatttgcagccagcagcctggatggcatcacctagggaccaggtatggacagagagtctcagtcctcgggcttcctgatgtttgcaggtcgagagaggaagaacagggcccatggagcatgagagtcagattacatccctcctctggctgccatcctccatggctcccacctgtcttggtttcaaggcctgaggagattaggcagaagtggctgtgagatggggagatggtggggtgcggggagccagagagggaaggggcccagggaggagggagggctgctggcaacctgttgtgccagctggtggggctgcagggctgagcactgtggagtgaggaaggcgaggtcgctggtcaccctacagctgattggggggtaggagaaacacagcagctacagccagtactttttgagatggagtcttgctctgtcacctagactggagtgcaatggcgtgatctcagcccaccacaacctccgcctcccgggttcaagcaattctcctgcctcagcctcctgagtagctggaattataggcacacaccaccacacctggctaatttttgtatttttttttttttttttagtagagatgggggtttcaccatgttggccaggctggactcgaacttctgacctcgtgatccacccgcctccacctcccaaagtgctgggattacaggcgtgagccactgtgcccagcccagccagtactttcaaggagttccaaggaaaaaaaaaagcctacagggaaaagaaataagttggtgcccagaggggcagagtaaagagtgagctttttgtttttttctttcttgtgtgaaataacagtgggattggagttgatgataaagaaccagcaggaaggctgggtgcggcggctcacgcctgtaatcccagcactttgggaggctgaggtgaacagatcacttgaggtcaggagttccagaccagcctggccaacatggcaaaaaccacctctctactaaaaatacaaaaattagctgggcgtggtggcaggggcctataatcccagctacttgggaggctgaggcaggagaatcgctggaacctgggaagcagaggttgcagtgagccgagatcacgccattgcactccagcctgggtgacagagcaagactccatctcaaaaaaaaaaaaaaaaaaaaaaaaaaacaagaaccacagctgagtttgagaagaggatgtggtgggagctgggctccaggacagtgtcccaggcaacaagcaaggaggagttcgagggaaggagcagtgctggggaacattctttccaactggcttgggttgcacagtgaaaatgaagccccgcccctcccagcctccgtgggagacaaagccccacctctgtccggctacccgggagatgaggccccaccccttttttactccttgggagatgaggccccgcccctcttaaactctgggagatggagccctgctccctgtgtcttcctgggagatgaggccccaccgcctgccttcctgacatgaagcccctcccctatgaggtgagtaggcagtcgcctgctgatgaaggggaggtgatgggggtctgaggagtagagagaagctgccagagtgccacccaggaaagcagctgagttcataagtacccgcttgggtggggttcatagtcatgaatggccagtcagggagctcgtgtgtgtgttctgctcatttagtacaagcgagagggggcctcgcgtgcccagctcaagagtgttaggtatcatggggtggggggcactagggagccataggtggttatggagcagggaaggccatgccagttagaaattcttaggactgggggctacagcggctggtcaaaccccagcctcctcctctccccctggctgtaggatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccaggtatggctggacctccccgggggccccagccctaagctcctccttcctccctgctctgagctccatccctctctctgttccccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcc

SEQ ID NO: 38465 - DNA, 19877 bp, Homo sapiens
atgtcccggccgcagcttcgacgctggcgcctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtcagcgccttcctctgctcctctaggtctgggcttcagggcacgaagagaagttagggtagaacggagccctaaggagaggtgccgtgggcgccgaaaccagctttgaccactcgatgagggccttcctgtttacggatccttcaatttatagatgaggaagctcgggctcagagaagttgagtaactcctcaggcctcacagcctgtaagtgcctgcgtaggcaggcgagagttcaaaccagatctgcctcctaaggcaagctcctttcattcccctgctgtgcctctgcggaagcactctgggtgtaaaaagcaaacaaggtaggataatccatttatgtttccaaggaacgaggatttcgtttgaaagaatctcagcactccaacagtacattagaatgcagagtattttgcttacctttagttttctatacctgctagccctttcctttaaagtacctcaaaaccacccatgaagagtggtaaaaaaaatagctttcagtacattttccttctatctacataacaatttgtaaggcttctggcaactttaatcaaacaccttctggagcaatattaaaaccacctgactgcccacttcgatgactgaaagcaggaattggatgacatcaggaaggtccaaaggcttaattcaaagaacgattcttttgtagaaataggcatgattcctagttcttaatctagtacattaatctgaggcagaacacttagatgccagtaaaaaagtatatatacatgacttaggagaagaaataaaaatggtgaaagtgtttatggagaacctgcctagtgtggaaacctaacatcttattaaaagaaagacttcagacaaagtaggataaccttttttatttgagcaaagaacaacttatgaatcggcagtacttaaaccagaaggggttcagagaggtctgctttagtagcatgggcttttataggccgaacagggaagcaaaggaaaataattacttggttggctatgactgtttgccttatttagctatgacttggtggaaaattactagttagaggttagttggcagtttctgataggttaagcttaagtttcctttcactgttgaccttgggctggagtttgcttaagcaggaaatccaaggcagttggagctgtttcagcataatggcctcccaattaaaatgttttatacaatctgaggcccagcgcggtggtagaggcagtggggacagtagctgtaaaagttcaaccagacatttcttaattttctcaatctctttttgagattgagaagcactttgtgaggccaaggtgggtggatcacttgaggtcaggaattcgagaacagcctggccaacatggtgaaaccccgtctctactaaaaatacaaaaattagctgggcgtggtggcgggcacatgtaatccgaactacttgggaggctgaggcaggagaaccgcttgaacctgggaggcggagcgggaggcggaaggttgcagttagccaagatcacgccactgcactccagcctgggcgacagagcaagactatgtctcaaaaaagagaaaaaaaaaaaacctgaaagatttactgtagtacccaatacttagtgggttaggcaatatctgtgggcactttgaaaaccaactattcaaagaagcaaaattatgcttatttgtatcttcatggtaaatggtctttttctctactggcgttttctatgtttttcaaacacaaaaactagactacatggcattttccccttatattttcaattagttcacccagctttttttttttttaaggatatctgttatatcacaggctcttagtattttttaaacaaatagaatcttaattatcagaactaaaatagaagttttgatagaaatatgagtcagaaaacaatgggccacttaatttcacattatgaatttttattatttcagtaggcaattgcttagcagaaaaaatgagttatgcataattaattctgaaaagttaaaaaaaattaaaaaaaattaagaaatgcctggtttaacttttacagctgctatccccactgtctctccctcattcattcccctcacaaggacccagtgatctcttttgtaatgcatatcccctgaattaaaactctaattgattcccactgatcccaagataaaatacaacatcttcagtggtcttggaagtcctacttaatctttccactaccgactttaaaggttttatccagttccacatacttgcaggatttctgtgctctacctacattgacctttttcagttccagaatctcagaattctcctgaggtgtagcgacctttgggctttcccttccctcagttgagaatgcaatcttttgtccataggtatatctcttccatcattctgctgatttcagcccactccgaaagtgtgtagtcctcagaaaagttttcgtgcaccatctggctagcaggtcccctttatatgctggcgtggccccctgtaacccctacagtccttaataccattgtaattaagtagttaactccttactggacctggtctctctcattaatctttatctccttagagcctagcaaaatactctccttgtaccttattggaaattcaataaatatttgccaaatcaatgaattaatgccttggaataaaataaaaataatcagtgaggcttctgtgcttcttgaattaactgtgggaagaaaatatcagagaaacacaacatcaggtgccttagaatttgacctaggtactattctaagaagctagcttcaccaaacaaacaaaaaacagtaaatgtatttatggctccatctgcagtagccagaaacttgagtattatcagacttctctcctttgattactcattcgattagtcacaaagtcctgtcaattttgcctccttaggatcttccagatctgttcacttaacgccactgctccacaattttagttgaggtcaccatcatctcttacttggattcctccaacagtttctgtattctgcctccagttttggtgtctctttaatccttttcccactgcagctgaaaatatttttctaaaatgcataccttccccttttaaaaatgcttttattctctccctttacctcaggataaacaaggtagtactaacttctcaacagagcttatgaggcctttcatgatttaatccatgcctactactctctggtccttcactaatgctctctccccaaattctagacgtcggccatactaaatatttagttacgcaaccaccatgttgtctctgcctccaggccttggcacttgccactcttccttcctggcccatccttcccctctttcccagcctggctaattacccctgccaccaattatcttgggacccctatgtcttatgcacttgtactctcactgccaccatagtgtttggtgtatggtgatgtttgatgaacggtattttggacggtcagcataatattcttggtttaaatgatggtgctcatctttgttctggcaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggtatgttgtttccagatctatgtgtgcagcaattgggaaatttatctgtatcacttgctatagtcccgactttccaaaaaagtccttttatgtttatctgtttttgttaggatcctataattaatcttagatactgtgtaattcatttcacaaacacagatctttttaaaagaattaaaccactgtatggttttgagcaaaatgttaactgccaaattagccttatgacctttacttaatcatagtccacaatttctgtttctaacttcagaacaattttactaatgatttataatggttattttggagattcatgagtaatggctttctgttactttggtatattctttctccattggaaaacttcagttaagggcttagtcttccaaaataatgaaatgtttttgcatacatgttcaaaagatatatacttcttccacaggagatgtatccttaaaggatatcattgatcctgctttcagagcatcctggatagctcaaaaacttaatttggccaaaacacaatatatggatggaattaatatagatatagagcaagaagttaattgtttatcacctgaatatgatgcattaactgctttagtcaaagaaactacagactctttccatcgtgaaattgagggatcacaggtaaaaactcatttattttttggaaacctcatattttccatatcagaatatactcatgagggtataactaatataatctttgttttatagtaatgcaatgggaaagagtttcagcacttatttcctaaaaaatttttctggagcctttggtgttcttatttaaggaattttaaagccctaaatctattctctattcacagcaaaatacaacactgggattacccccactacttgccttgtagcacagttagaagtgttaggcaatgggagaacaaaaatcaaggggggcgcctaaccagcttttaccaatgcaggacagaaacaacccaggagtagaggtagttctggggaagtgtatcacttgctctacagtctctgaattacttgcacccaaggcccagtaaagcttaaaggactaactacacagaactgtgacagctataacaataggcagtgtgcttccccactgccataatgaacatgattagagcagaaggtaacaacacaagctatcttgccagacaacagatgggtaacagaggataatgtgaacccagatcagtgatcctcaaacttggccacatatcaagataaccataggtcttaaggaaaagtaagcatgtgtttacttttccacacacatgcacactgtgaactcactcccagaaatgatttttcaaaaggttttgggtaatcccagagcccccaattttaaaaaagtttcattggtgattatagttaagaagtaataggctagacaatgagtttttttgaagacggggtgcagctccttgatatctaacagaatgcttaaaaatgtattccagtatagagcattatgagtattataaaccagtgattcctaaacctgtctcagaattacctgagagtgcttgtttaaaatatcctgagtgtattagtttgttctcacattgctataaagaaatacctgagactgggtaatttataaagacaataggtttaattggctcacggttctgcaggctatacaggaagcataatgctgacatctgcttggcttttgggaggcctcaggaaaacttacagtcatggtggaaggcaaagcgggatcagcacttcaaacagccagagaaggagaaagagagagggtggggaggtgccacacacttttaaacaatcagatcttgtgagaactctatcacgagaacagcactggagggggaaatctgcccctgtaatccagttacctcctaccaggccctacctccaacattggggattacgattcaacatgagatttgggcggggacacagatccaaaccatatcactgagattgactcagtaggtctgggatagagcttagagaactgtatttttgccaagtgtcctaggtgattctggtagagttggtcatcatgaatttgaaaattacaggtaaaataatttgagaattactggtaaaataataagcaatatgacgactgacatttctgtggttttatgcaaatagggaagatctgtcagtatggaattcaacttgtcaggagagtacaatgtagattaagaacagcaaatacctggcatacaggccacaataccccttctcctcctcacacattttggcctcagaaacttttccttcattctctagatagtgattactaataggttagaattgatgtgtggaatatatgggaaacaacctatttgacaatcctgattaagctgtagtgaaagagcagagaggaagagattgagcaaaatccttgcagtaggaatatctctttctgtctcttgagaggtgaggagaacaatttgggctacatgtcaagttcatgttaggtgaattagtgggagggacagttgcaaaggtaggccagattgtggaagatccagaatgtcaggctgaggactgtgcattttattctgtgtgtaatgggttatgtgtgtaaaatagtgtttggggaaactattctgtaggagtatgtaaaactagatgagaaaggaagatgagtaaggactgctaactgaacaatacagtatcaagggatttagtttggatttggatgatgacataatcctaaatcagcaggtgtacaataaatacatattaaatgaattaattaatggaaaggaaggggcagaacaactgtgagatgccacccaaagggagacgtgaggttagattttggaagtaagggaagaaagaatcagaaaatggccccaaggtttttaaactggtaaccaacaaaaaatgactagataatctagaggggggaatgagttttgggaataagataataactttggtttacagaattgtggtcacagaattaaagagctacaaataaatgccttgaagagttctttctacaccctcatttttatagatgggaaaaattcagatgctttaattgacttagcagtgatacagacctaactataagatagctgacactagcacccaagtcttttgctttcttgtctaatataataatagtaccatctcaaaaatatgagattaactgtgagagaaaatcctggtgaaaacactcttacaaaatggattggaaatttacttgcttagaggtagtcatttatttttctctattactataatatacctctcattttgtaataagaggcagtgataaaataggaacaaatatgtaataattttatttcataacttattttgttggaaaactactgagcaaagcttataattataaagtgctaatattcacggaattataaagggaactttgaagaagtcctaaaaagagttttgctagaataaattgttcaaagtataaaaatgttacctaaagtatctcagtttttaaaataatcagtgtttattgagtgcctaattaaggggggaaaacaacctttaatgaagttttagaacatttgtacatgtataaaataaggctaattaatatttggttaaggcaataaacataaagagacacattcttgttgaaggctggctcactattcaaaatgaaagataaggctgggtgtggtggctcacgcctgtaagcactttgggaggctgagatcggcagatcagctgaggtcaggagtttgagaccagcctgggcaacatggcaaaaccctgtctctactaaaaatacaaaaaaattagctgggcgtggtggcgcatgcctgtaatcccagctatgtgggaggctgaggcaggagaatcacttgaacccaggaggcagaggttgcagtgagctgagattgcgccactgcactccaccctgggtgacagagcaagactccatcccccccaaaaaagaaagataatactcaacatttatttgaatatttccgtaaaataagatcatttaaatgatttattcaacattttgacttgattaatctatacctgtaggccgtaagacaccactattgtcttaactgtaatattgggccaaatctaccatataaggtgattgtgaatcaggctgaaactcccaacccagtcaggttgtgccaacaggtgacatatttaacctgcacaatattttaaaaacttttgtatttgaattcttttagtgtgcctttactctctagttgctcaggggcatcaccataccctgttgtcattatacctgcttcttttaatcagctgaggtaccagcctagcgtttgaagacattttgagtttgaaggccatcttctatatagtgtcttgctcctggtcattgtatgtccaaatatatgtctgactcagtcaagtgtaagcaaaaaatatttcttagaatggttcaagttctatgtgtgtcaaaccctacattcatatactgtaagcagttccttttccttgtgtagtataaggtaaaaaatatatataattttaaaaatctgacgtaatatgcacacgtgatcatattacataaaatagtaagatttttttccacaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggtaagactctaaacatggtcatttattaataatattaataatattctataaattaaaatattaagatgtttttagtatttctaagttatatgtatacgtttttcaattgtaaggcttgcttcaaacatgtaaaaatcacttaattgaaagctttaaagtttacaaaaagttttaaagttttgattttcacttaattcttccaacaatcttgtggtataggtatatttctagatgagataaaaagaattaactgctcatgattgcataactattaagtattatatagttggggcttaatcaggtattctcatttctggtctgatattcttgtcatgaaatcacatgcttatctagaatttgacaggatatttttgttgaaataaccagtgttaaataatagcaaagatagatatggttgggcaccttcattgcatgattaataggataggcattaacttcttttagtatctgtgataaattaaaaattatattcctattagaatttgagtacttttgacctgtcattcatttgatgtaggctttgcattatcctcttcaaagtttggattggtttgtattccatcagtcaactaaataaaagattgcttgttcttttgtttttttttttaatttttatttttttgagcagggtctcactccatcacccaggctggagtgcagtggcacgatcagggctcactgcagcctcaacctcacaagctcagccttagcctcctgagtagctgggactacgggtgcatgccaccatgcccagctaatattttcatttttttctttttctgagacagagtcttgctttgttgcccaggctggagtgcagtggcactatgatagcccactgtaacctcgacctcctgggcttaagtgatcccccaacctcagccccctgagtagctgggtatacaggcatgcaccaccatgcccagctaatttaaaaaagattttttttttaaggagatggagtcatactatgttgcccaggctggccgcaagtgatcctcccacctcagcctcccagagagcttcaattacaggcatgagccattgtgcctagccacatacctatttaaagttgaaaaataacttattctgttaaaattacgaagtaattattaattgagggttcccaaactgtgtttcaggcaagacattataattatgttctatcaataaaaggttcaagccttgggaggctgaggtgggaagatcacatgaggccgaagttcaagccagcctgagcaacatagggatactttgtatcataaataaatcaacaaccaaactaaataaaccaatatgtttgggaactgatacataccccaccccatttttggttatttaatagtacataataacattaaaggctctaaaaagtaataaagttttttagctgaacattctaggtaatctgtgaatatgtcttggtggaaaaacatgttttgcagcattgggcaagaaaaggactgatagttccagggatttgttcatttttctctttgtttcctcccactatagatgacacatttcttatccccagcttacttacagaatatttgcaaaacatggaacacttgtactttctaagaaactctgagaccatcactgctagaaagttaagatttataaaacttttttgaaactttagaatctagagtatcaagtatatcatatcttagaattaatagatataattagcatactttcctgaaatgtgtcattcttcctagaattagattttgtgaatattttatttcagtatgatcttaattgttttgaatgttttctcctattcaaagagaaatggtttagaaagcaagatatagaatttatggttcttaagggatgttttataacatattaaacaatattagtgttttttataaatgtacttgtttttacaaacagattctgaacggttgcatagcttgtatgaacacattgacatatgaagagaaacaaatatgctttttctctcctgcttgactaggatataatgactacatcaagatgagcattaatcctaagaaacttgtaatgggtgttccttggtatggttatgattatacctgcctgaatctgtctgaggtaggaacagtcatttgttacataatttttattatctattatattttttagagtctctctgttttcattagaaatatataaactttagaatctctgaaatatagtttgagataaaaattatttatttttacttctatgaaagcttatgattatcatacattttcatttaataatgaaatttattttaaccttttttctgtatagtcaggttttctatggtatatgttttatttctaaataatttatatatttttggtttggcttttaagaattgcataattgataatatataacatgagcacttttgcatttctaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagtaagacttttcgtaagttatgagcatttattctattagtttttgtaattattttcataattagatgtttgatatcaagaatttctatcagttttcttttagggcataacatgcagactgctatttacatgagtaaacttgtctttgaatctgtaatcaggaactttagttccctggcgagcaattggagttttgctaatggtgaatctactctgcttgggccacttgtcatttagatgatgccataaaaatgtgcatatcacaaacaggatttctgtaacagttgacaattatgttaggatgactgttgattttgaatgggttttgggccaaaataagttactatctctgaaagcctccatttcaaagtggcctacagattctgatgagacttacatagggaggaatgaggctgagaacagaagaggtgtcataatcgactttacaatggaaaaactatcattttcaatttattttataattaaattataaagcaatgtcaaaacttacaaaaatattacataaaggaaacctgaagaaatacactaagtgattagcaattctgtcaagtagtgtttaataggaattgctataccaaaatggcaaagaaaagttacagttttcataatttacctttagcattataaaggctcttccacagctcaaaaatctaagtacaaatcctctttgaatttatttcagattatgttactttaaaaggagtactaaaatgatataagtgaagttcagcaaggatttatatgcttaattaatggtctggtacccatttataaaaaaatgactgcaaacacactacatgtcataaattataattgatatacatgtgtatgcctccacagagagctttagtgtagagctttctaaactttggaactgaaagtatatacctattagtgaaactagagtgtattgtaatcttatctttcctaaacagtgtttatattagtctgtcctgggaactgttaatattacacacacagatgcacatgtgtgcaaaatatacacacgtgtgccatggccaaatatatttagaaaaacactatatactgtacgcccctcttggagatttgtaacaacaattatattaatgggtttgagaagtgctgtaatacataaggtagtttaattgtttgacatataatcttgtttcacagcattcttagaaacatgcagttcttagaaactgtttcatggatatggtttgttaaaagttatggtaaccaattacatatacaggcataccttagagatattgcagagtcagttctagaccaccacaataaagtaaatatagcaataaagcaagtgacatgaattttttgtttccctgtgcatataaaagttatgtttatactatactgtagtctgttaagtgtgtaatagcattatgtctaaaaaaagtacataccttaatttaaaaatactttattgctaaaaaaatgataacgatcatctgagcctttatcaagttataacctgcttgctggaagagtgtcttgccttgtcattgatggctgctgactgatcagggtggtggttgctgaaggttggggtggctatggcaatttcttaaaataagacaacagtgaagtttgccacgtcaattgactcttcctttcacgaaagatttctgtgtaaaacgtgatgctatttgattgcattttacccacagtagaacttctttcaaaattggagtcaaccccatcaaactctgctgctgctttattaataagtttatagaatattctaaatcctttgctgttatttgaacaatgttcacagcattttaccaggaatagattccattctcaagaaactactttctttgcgtattcataagaagtagctcctcatctattcaaattttatcacgagattgtagcaattgagtcacatatttaggattcacctccaattctaattctcttgctgtttccactacctctgcagttacttccttcactgaagtcttgaacccctcaatgtcatccatgagggttgtaacccacttcttccaaactcctgttaatgttgatattttgacctcctcccatgcatgaatcatgaatgttcttaatggcatctagaatggtgaatcctttccaaaaagctttcagtttactttggccagatccatgaaaggagttactgtctttggctgctacagccttacaaaatctatttcttaattaataagagttaaaagttgaaattactccttgttccatgggctgcagaatggatgttgtgttagcaggcatgaaaataacattcatcttgtgttctccatcagagctcttgggtgaccaagtgcattgtcaatgagcagtaatattttgaaagaaatctcttttttttcttagtacatctcagcagtgggcttaagatattcagtaaacagatgtgctgtgagccaggctttgttattccatttatagatcacaggcagagtcaatttagcataattcttaagtgccataggatttttggaatggtaaatgaacactggcttcaacttaaagttaccaccctcattagtccctaacaagagaatcagcctgtactttgagctttaaagccaggtattgacttctcctgtctagctagcaaagtcttaaatggcatcatcttcttccaatataagatttatttgaagaaaggggtctctgccttttaaaatgtgtttgatcataattttacccgacatgggaggtttcagaatgaaaacccaaagatacaggaaaaactgtccatttttgtgcttaggttcaacgaagtatggacagctatgtagaactgtgatcagaataaagggcatgagctaatgcaaacagactgagtgggaaaactcagcaaggactgtctgttcagatttttcttggcctctctgtgaaggatttcttctcatgggtatggggtaggacctctctggaatgagggtcttaatttctttatggccagctattacacagaaaggtggtggtgggaaaggttagagtaacatttttagactttatggctggttttggggaaaagaggctctagtttctatgacccattttagggaagagggattctagtttctctttctttctttctttcctttctttctttctttctttctttctttctttctttttttttttttttttgagacagagtcttgctctgtcgcccaggctgtagtgcagtggcgccctctgggttcactgcaccctctgcctcctgggttcaagcaattctactcctcagcttcccccataggtgggattacaggtgcccgccactatgccgggctaatttttatatttttagtagagatggggtttcactatgtaggccagtctggtctcaaactcctgacctcaagtgatccgcctaccttggcctcccaaaggcctgggattacacgcatgggccactgcacctggccaacacattgtttaagctcttagaattcaggaaacattttggtgagccttgaaggccatttaatgtcacttcagaaaacaatctaattataactattttcttcctcttttttattcattgcaaaattcccattgtaaggttattagtctaatttcaatatcgttattaagtcttttttttctgagatggagtatcgctccgtcacccaggctggagtgcagtggcacaatctcagttcactgcaacctctgcctcctaggtgtaagtgagtctcgtgccttagcctcccaaatatctggggttatagggatgccctaccatgcccggctaattttttgtatttttagtagagatgtggtttcaccatgttggccaggctggtttgaaactcctgacttcaagtgatcctcccatctcggccttccaaagtgttggcattacaggcgtgagctaccgcgcctagccaaatattgttattaagtcttatatgggcagttcatggtgcccacaaacaattacaatagtagcatcaaagaccactgattgcagatcatcataacagatataataataataatgaaaaagtttggaatattttaagaattgccaaaatgtgacacagacacaaaatgagcacttgctgttggaaaaatggcaccagtagacttgttcaatagagttgccataaaccttcaatttgcaaaaaatttaatgtctgcaaagcacaataaagcaaagtacaataaaatgaggtatgcctgtaatttaaaaatatgtaacatagaatcttaggacagtatatactaccatatactgtttctttgtaatcctgaccttagtaatctgtggcttgttttttccttaatgaatgtgaaaatgcaggaacacattcttctttttttttagacgaggttttgctctgtcacccaggatggagtgcagtggcacaatcatggctcactgcagccttgacctcttgggctcaagcaatcctcctgcctcagcctaccaagtagctaggaccataggcgtgtgccatcatgccaggctgatttttttactttttgtagagacggggtctttctatattgcccaggctggtcttgaactcctggcctcaagtgattctcccaccttggcctcccaaaatgctgggattacaggtgtgagccactgcacttggcctcttttttttttttaattaaaaaaaagtggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaagtttaatggcaggcaaaaattatctgtatttatggtgtagaagatgatgttttgatatatctatacattgtgaaatggctaaatcaagttatttaacatatgtattacctcacataccattttttaaatggtaagaacacttaaaatccattctcttaggaattttcaacataatacattgttattaactatagttaccacgggatacagtagatttcttgtatttattgttcctaattgaaaatttgtgtcttgaaatatctattcttcccacccccagcctctggtaaccacctttttactctgtttctatgaagaaacacattctttaggtctcagaattcaggaaacattttggtgcgcattgaaggccatttaatgccactttagaaaaaaatctagttataactgtttccttcctcttttttttttttttgagatggagtctcactatgtcgcccacgctggtgtgcagtggcgcgatcttggctcactgcaagctccgcctcccgggttcacgccattctcctgccttagcctcccaagtagctgggactacaggtgcccgccaccaagcctggctaatttttttgtatttttttaatagagacggggtttcactgtgttagccaggatggtctcgatctcctgacctcatgatctgcccatctcggcctcccaaagggctgggattataggtgtgagccaccgcgcccagcctccttctttttttttttttcttttttttttttttttttttgagatggagttttgttcttttcgcccaggctggagtgcagtggcacgatctcggctgactgcgccctccgcctcccaggttcaagcaattctcctgcctcagcgtcctgagtagctgggattacaggcatgcatcaccacacccagctaatttttgtatttgtagtagaggcagggtttcaccatgttggccaggctggtcttgaactcctgacctcaggtgattcacccatcttggcctcccaaaatgctgggattacaggcgtaagccatcgcgcctggccccctcttttttattaattgcaaaattctgtagcaacatgaatcaagtttctgtcttatttgaagagaatcactctattgggctgtttcagcaatagcagctcatcttggactcaatattctggaaagcaaatatgccttaaccatgcataaattagtcttacatgtgcttagtttttgccctttgttcctttacaattttgagacatttgaatttcttaataatatcaaaaaggctcaaagtactagctagaatgatggcaaaattcaaaggtatatgtctttgggtttgcccctgaatcttcaataatctgtcatatttaagtacaagttctacaagttgccttttaataatgaatcacaactattactagggcatgcatggctttgtctagttctaaaaatgttaaagaatggaatataagatacagactgagatatgcttgattacaattagtctaccatatttaaatatgccgcagtgtattcatttaccaggtgaattattttccttcaaagtggtcttttttttttttttttttgagacggagtcttgctctgtctccaggctggagtgcagtggcgtgatctcagcttactgcaacctccgtctcctgggttcaagcaattctcctgcctcagcctcgagagtagctgggactacaggcatgcaccaccaagcccagctaatttttttgtattttagtaaagatggggtttcaccatgttggctaggatggtctcgatctctcgacctcatgatctgcctgcctcggcctcccaaagtgctggtattacaggcctgagacaccgtgcccggccccaaagtggtcatcttaagagactattctaattccaggagtgctgctgtaaatattactggcattaattcagaaatgcctttaaggagtttcctagatgtatataaaaataagtaaattatttttagtcacaggtctttctattttttatctcctatctttttcaccttcctttgcactttgtcctagatctgctcctttcccttttcctttgtctcttatccaatagctcatgtgctgcctgagagagactgtgttagtactagatagaggtagttgattctgggcagaaggactttttagggtggaaggtgaacataagaccagaatctaatttatggctcataatcaggtgtatgttaagtcaccaataaagtgcagacctaacagactctgagaatgtatctgtaagacctagaaaaggatgtacttttctcctccattgccattaccttttgacttggctgattcatcataaacaaaatcttctgtagacctcctagccaggcacacttctagcaactacagagaatacaaaaaagcacataagctggttttagaggaccagagcattgattccccttaactttggttgcataccagcattatctaatgaaacattaaaacacaaaacaaatatatgccctagcattaaccctggagaattctgattcaataggtttcatgtggtgtgggacccaggaatctgtattttaaaagctccgcaagtgattcagatgtacgccttggctaataatcactggctaagggcaaggaaagaatcttaggacatgaaaaggagctcaagtagaatctattaggaggctcgtttctgtaatctttgccattgttaaaagtgccataagcaataatacctagaaagtacagatgttccttgatttatgattgtattgtgtcctaataaacccataaacatatgataagttgaaaatgaacgaaataccctgataaatccatcgtaaagtctaaaaattgtaagttgaaccattgtaagtcagggaccatttgtatcaaatatagaaccatggaattatagaataggaaagtgttatgccctaaaatttttatttcattgtatcctttttgaataattggatttaggaaacttttttccctcttactgtactgtatacttcttttatttttccctttcctgtggtgctgaattgtactaaatactttaaaatctccattttaatttatttatataggatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacct

SEQ ID NO: 38466 - DNA, 16774 bp, Homo sapiens
acactcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacaggtgagtcattgtttaaacctctgtgccctttgtggagtgtctgcctgtgtgtgtgtgtgtctctgcttctctgtgtgtgagtctctgtgtgtctgtgtgtgtgctcacgtgtttgtacccatgtctgtatttgtttgtgtctgtgcatgtgcccatgtgtgtataatcaaaggacaaagctggggcggagacttcctagttcagatttctgatggctcactaagtcggattcccagaaggagattcttatttgcatttttcttcgggaaagttccggttttaaggtcttgaaaaaaaaaaacacaaaaaacttctggtaatgagaagaactcttaaagaaatccatttcaaatgacatcaacattcccaatttaatacccagtgatatctaggaagcttgtcaggttttcttgtaaactcctttttacaatctacattgtgttttctgtatcagatggctgtattctgaatgcaatgtacaggtgtacctctcgtaatctcaatattcttcacaggccccaggcaagggtgacacaggatcacagttgccgatagactcatcaatcagacccttccctggaatggccccttccccgcaaaaaagactaatgtgggatttgctctccgttttttttccctttagtggaagggaggtgcaagagattaaaaagccccaagttaagattactagagaagcgccagtcttgaatatggtgttcctgaaaacatctttgtcttcaacaacctaataacatctttcactactaataaccccatcttgattaaattctggaggtgggggtcaggtgccacacttttaattttctctttggacagaaggctccaacctctcattattgaaagcttacaacactcaatcacacaaaaagttatataagaaaatgtttactgcagtcttattacagagaaaaaattaaaactaagtaaaaatccagtattaggaaaatggttcagcaagttgagatagttgtagaaatgttatatgtccattaaacatgattttgaagcaatgtgtgagactgcctttggtattaagtatttcttacccatcggataataattttatgttaaaactatgggttttggtttgtttttaggagtcatagaaaaaaactagaagtaggcaaaaataccatttgtggttgtattacgggggtggagttatgggtagctgcttcttttatattgacacttgtatgtttatagtaaaataacctttttttttggagacagattctcgctctgtcacccaggctggagtgcaatggtgggattttggctcgctgaaacctctgcctcctgggttcaagcgattttcctgcctcagcctcccgagtagctgggattacaagcgtgtgccaccacacccagctaatttttgtatttttagtagagatggggtttcaccgtgttggacaggctggtctccaactcctgacctcaagtgatccacctgcctcgtcttctcaaagtgcctttacaggcatgagccactgcgcccagcccaaaaataaaataacttcattaaacaaagagacatatcattgtcaaaggaatgagacgccggcatcccagtggtcatggtgcattccttcagagtccacctgtttcagttaattcagacatgtttcgggctacagattttttgacttaggaaaggttttattaacctatgcaaataaatagcaaagagaacttgaaggggtatctctgtttattttaaattattttttatttcaatagattttaggggaacaggtggtatttggttacagggatatgttctttagtgatttctgagattttgttgcaccccataccagagcggtgtacactgtagccattgagtagtcttttttccctcaccccgcccccgctaccctttccccttccaccaaagggtggaaagtctgggccgtgccttgacctctgagagcctgtccccagctgacttgagcggatcatctgctggactaagttcccaccccaggcactctcactgtgcctcagatgctgtcttagtctgtttgtgctgctttaacagaattcctgggacagaaatgtataaagaacaaagatttgtttcttatggttctggaggctgggaagtccaaggccaaggggtctacatctgttgagggccttcttgctgtgtcatcccacagtggaaggtgaaagggcaagagaacacgcaggcttgtggatgtgcaagacgcagcagtgttaatctgtgctgggcgtggattaacgagggcagagtcctcatgacccaacccccttccattaggccccacctcctagcatggttgcactggggactaagtttccaaatctgctttttggaagatccatgcaaaccatagctggccccaagaaatcatcctcaatccaggtggatatttcaaagcacaggtgctgtgttatgtgctcttcatgcttggcctcattcattcatttcttaggaattagtacttactatgtgctagacactgttcccagctccaaggaaaacagaattctagcagtgattcctagtcttggctgcatactgagatcacctggagagcttttctttttctttttctttctttttcttttcttttttttttttttaagaaacacagatggaaaacttaatgttatgttttttatccgtctctgaagccagcatcatacttgatggtgaaacttgagtatttccagctaagatggggttccaggcatgtttgggataaccacccgagtctactatgtggaacccttcttctctgatgggtagagagccctaaaccctcctgttctggactccatgactctcagtcactttctctctagaacgatcttcttggtatctaggactcagtcctatttgttttgagattgattccaaacttgattccctcccctcttatccctgcagggcagaccagaccagtctgtggccatggctccttactggcggcagtgagggcatgtgggctgcttccaaccactcctgcttttcttctttccttttcaaaattcctccccttccccctttagggagcctccctcttgcccactgtggtgaggaagggagaagagactctgttcccaggaccagctgcccctgatgggtttcatattttttgtggggagcttctcttcctagataataaacacaaagtgataacattagaacattattagaatgtcaccattttgcaaccccttagtaaaatagtgggtcgaagtaatagtcttcagtgactgccaacatcacagaaagacaactggacattatttgccttctgtgggaagtgcacgcacactctcatggcaatcttgccaaaaaatagcctgtatctaatcaggtttatgtcctgaaccaccgcggtatcaaaaatacagagttcataggactctattcaataacacaggggtgtaatcagcaacatccgtactggaaatctacaggacaacctgatttcttcaacacatgaactgcaaagaaaaaaaaatacctgtatctctactgagatttgcagatgatagaatgcctgggatctgctttacacagtaccctgcagggggaggtttgggagtgtgagtgatacaaatggctgagctgattactggggaagcgggaggtgggtctatgggcccatcggaccgttctctctattgtggtgtgtacatgaaagtttctatgatgaaaaatacgcaggggtcgcccacgtttattttgatcacgaagttggttttctctggggcatattactgtgggttctgaggctttagacacaatgggaatgtgtctacgatgttttgagatcattgagacaccaacctttttttaggtagattttttctgaaacaccaactttaatccatgaacaaccacccaagaaatgctcagatgctttttacctctccttgcattagatactttggggacaagtaatagatttgtaaaaactgaaagtaatggaaggaggacaacaagccctgagaccgtcacatgtaatcattgcttttcagggtctgcaatgacccgtgcccggagctttccaagcaaagctccttttgttccttaccacagacctaaaaatggacctaaaaattgcagatggggagatggggcatggggtgcagagggaagcaggagtgtggacctaggtggcctctgagttgggagctctgtattgggccatctgctcctgaccgagaagcagccccggggttgagcttgctgagatgatgtggctccgatgttccacttgcttcagacggttgtgattctttgcagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtaagtgagggcagagcacccctttgttggtcttcagtgcagaagtctgggctgctgacccacacctggggcagatggggacgaggcccacctaggaatccccatgctgggaccttgagctgcctgtgtccagtgcgtgaggggagggggtgaggtccaagagggcagccacagaatctacaaagacaggaaatgcccttggctctgggtcaggtttcagctcagctggagtctgcagggggtggagattctggggtaggacctctggccccaaagggtcgggctgggtgcgagggattatgctggtggaagggacagcccggaagaagcctcctgggccctggccactcagcggcctaaaccagctgtcctctcccaccacccaggccgccctcctgctaacactgctcccttgctttatttaccccaacagcatcttccttcctgcctggacttggtttaccagcttggcctggattgggggtgggaagatcattttgggggtgggcggggagggagaccttctctctgtgtttcttaaaaaggctaacctgtcatgaagctcaggagtaactgtatggggcatctgcaggctgctggcctccttcccatcctgctgtgggcacagtctgcctaggcagtgaaacccagttttcacctgaaatggggaaagccagcgtgttctttatgcccattccccctgggggaacacatgcagaatcagagcctcggtttcaaattcggactctgacatggataagctgcacatctccaaattcactcattcatttactcatctaacaggcatctgttgagcatgaacccttttgcaggcctgcgttaggtgggatggattctataaccagctaaacagatgcaccaaacacagaaacacaattgcaagatgtggcacatgacgttagctatttagggagcccttccattttctcaggggggtggttcctgaaggatccccaggggatacaggggaattggcaggggtctgcctggcccgactcccagagctagtggtgagaagggccagggtgatggtgagaggctgtctgcagagggggaccctggggagagagtcaaggttaccctgtggtgtgcagtacaatcctcttctccattagcaaggagatctgtacccctcaccccccaagtcctgatattggacttggcttcctttaaaaatacatcaaaatgccaaggctggcctgagggtggcctcagttgagaatagagcacacagatgggggcctcaccaggcctggatgttgagagctttgtacctgggtggctggtattcaagatgcagagagaggcagcaggtgtcaggccaggtgagctggactggggatggatctcactctgacacggaggtctgcacactgtggctctctggctgttcttgttgttttgtgagtaaggttctgtggagacacaactctacctcttcaggtacttaccctctgtaaatgatattcttgctgttcctcctcctctattcactctaaaatggcagcagggttgagtggttgcagcagtgaccccatggccagtaaaacctaaagtatctgctacagggccttttacagaaggactccatgacgccaccctagcagagcctgcaggagccagcgcccaaaggcactcactaggtgagcgcaagcagggctgagagattccgagatgcccggttggagcgtaggagggtgctttggattcattgagacgtgcttggacgtgctcagcccacagagagctgtacccacagagcacccacctttcttgggtgggggtgggggggtgatgtgtggggtctgtgaagcttcagggtggtgccgggcattctgtattttacaggtgagggggatggaggccccgacaatgaggcgcgaggccctagttcctttcattccagcaagccagggtccgagcatccccctcacacctgccctgcctgtaccaattgcctgccctctcttcagggggcctaccagggtcggggggtgaacaaagctgggcttgctggggagtcctaggccaggttgggggtctttgcttggggggcaggcctgtatgtctcactctactcctggtcctctgtctggccccgcaggggccatccccctgccggcagctttcagatgaaagccagggcctcccttcctccaagcccctctcttccaggcctgggtttatctcctctctctgaggggaaggaccgttctacaggctgggctctgcctttcacccagaactggtgggtggagtctttgttcccactctgggtctctgtgatggggccggggtgggaggctgtgggctgtggcccgtggcacaacggggagaggagaacagccagattaggttagcctgtggctcatgagctgccttcatcccatcagcctccaaccctggggtccgcacttttgtattgagcacctctgtgtgtgggcagctgtgccgggttgcggggttagaaatgtggaagctccttcctttgctgttggctgagtcccctgtgggaaccatggtctcctctgcttccatccaagtgtctgcgtcacaccttgggataatattacagcttttagaggtagatattactgtaactatggatagatgtcatgcaatttattattatcattatgttaatttttttgagacagagtcttgctctgtcacccaggctggagtgcagtgtctcactggaacctctgcctcctgggctcaagccatcctcccaccttagcctccagagtagctgctatcacaggtgcgcaccaccatagccagctaatttttatattttttgtagagatagggttttgccatggtgtgcaccactgcacccggcctatgttaattattttattattattttttttgagacggagtctcgctctgttgcccaggcggagtgcagtggtgcaaccttggctcattgcatcctctgcctcctgggttcaagtgattctcctgcctcagcctcccgagtggctgggattacaggtgcataccaccatgctgatttttgtatttttagtagagacggagtttcaccatgttggccaggctggttttgaactcctgacctcaaggaatccaccacccttggcctcccaaagtgtatgttaattattaatcctcattataataattacatgatcacatattataaatgtggatattgccacttttaggatgaggagatgggatgtgctcactcctttaacttacgtgctttgggggaagagtgatctgtgttgcacaaaaaccctttgagagcagacactcctgcttcttttgtcacgtgtggcttcagcttttatcaagaacactgggctcctgtccaggggagagggtaggccaggagcagagcctcagaggagaatgggagtgctgtcctcacaggcggcctggaaatgcaggaggcagcacgcccagtgcttggctgcaggatccccgagggagggacaggatggatggccacaggcatgccactccttccctccgtctggattttttccctgtgaaacgggagtgtaaacaccttcctggagtggcctctccatgaaaggttgctgtcaccctgggtggcttaaggtcaccaaggccggccctgtccgaggggtcagccttcaggaggattgactcaggtccctggggccctcccgagggtctggttcagtcgacaggtgtgtggggtggggcccacagcaggacatgacacaggtggtgggctcagctcctggcaagacaccgtccatccagaggaagcaggaagcagagccagaaagggacatggactcgagccctgaagctggaaagccaacgtgctggctggagccagaagagcaggcaggagcagaggcagaacggacgggagtccgagggacgggagtccaagtgagcgcagcctcccgcccacccccgccagggcctgctgcggaggtggcagctttaggagcccctgctgtgtcagggacgggggctggacctccccatggactgcccccactgtcctaacaggccacagcaggggagattctgtgcgctgctgactttctgcatgacatcttttggaaggatggtgacatctagtgcttgtgtgcacatttgccagctgaagccacaactaaccccagacttgttgggctttttccaggaaggggacggtgacaaacaggtactgagcacattcaacttggcaccagctgacttcccttctaaatcgagaacgtggctgacgtcctagagcccccagaaaataagtttccatttcatgttcctttcaatttgtcatcagctcactatttttacaaaacagccaagtgctacagagagggcttcaatgagcagaattggctgtttatttaaattaaaaggtaaaaaaagcaaaaccacttaaatgatattaacatttagtagagaggctgggcgcagtggctcatgcctataatctcagcaatttgggaggccgaggcgggcagattgcccgagctcaggagttggataccagcctgggcaacatggtgaaaccgtgtctctactaaaaaaataaaattaaattaaaaaaataaaatttagtagaggaacttttttttttttttttaagatggcgtctcattctgttgcccaggctggagtgtggtggtatgatcacagctcactgtagcctcaacctcctgggctcaagcaagcctccacctccacctcttcagtagctgggaccacaggtgtgcgccaccacacccagctaatttttgtgttttttgtagagacaaggtttcactgatcttaagctcctgagctagattgatcttccctccttggcctcccaaaatgctggggttacaggcatgagccactgtacccagccaaaactttattttttaattacattttggccttagccatggagatatagaaatgtggttagtgggtttctgaaaaaggttatgataataaatgcatgctgtcttccgggtcagagccacggagtgcacgagactaggttgcctcaaatacctgtccaggggcccacctgagggccttacatctctgcagggaagggaagggtctatgttctgtaaatagccaaacattgactattattatgcattatcattgcttggactaaaacccatgccctccttggaaatttgctggaattttacattagtgtaaattcaaccaccagccatcattttccctcccctcctccccccccttctttttttgaggcagagtctcactctgtctcctgctgcccaggctggagtgcagtggcacaatcttggctcgctgcaacctccacctcctgggttcaagcgattctcctgcttcggcctcccgagtagctgggactacaggggcatgccagcacacctggctaatttttgtatttttagtagaaacagggtttcaccatgttggtcaggctggtcttgaactcgacctcaagtgatctacccacctcggcctcccaaagtgctgggattacaggcatgagccactgtgcccagcctccagccatcattttcaacatggaaaaggaaaatatgagaggctaagattggtaaatggaggaagaaaacctgaattttatgctcacgtttcaccctgcgccagcttttaagataaaaccaaattcaaactgagaaatgtgatttgaagtgatgggaaacagaaagatgtggataaaaggcccacgttttaagacaacaagtccacaaagagcaaagaggacagaaagaagaagcaaaattcatatgccctttctctccttgctcaggcgatttaacagccaccctgggtgaagggcaccattagctcctgctatggatgaggaagctgagacttagaaagtttaagcaagctgccatcagatcagctgatgggtgtacatttatattctgggcacggtcttcattctggcaccattgtcaatccagtggagcatctggtgtgttcagaggtttatagccggttcagtcccgacagttgccccatctaagctggaaatcactggtcctactgtctggatggagactgcagctttgtttgacctggggagttggtctgacttcaagttcctggacctgcagggaactgcaggacatgcgggcagaagagcccaggcagtggtttccgtttaggaagaggttgtctcatgatagagaagcacggtcttgctgcaccatgctggaaagctctgtccagcctcctgttctctgtccagcctcctgttctctgtctagtgggtgcaattgagtttctcccacccgtaaagaggcgattaagtcctaacccccggaacctgtgagtgcgaccttatttggagagagggtctttgcagatgtaattaattaaggccaacaagatggaacttaggatagcccttaagtccagtgactgacatccttataagaaggggagaggacacagccacagaggggcagccacgtgaagacagagccagagatgggggtgatgcagccaccaggaacaccagggttgccggcagcccctgaagctggaggaggcctggaatggattctccttcagtctccggaaggaaccaacccagccaacgcatcagttttggacctctggcctccagaactgcaggaagaaatttgctaatttgagccactcggctcatgggactttgttttggcagccgcaggacactcatgcactgtccttggagtgtaagtttttattttaaacatgtggctccatttgccagaatctccccaacagaccccaaacccaatccagggtctaggcagggtagcagctttgacaggagcctgtcggtgctggtggctcctccatgccccagacaccttgccttcccccgccccgtcctctccagttctgtgtataacacattcctgacaagccacacacaatggggcaaaacattttggagatctataaaataaccattttaaaatcatataactttggaaagcaaagggtagaaaatctttaaatgaacagtgcattgcccaatatgttaaagtgcttgggagtagttgtgtgtgtgtgtgtgtgtgtgtgtgtgtgtgtgtgtgtgttaagcaggtacatggctgagtaagacaaagcccctgccttcctgggggagacaggtggagaacgcaggaggccttgcctctgggtgtgtatggggtgcagggaggcttccgtggaggcagggggcccagcagcccttccggggttgccgctggaagatctcagaggatgcctaagagttttctaggtgaacaagaggaaggataccatgcagaggggacagtagagaagggtgttggtggggagcagcattgggaaagtggggaggttagcaggaggcgaggaaggccttggaggagcctatgcaatcgtgactgcctctgtgcaagatgggtctggcaggcgaggggccggtaggccgggggtgcccagggctctaggggttcccagagcccagctgcatcgctggaagctggcagggatgcatcggactcccagtaagtggagatccctttcacggcatatgtagcccagagcttttgtattaggtcctggagagatttatcttcccatccaaagcctctccaaaggccccatagcaatcactcccaacactttgctcgatgtggaaggctccatctcccagaagaactgtttgctcaacctcctggccatgcgggcgtgggagatgcatggccagctgtccctctgagcccattgctgtgcctgcggcttgccgtggtcccacctgagccgcatgtggcaacctcgtcctctgagtaagccctctgggcctccctgtttcaggtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggtagggcccgccttgaggcacgtcccaccctccttcccaagcacctgccttctggtttctccagtgcaatgatgccatggcgtaatcacaaggaacagagactccattagtgagcaacagtcacctcctccaggatggcctcctgacaaccccccatcctcctccacagtggggttctgctcctccgtggtccacaaagaacatgccgttgccatctgccactcagtagttcctggtgctgcattagggtcagggtttggggtggtggccagtcccccagactctcttgcacaaagtggtcctttgaggacagctaggcgtgggagattcaggagctcgaggcctgacctgaaataccccgtggctggcagtctcctgggcctggtcagggtgaaggatctgatgtgtgtcctagcagttttctgcctggccgcacaggtcacccaggacaggaacgtgccctcctcagaggaacggagcagccctgcaggtgcgcccatggccagttggattctgtgacattttacacaacgtgatcagcaacactggcttccccctcccggaatagctaatgaccacctataagttttgtttgatgttactttttttcttcttttctaggattccttcctcaaggctcagcagtggctgaaggacctggaggaggagctgcacccaggagaagtcctggtgatgctggtgggcaacaagacggacctcagccaggagcgggaggtgaccttccaggtaccgcccaggagaccctgctctgctcttccacagcaggagagagccctgcccgcctgtgtcaagaccttggcactcacactttcatacacgcacacccacacacgcacacacttacacatgtgcacacacacctctacacgcccacatgcatttacacacatgcacaccccccacattcactctcacttgcacccacacacatttacaagtgaacacacacacacgcacacacacacagctttccacctgagtttctcttttagtcaaagatttccggtctttcctgaaaaactcaggcccagtgcaatggcagttcaagcccagtggccggcagagggaagggcagggcggcagctgcagggtgggctcggcttgaacgagaaaagtgatctagttcctcagcagggctcccttccctactctgttcccagaaggggcttctgtgcaaatgtagcctccttcactcgagttttgtcagtcctccttacaggcagaggcagcggtcacccaggtgtcgctgttgtttctcttccacggcatcccacctcccccaccacatttaggacgaagaccgtgtaaacagctgcagacaagtggctgatggggagaccccacacacactagaggctggcgcaggggaagacccaactcagggcttagaccgacgggcgcgcctcccaaagagaaaaggccccagcttcaatggaggctgtggagagatggagaagtggggtgaagattttggagaatctcgggggagagcaaggggagcaaagggagacagcgtcagtctgagccctcgttgcaagttggggtgggggagagaggatcctggcagcagagctgtgccctctgagagtgactacatgggctgtgtgcttgggcaggcacaaaaacatgggcacgaggttactcaaggcttggaggggcagtgggcggccagggtgggtttggagcgtctgtctggggagctggctggggagctcagtggggacaaatgcagggccggccgagggatctccgggccaggacaggaggagtgcactcacgatggtggatggtgcgagagctgggggcatggccggccacacctgctgccagctccatgtctggctggacagtcaggagcctgagctgtgccctctgggatccaccacaggctcctcttcctgggagagtcccggaggccaggggaggggcctgcacaggaaggcccccattcctcggccaccctcgactcctgggcaaggctgtggccttcccatgaatgctttctcctggtcacccgttgcaagcctgctgttttctggtttgcctttgctctgggacatccatttctccccagaggagagctgtgttggaaaatgagggttccccagaagaagggcccaggtgggtgccgtccaggggcctccctctgcctcatgtttcctgggttctcagttggttctttgcccagcatcaaagcccacaggtgccaacaggcatgatgggaggggaacctgggggtggggacttggctttccaggccctgcaggaggaggaaggccgcaccccgccagctagaggaagagcctcttccagggagcacaccccgcccctccctggtcctggctgctcaggagtgccaagaaacacaacttggacacgaaacgtggaggagtgcgggctccacggctgcagctttctcggatcttactgttggaagtgaaccaggtgtccttaggaaactctcttataaacagcgctggattttgtggctgtttccttcaggaagggaaggagtttgccgacagccagaagttgctgttcatggaaacttcggccaaactgaaccaccaggtgtcggaggtgttcaatacagtgggtgagtcacgtccccgtgggccagacaagggggaggtgcttgtccctgaccaacttccctgggtccctgttgctggtgacgtggtatcccatagaatgtctttagggactggatggtgaccaggaggggcaggaggcccttgttctatggttcagggtaaacacaggaggggcgggtcctggggtggctggtctgcagggctgtgctgggctgggcgacttccctccctagccagccccctcctcttgctgttcacagcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgacaatctg

SEQ ID NO: 38467 - DNA, 5565 bp, Homo sapiens
actccacataccaccagcaccgctaatacccctgtagaaggagctctccaggatgaagctccagactgggttgtagggggctcagacaaaagagaaactgcccgtcttcaagaaccttcaatctaatggggagacaggtgaaccctcgcccccgtgggaactgccagttggatagggaagaagggacacagcagagagtcacagcacacaggaagactatgtcacactgccaggtgctgtgggaggacaaagacagtcagtgctgggggcatctggactgggtgtgggcccatgtgagcaggagcagtcagagaggcctccctgggggaggaggcattggagctgatctgggacggaagggacggatttggagaggacagcagaggcccttaactgcaacctgggcagagcagagggcctggccgcctctcagaatggcctccaccctggcccagggcaaggtcagtcccagctttgctgagcaagcaggtgggtagggaggggcttctctggctcttccgggccagcctgtctccataggcacatgttcaaaccacctcggcctctgaagggctttgggtccaacacatctaggttcgaatcccagctctgccacttacgcaactgcgagccccgccctttccaagaggcttcgcttccccgtccgtaacatgggaagagcccctccaccctcccagctgtgtggggatcaaacggggccgtgctggacagcttgcagccaggagcccatgcccagaaggcattctagaactcagggctagaataattgtcttccggaattctcttttacctctgactgaaatcccacctaaggcgctcgcaggcatcacctctgacacagagatggagcagacagttgccgggaacacaaccttctagacctttaaggagaaagctgccaactttgtcctcttggggctgctgaatgttctgagagtcagagggagtgcaggcacagaatccaggtccccatgggggctggcaggggacagctgcacattttacaccccctggcagggctcaacctttccttagagatgggctgtgaaggttgtctgccttgagggaaggagctcctgacgtcacagagcggtggtgcttccacctaccctgtccccaaggagcctgcacactgatggaggaggtacagccgtggaggagaaccagagtctggaggggaggcacagtcctcaggagcccccaggctgacgggggaaacaaaacacacaataaaccccaaacttgcaaggttctggggcaggcaccgaggtccgagtggcaaggagacaggatccagccctgtgcagtggtgaggaggcccctggggctgctgtgatcagcctggaatgtcaggctgtgagctcagccctctcggcctgcgtgtcgggctgtcagcagggccggcgcacgggagaagatttccagccccctctgggccatggagaggcctaaatttagctagtagacaaggggctggccccaagcccagggacagtcggccttataaagcggccgcagtcggagcctggcacgctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccaggcaagtgatccgggccctgaggggaggggaggtgcacagggaggggacgtctgctccagggcgccaccgaaggcgctgtggctgccggtcggcctggaacaggtgctgcacagcctgcagccatgtgtggccaccaagacagatgtggccacagggacagatgtggccatgaaaacaggtgggcctctaaggaacagttgtggccctgggggttggacatggttccatggccacccatgctctgtaaccacagccaatcccagctggagccctggagggctggatgggtgagcggtggggggcagcccccaggctccaggcctggggtggggttgttacagacctagcctcatatacacacacactgtgctgggtgaggccccacccccaccccagaaaaggtgggctgtaggaatgaggaggagcttagggagaaacagctaggggggaggtagggcctgggggagccgccccttgccccaagagaaggagccagaacccccggatctgcatgcaaggcctgctccatgcctcgctcacagcagcccatcccacagcccgccccggtggggcaggcaacatcaagaccctaggagacgcctatgagtttgcggtggacgtgagagacttctcacctgaagacatcattgtcaccacctccaacaaccacatcgaggtgcgggctgagaaggtgagccccccaccccctactcaccgcatcccaaattctgctcctgcctccaatgtctcctactcccccttaccatcctgggaccccagaccctggccagtgtcccttccccacccaaactcccccagggctaactgaaggccttgtccctgcaacccatggccatggggccccctcactgcctctctttgcaccgaggttcccagatcctttcttccagggcctgagcagctgagggagcctccgaggaatgggagagggatggagggatgtgggcagagggagcctgagggggtggggcttgagggtgggagatgacaggtgtgagatggtgatggcagagtgaggacagctcctctggtagctataggggggcggatgcgggtaggtggggaactcacctgggcagtggggggaggggtttctccatgtgacccacctcaagccctcttccctcccacagctggagacccatcccccatcttgggacccctaaattaggcccgaggctgggcaggggccctgcagtttcgggtcacacacactccaaaccacacacagcgcccgcccacaggtctcagggtcactgggtctctagcgtgtctgagtccgaacttctaggaggcactggggcctccaccctggagagggtatggccaggcctgaacaggggcgttgcccagggacagccacggctgccaggagagaggagaggacctgacccaagcctcctcctaagcccccaaggactggcttcttcccctccacattcaagggtggatttctgggcgtccctgccagggatgccatggactgggggcaccaaaacccacaggcagcatgtgccagccctgccacccccaacagtgactcagccgccccaaactcccctggacactatgtgctggctgagttgcgggggaggggccggcgctcagccctggcgggcagatgcccaatgtgcccggggatccaggaaggcacggctctcctctgtcacctccacgttccccaggagccccagattcggagccactgccacggagcctcctctctctccaagccccacctcttccccatgtccctggcctgttccttggagctactggagctctgcgaagcacccctgcgctgtccctgcagagcctttggcctgtggccatcaccaccctgggcagcccctcggcacctgagggcagagcccctcggcatgtggggtctggctggggttagaatggggagaagagggctctggcttgtcacaagcaggacaggggtcggggcagcctgcctgacgggtcaccccttccccagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacagacagacaaaccctctgatctatgaagtctctgcagggcaaggggaccagggacctggaaccctcttggccaaggggagtgggagggacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccaagtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaactgctgctctcaactccccacctctgggcactgaggagtatttcccctcattctacctctctaaggctatgcaaccctccccacgtcttccagctgggggatgggggggagtcataggaaaagcccccatctcccatctgggatagggaccttccatcagccttaaccctgggaaatgcctgctgcccccaatgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacag

SEQ ID NO: 38468 - DNA, 34058 bp, Homo sapiens
aactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtgagccggcccagggtcctggcagcccaccccggagcccagcgcctagtccctccggtcactcctggtgctccatcccagacaggggaccaatgggaagccttcagttgagggctctgaagagatctgtgtttgtgcaggcgtcaaaatcttaccccacaatttttgctggtcccccttcccatcctacccaatacctgtccactctacttggcccttggctgtggtggtcaacctgaagtattcaagtgtaaagccattcccagtctccccatcttatggatgatgaaaccgaggcccaggaggcacaatggaagagctcctggtctctggagcgccttatgttggtggggatgtcttacgtcttcactttttagcaacacatcattcacgggcaaaacctcttcccttgtttttcaaggggcttggcactcacatgggggcctcacagttgcagctgagttctgatgggtgcgggcctgggaacggaggtggcctggggatgctacttgtcctccttttatcatttccttctctaaagcagagctcctgtgtatatatcttggagactcaacagaagctgagtccagaagcagaatgctttttttttcccctttctcttatttgatcttaatggcttaataataatattaaagacgcttagagatggaagggatattggcattgtctcatccagttgctgagtttgcaggtgagataaccgaggcgcagagaagttaaatgaattgtgcagagccatctaaagagtgggcagcagacctgggatgttaagtcctagatgcatgtgaggagatgcttggctaaacgcctgtaactctgagaatgagtcatccattcccttcaattacagaatccttgggctggagggaggctcaagaagtcaatttgttcaccctgcattcagagaagtccaccagaggcccttcttatctttagagaacaggcttcactccagtcctcaatcttcccaacttcaaggccagccattttcttggccccttttatagccattccaaattgttgagaatgctgtggccctctgtcttaagactcaggctcccacagcttgagaatggagtttggtggccccccaaagtcaagtgtgctcatctcctgcagagggtttggaaagcaggggtacccttattcctattccttggctgtttgagcatccacagcatgtgaaatgctgtgctttgtttggtgaggagtgcagaaaagttaacagtctagttactaattttctaggtactaattttctctaacatccaccttgtaacgccagccttctggaagtagcaccatgctaataggtcatgtctaaacacaacaccacattgagtttgtccttgtggagtgcacagcctagggctcagcagctttaagaggccaagtgatttctgaaggagtttgggaggtgatgggcctgttggctcttgtatgttttatattgatagaactgcaagaggccttagagattaaactaatccattgcttcttaactttctatctttagaaaaatgtacgtacatcccaaatttgcatataatgttgggggtccaagggccttctttggactttagggtgggaacccctgatctaagccatgcttcttgttttattaagcacccattgctgccaaaggcacttcagagctgcctgggttgcctgcagagtttcctttgtgagccctggcctccacttggcccattcatgcctcaggggaagttcaggccatttgcagatggcccttgccctctcagccttccctggctctctacacatatggtatttataacctttcatacattatctgtagcttctccttcctggtgtacaatcattgacaagacaacatccatgccttagcatctctggggccttgcccagggtctcggctataggaggttcccagtagacattttgcagaatgggagggaagatggggagaggtgaggatccccaagcagcagacaggtttgagcgccttttgtctgagacactctcccggctttgcctaagtcatcactggctgttaactgggtctaagaaagtggcagagtcaaattgccacagatgattcctcatctgagggagacagtaagaccgggagaggcagatcgctcttctttcttatcctccatgtgcagtagttccctctccccactcatgtcagcaactgaatttagctcatgcgtcaaaagctgtctccccttgagggagtgtcagccagcgctgtaggaggggtcataccacagggaaccctccagaaccaaatcatgtacttttcttctttctcataaaatccagtaaacagttgtttttaattggaaaatatagaaaagaataaatttaaagaagaaaaaaagtcacccataatcccatgacttaggagaagctattttaatttacatataaaatatatttatatataaagcatataatttatatataaatatatttccagtatttgtagctattttatagcacagttgagatcatgctatacatataattttgtatgctggcttgtttatttttgtttttgtttttgagatggagtctcactgtgtcacccaggctggagtacaatggcacaatctcggctcagtgcaacctccgcctcctgtgttcaagcagttctcctgcctcagcctcccaagtagctggggttacgggcacccgccaacacgcctggccaatttttgtattttaagtagagatggggttttgccatgttaggcagactggtcttgaactcctgacctcaggggatccacccacctcagcctcccaaagtgctggggattacagacgtgaaccactgcgtctggccagtttttcttacttatagcatgaacatttcctatgttataagcgttatttgtcagcattatttttaacaactgcatactatttcactatttgtatatacaattattcattcaactaatgaatagcattgtttttaacagctgcatactattccattgtgtgtatatacgattcttcacttaatctacttctcttggatgttttaggctatttctaattttttgttattgtagaataattctgaatatctctgtgtataatattttttcctatattgtgtgtgtgtgttttttttgtttgtttttgtttttgtttttttgagattcccagaagtggaattgctaggccaaaggttgggcagggttttgtttaaaatattttttaactttaaaatttttgtactaagagtcatattttgcagttgttttccgagagggtgagttgacactgcatcccttccccattgcgagtaaggctgctctggggtggataagtgcgtccatgcctaggtctcagaaggcctcctcctctcccttctcccatccctgcttcttgccttgattcttgtctccatgccaggcctgaacctgtgaggggccttttcctcagaaacaaagatttgcctctttattcccccagttcttggcgttttgcccctgagggtccatccactttcagtaatatgtgcttgccacagcgtctatttcttgtctgaggaagaacacacagaaaaggacattcttttaataactagttaatgtgctgtgatctctgcctgaaataacttccccggcctaaggcccggcaacacagagtaataaaatgaacagtaaattggcttggcggctgccctctccaacacaggctgcctctttggagtacagtagctctgtgtccctctggccctggcagcctttcctcctgcctctgctattcttctccctttgctatttctctgcccggcatgcagccttgaatccctccttccttggaccatctggcccctggtcactccttctcgctgcctacttctgtggccccttattctgcaggtagtggaggtgagtagctggctgctccaggggctgaggaaggcctgagtacttccatgggccatgagggaggcctccctggaccttggcagagctgagagagaggctctagtggattggctgtggggcctggggctgcagagctaagctgccccgggctccttggggaggctgggctggtctggagggttgcacggaccttctatcgtgtgacttggactcttgaggcatgagcacttggtagggctgctgggatgggagtccatcgtgagggctactgagctggccctttcagcttctcccacttcaggagactctgcaacctcccaccccaaaggtgccttcgcatttgctgtggccgcaccagctctcatcaccaccctgacatccccaccccaggcattacagcgccactgcgccgggaaagatggttctccagaaagccaaagggatagagtgagagggccaccaccccagtagacccactcactgcaaagtccatcctggcaggcatagcccctgcaccaccttcagccctgtccacccaccaaggccaggggatgtcctttgtctgatagggttctgatctgctgggtctctaaaggggcctgggtgaaaatccacctgcttcttacaaggcctaagtgttacacaaggaagcagaaggccttaggccagaggaactgtgtccgcgtgcctcggcctggcttaggggctgccttgaaagtcaggtgcctggcagtcatcaggcaaaacatttactgggaggagaaagacctttggggaaaggtctccctcccattcccattgacagtgggacgaaggccatggaacacagtccaagtcagcagaatccagctccaccacttcctgcccagggacctggttaggaaggtctgacagaggtcaggccacctcccctttctgacccgcagtttccttatccataagatgcgaatagtaataaccgcctcacagcattactgaccggattcggggtggggagggggaggcagaaccagtttagcaccagctgtgctccaggcaccgcgcatggggctttatcatttcctctcctctctcgagctgactctaacaggagacttagaggcaggctctcaggaaggtgcgggaaggcccttctccagcacgaaggggagggctggagaaggggcacgtcgctgagctctggggacggtgccgggtagtgccctgggcgggctggcctgtcgcaaggaggctggactgtctggccaccagattctccttcgtgctggaatcccttcatcacatggctgagggtgctttcgacagggccaattatagctgctccagggaacacggagctgactcatgcctcaacttggccgtggagagtctcccatccactttctcgcttgtgtctgtgggatgcgttacagactccctcaaaccccatgaggccgacagggcaagtattatcatcctggactcagtctgtcctgtctcccctcattcttgtgcatccccgtctctgctgttcccaccctggcctgaattaacttttcttttttcacactgctgtgggaatgttttctcctggcaacagaggcaatctgtatcgcttcccataaagaatcagtgcatgagattcctcaatagatttttcctttctggacacagtggtggctttgttacaggggcacctgctgctgtaagccatacccaaatgtccctgagaatttaccccacccgactgtgctgcctggacttgctggtggcctcattagactcagtgtttccccagacccatgtgtggtcagcaagttttgggtcatgtgggtttagcaggacaaactctaggcccttgcctgaccacctcgggctgcagccctgtaacttccccggaagccaccctgctaggctgggaagccttcactcatctgctgagaacaccacgtccctctcaggggtagaatttgagacgcctgtgtgagaaggatccttcattgctgctgtttggccctgttcattctgggcatttttgaggctgcctcagaatggttcttttcagccctctctatttcagctgtccctggagcctttgatgatccctacttcccgcaatccactgttgctgctcccttgcagagccctgcttagggcttctcatccacacactcactaggtcaggtgcctgggcaggcaaagatagatggggtttcccaatcagggtggaatctttctcgtgaagggtaatcttggccgactgtttgtaaatccaaaagtgtccttttagagcccatggagccagggacctgctctgatcatatgatagcagcagctttgggatgccacaccccagtcactgaggccaagcagggaaccccacagctgatatttacagagatgagtacactcctgcgtttgtgggcctcaaagcctcacctctcctccaaggcctggccctgcctgcctcctgccaaaccatatttctttgtggccttcttgtcccattcatcgttctaaaagggagctcaacccttttggcctgtccctaaagatggctgcatttcctggtcaaggcaggaaaggtgagtgtagtggttaggagcgtgaactcaaatccaagggccaggttcaaatcctaaccctgttactgtttactgagtgcatcacctggggcacctttatctcctcctccttcaaatggaatgataatctaggtaatttaaggtactggttaaatgcttaacttctgcaatgaatttaatccccagaactccctgtgagataggttttcttattaggtccatttgatgaggaagagcatagtgctgatatcatagtatgtgggaaggtgaaacgagataatccatggaaaatttagaacaacgtccggcacatcgcaggtactcagtcagtctgaacgattacccgccatgttatggagtgaggtactgaggttccctgagttaagtaccccctgaagagcatagccctcaatgttagagaaagcaggttggctggccccaggccactgagattcacagcttctcccaggaggccctgaaggagaaggtattctgagaaggcaggaagtgctagccaagggtgcagctgttaggattcactctcatcacaacctcggtgccagctttcaaagtgatcctctgaccaggggaaatcctgccctctcactctgattattgaactgggatctggagagatgaggggcttcccaagacaacctgaaacccatctgtgccctgtgtggcgggtggcctttggacaggagggctccaactctcagcagatcagcagcttcctccagggctggctgccgaggctcctccttggggacggagcccacagcaacctgactttaactaccatggaactgcagagtaaattcacagctcagaacgctgctcaaaggcacaaatgggatgttgatgagtgggaggaagccctggcaagcctccctggccaccacccctctgtgcagaccaggcctgctgctgcagtccacctgtgcacattacaacatccttcatggttacaaagcatgcacacgttgtggggaggggtgtgtgtgtgggtgttgggtacagaaggaaggcattgacagatagaaggtaactttttgacacctgtttaggtagtgcaggtaaaacaccaaacacatttaaaaacatagcacaattataatctttatctgggaatcccaccatatactattacattcgtaatgaaattgcctaatacccaagggcacaagggaggactcatttgctgaacatacctattttgccaggtactatacaaggcattttgaatgtagtctcttctttgaaagttggaattaaatggataatgacaagaaagatagaatgaaaggtgtgcaggttgcttctatgctaaaaaataagatcaggtggctgggtatggtggctcatgcctgtaatcccagcactttgggataggccgaggcaggtggatcacctgaggtcgggagttcgagaccagcctggccaacatggtgaaaccccgtatctactaaaaatacaaaaaattagccgggcgtggtggcggctgcctgtaatcccagctactcgggaggctgaggcagaagcatcacttgaacctgggaggcggaggttgcagtgagctgagatcatgccattgcactctagcctgggcaacaagagtgaaactccgtctcaaataataaataaataaataaataaataaaatcaggtcaggcacaatgcctcacacctgtaatcccagcactttgagaggccaaggcaggcggatcacctgacgtcagcagctcaagaccagattggccaatatggggaagccccgtctttacaaaaatacaaaaaaattagccaggcatggtggcaggcacctgtaattccagctacttcagaggctgaggcaggagtctcacttgaacctgggaggtggaggttgtggtgagctaagaacacgccactacactccagcctgggcgacggaatgacactccatgtcagcaagataaataaataagatcataaatgtgtagatctgcatgaacacttaataacatagtacttgtgtgcatgggacatttctggaagaatacaggatacaaaatacagatactagagggtaggataggatggagattcatttttctttctttctttctttctttctttctttctttctttctttttttttttttgagacagagtttcgttcttgttgcccaggctgtagtgcaatggtgtgatcttggctcactgcgacctctgcctcccgggttcaaatgattctcctgcctcagcctccctagtagctgggattacaggcacctgccaccatgcccagctaatttttgtatttttagtagagacaggtttcaccatgttggccaggctggtcttgaactcctgaccttgtgatctgcccaccttggcctcccaaagtgctgggattataggcgtgagccaccgcgcctggccagagattcatttttcatagtgtaccttttatattgtttgtattttgtatcatatatgagctatttttatattaaagaactaaccggttaaataaagacctatgaaaacccagcagagtctacggaaggtttagttctaaccatgcctttgtgtgggtacttcagcaggttaccttcagttatggagtctgtaatactctgtgtaagaatcatttcaatccatgctttgtttttgagcccaaaccttgctccttctacccccgcccaccagcccccaaccaattgagaaagggaaaaagataaggaccaaaaaacagaatattttaagttcagctgaaattccacctcctctacaaagttctttggacttgttatccagcaggcatttctcccggccatgagatcttgctgcggtggccctgccctcccctctgactcgcatgttgtctgccttatagtagacatgccgtgttgatctttgcgcagaacgcctgcattaggactgtgcttcttcctgctaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggtgagtgtggagggaacacaacactttcaggtgctctcttttcttcttggggtatggggagtgaaagaacagtaggcagggtcttgggatgcttggtgcctagagtctcctgtcaatctttccatacctagattgtcccttgcttgctgagagtgtaactgagtcagttgtgagatgcagcagctgcaaatgctgggttgattcctccttatcagggagcagggaaggatacaacaatgactcaggtcacattcccctaccctgcacctacccctagtaaaagtggaggaggatgctccatatagttcccagtatttgcctaaatattcagtggctgggatttgcatccaactggaaggaggcagacgaaggttcttttctattcacggatattgtttctacctggtgggaagaaccctggaattaagagggaagccttgggtttgagcactaactcttctactaaattgaatgaccttgcacaggtcacctctcttcccccgggacaagttcagccttgcagataccaagatcatcatgatgatgtgaatggagaaagctctaggaatgcttggcaaactaatctgggccttcacattaattattctgtttaaccagaatgcaggctgatcccctgctcacacttattacactgataaatccagtttcacatgtgcatggtaaatactttgaaaataattttaaaactactttttctaattggaggtttttagagtagaggtaatgaatatgggctttgccttcagatagacctgggttcaaatcctgcctaatactgtggctcttgaacaagttacaaaacttacttgtttctaatttttcccatctgtaaataggataataggagttaaaggagaaataagtgggatagtgaacagaaaacacttcgtgcctggcacatagtaaccaacaggttagttagtgatagtgttactatgtcttatttcatttgattacttaattgtttagtgaatggaataggcatctgctgtggccatttttcattgtagaagttgaggctcattgcccaaaggattctcgatgtctcttatcccaaatatatatatatatatatatatatattttttttttttttttttttttgatgagatggagtttcactcttgttgcccaagctggagtgcaatggcgcgatctcagctcatcgcaaactctgcctcccaggttcaagcaattctcctgcctcagcctcccgagtagctgggattacaggcatgtgccaccacgcccgactaattttgtgtttttttttttttttttttttttttagtagagacagggtttctccatgtttgtcaggctggtctcgaactcccaacctcaggtgattgacctgcctcagcctcccaaagtgctgggattacaggcgtgagccaccgtgcctggccccaaataatattttttataaacctatgaacttgtctctgacctttcttgtagtggcatggagtcaataacagtctaagacagggacagggagaccacgacatgaatgaaatgtggaactgtgagtggccaaggtgtgcgcccagagtagggagcagaggaagggtcacgctgagaaatcttgggaacttggcctggcagagagagaggcccaggcatggggcttggtttatgttgggaatgaagctgaggtccctttaggaagaatgaggaggtcgtggtggtaaggtgcagtggggcaggtgtcctggagtccaggggtgtctcttatacctggaactgagtaaggaggtcctggatgcccaaaatgctaaaatgcataaatggagggggtgggatgagcatgattcaggagaatgagtcgctggagctgaagagaagcagggatatctgagcaagggggtaggcaaggaatttgattttggacacattgagtttgcagtgttagtgagtcagctgaggagcatcgtcctatctgaaggcagagaggaggagctggaccccaggggagaggagggaaaagccagggggagacaagaggaaactgggctcatcacaagagaagagtacaggtttagtggttaatgccattttgggataattgtgcttataatgatatagtgtattgtattatatgtaatagcatatagcctattatgataacagaatttaagtgattgccatcatatgctgggtgcattcctgagagctgagcgcccttatgtcattaatcaaacccagcaagtctcattaactccattgttaaatgtattgaaaccaggtggtgtgggtgaggttgggtgggggtggtttactttgagtaaagacacctctttgaatattattatcttcatctagaaagtgataaaatgtaaataatccattcctgcaaatgttgtgtgttgtgtgaagaagatctgagagagaaaggaaaaaatatataaatctttacagtggttaccttttttttttttttgagacgaggtcttgctctgtcgcccaggctgaagtgcagtggcatgatctcagctcactttagcctccatctcctgggttcaggcaattttcccgcctcagcctcctgaatagctggggttacaggcatgcgccaccacgcctggctaatttttgtatttttagtagagacagggtttcaccatgttggccaggctggtcacaaactcctggcctcaagtgatccgcccaccttggcctcccaaagtgctgggtttacaggtgtgagcctgtaaccggcctacagtggttccatttaggaagtggaattgagcagggcagaaggatagagaagaggaacaccttcctatttcattttatgccttgctggaccatgttttggttttttgttttgttttgttttttgtttgtttgttttttaccatgtgcatatattttacaaaaaaaaaaattataaagaaaatatataggaaggtgttgtgaaacaaataacatgcacataaaaggtgatactattaaggggtcaggaatctctctctaaatctgtgatttcaatgaataaaatgaaggtgactgaggcaagatcctgcatttccagagtgacttggtgtctggcctggagagcagacattgacaaggaaagaaatgtggccacaggaggggctgtgtctcctgcctccttcccaggtatcttactaagggatagaattcgtgttttatttcaacagacaccaggcccctagcggccttgggctctattctgtgggggaatataaggctgatccagtccagtgggcacaggcttggaaagagccagtgataacccaggcaagaggaagagcaggcctgacgaggcctttgtgggaaagttggcatttgaccctgacattaaatgatgagtgaagtggcaccaacagtgtaaaaaaaagaggacattcccagcagaaaatactgaagagagaaagaggagaaaatatgcatcaccagagaagaatgatgaaagaatgtggcttactgcaggcacctatgaaatcgtgaggttctgagattttctccaggagcacgcagccgctgaagtagtggatgtttaggttggctgggagtctgccaggcatgtccattgaaacgacaacagggaatgatgttgcatccctcttgcatgtgccaccagcttcactgcagtccacacaaggtgctgcaccttagatttgtccgcacaaggtgctgcaccttagatttccaggttcctgtctctatgctgctgagtggtcctatttcacaccccttgtctgctccccttccctcgcttctcttaaataacacttgactgctttcctaatagagatatttggcctttaaatgcccaaataaatgttcctgggtggttcccattcttcgaggccagctccagtgcctcctcctccaggaagccctccctctgcctccaggaagccatctctctgccttgaatcttccaaacactacatctgacttctctcagggtgctggtcccattgcactgtgtattctgcttgtccatgtacaggcctcctggcctcctgtcctgcaccaggctgtgctccttggagacagggatcgaggtttggatatcttagtgtccccaacagcaggagttggcaagcatgaaccatggctgcctcacaatcatccagggagcttcctcaaggcatagagcctgagtgagacccacttctggggctggggctgggattctggcctggctcctgggagtctccattttaagccagccaggcttgtgatcctctggccatagcacccagcctgttatcttgcacagagtagggcctcagttactgttgaatgataccccatttacaaatgaggacataaacagagaagcacagccacttggcccacaaggatcaaatcagaaggaggctccccagaccctgactctgcagtgatggtttgggacagacccttgaagtccctcctgccccgctagtccctaggggctcatttgaagaggagccagggggtcttctcattggctatctaaagaagctaaggttcctagagagggccaagctaagtggagtaactcaaggcaaggaggtagctgaccaaggacaaactaaggacttggggccataagaattaaacccaggctttgatcacacatgaagacccaatgtcgctatggagtagccctgcttgctggtcacacagcattttaccaaacacacccgggtgcagggcgctcttaacactggatgtggggagaggcaagaggactggggttcagccccgggtcagctgtcagccacaccctgaactgggcaagtccatggtgaactaaacccttcaggatgcacctgcagctcacctgagagagacaagacaggtggttggagtcatgcggctaggtcatgaaaggtgggcgagtactcacccaggttacctctgcccatgcaggttcgtgtgtgcccagctacctaaccctgtgctggagagcatcagcgtcatcgacacaccagggatcctctctggggagaagcagaggatcagccggggtaagcaacctgcctgaggggtgttggctgtgggctccatggttctggcacgttcagtctcttacataccagaagagaagcacccagggccatgctgtcccttggtgagccggcacttctcctgtgctgtgtgggatcattttacctggggcagtcctaggccggggttggcaggggtcgggagaggggaattcaggtccaccgtagctcaggagatagctggcctcagtcttctcatctgtaaaatgaagacatcaatatcagtcttacctcgttgggtttattcatgctacaaggggcaccttccatggccctgatcctggcttgcttcttaagttcctggggagcttgcagctctgcagggcagccaaatgcatacagagaaattcagctcaatggtatcagtgccctgggtcataagaggagggaaccaggtagtgaaagcacttcaaaaactgttcactacagataaatacaggataattgctcattaaaggaggttgcctggtatggtggttagaagacagaactctggagtcaggctggcagggttctaagcctgcctctgccacttcatagcacagtgaccctcagcaggtttctttatttcagttactttgtctgaaaaatggtgtggggcggtgggggcgggtggggtgggaatagtattatccatcttacagagttgtttgaagattaaaagaaatgcttaagataaaaagccttttctggttggcacatagcaagtacctagtaaccatgagggattatagatgatcatcatcatcatcgttgttttctttttttttttttttttgagacagagtctcagtctgttgccaggctggagtgcagtggcacgatctcagctcaccgcaacctctgcctcccgggttcaagcgattctcctgcctcagcctcccaagtagctgggattacaggcgtgcaccaccacacccagctaattttttgtatttttagtagagacggagttttaccatgttggccagaatggtctcgatctcctgacctcgtaatccacctaccttggcctcccaaagtgttggggattacaggcgggaaccaccgcacccagcctgttttcttttttctaactctaaaatgctaggcagatgctatcaaaagctaaaaacaactgctctgggcccccacccccagcctgtcctggcacagtttgctgagtgtcctgtatagcccactaccctctctgtgccatgtgttgtatctctggcaagaaaatcagatgacgccatgcccaccccaatattggagctagttgccagggctggagccacatcagcactcagaagtcagcctatgggtaaggaagggctttgaactgctggggttctctgggaagcagctagaactcttgcctgaatggacctaggtaggtgactgtctgcatgtgccttcaccctctgtgctctgtggctctggctgggacacagatctgccctgcccatgtctgtgccacaatagtggggcccagaaacctttgctctttctgcaagagcatggcctgcccaggccagcactgctcaccccagacccctcagaggagaggtcacagcctcatggtgtgacaggccagtgctcctgcagttgtgtattgacgaggcccaagtggtgcaggcccttggcccaggtgcaggccactagtgccagacctgggcttctgtccagtgctcctgtgagctgccttggtgtcctctctgcagaaagcagctctcttctgatgagggcaggtgtgtggtgcagggccaggctcggctctttgaggctacactatgcctgtgtgtgagctgccatggctgggagtggaaagggaagacagtgagagaggccctccaggtcagcagcctgctcaagggccaggttaacccgagtcagccctccagggaagacacagcctggagtcctcatcctgtagcaggtgggagggagtggggaggctgaacatcctgagaggaaagccctgcccttcctccttaccacctcttgctttgcttaggaggtgagacctgggaagaagaggggaaatgaagcaactgagtcaggagggacttgggaaactgtgttagcagttcctgtaattggtggcctgtgaattctgggacatcacagtgtcacctgggaagggggtcttggaagacttgatctcctggctccctatctctgggctgtatggtggaggtgatagggagctggaacccctggcctgggaaaatagggatgtctgagcctccctccttccagccagcacgcacgctgtaagcacctggctccctgttaagggccctgtggagggacagcacgggtggtttttctgtcttgctttggtttgtttgccggagcaccccctttctcctaacccacctattcccaaccccaagtggttcatctggggtttaccctgcgtttaagcctgaaggggatttgctgtttcactcaggcagctcaggactcctccaggaaggctggggaaagccaccccttcccagtgtgaactccctgggggacgtcacatgtgcacctgcaaggccagtgtagcctgaccagcgggtccagagaggactccagcctctgcggtttccaaggacactgtactaggaattcagagttctgggctttagaacctgtgtgtgtctcaacaggtcacattttcagtgtccccatgtgtaacaaggggtaatgatatgtaccacacagccgtcttgtgaggtctatagaccatatgaaaacacgggccatagccctgggtctggatcaccatgagctaccttcctccctccctccctgtcagttggcaccacctatcatacaatcccagagtaatctgtgtgaatagtttcccttgtagttgtgcagtgcacagcctgtgcacctgtatgtggcaggctggttcccagggactcctgccttcctcagttcctatcctattctattcttttcctatttctgtttttgttgttgttgttgttgttgctgttgttgttgttttgagacggagtctcgctctgtcaccaagctggactgcaatggcgtaatctcggctcactgcaacctctgcctcctgagttcaagcgattctcctgcctcagcctcctgagtagctgggacgacaggcatgcgccaccacacccagctaatttttgtatttttagtagagacggggtttcactacctctctcctgcctttgtctttggaccccagtgactgccttaagcaaattaggcccttggtgttcttgcctgcacttcctaatgcctcccatcccacattgactaagcaccaggtccccctacctctgggagaaatgatggccccaggagtggctttgcaggccagtttgttttctgctttcctgagtccagactgtaaatgcagctgctggcaaaagcagcctgcgttaaaaacaagagctagaactgggctgctggcgcctggggcggtgctgacctcagcaccctgaggagaccaggacagttgggggaagggcgtcagacaccctcagttatctgtggtaccccaaacgagtaaagtttccagggtgcagagcccaacccctttctttctcacaattggccttagaacacatagctccagtttaaactgacgcacacctcccccaccctcccccacccatacctccttttacgcacacacccactcccacacccacacatgcatacacactcctcacacatatcctgcatatacacaactcccctcttccccacagcaaccccctcccacacacacacacacacacacacacacacacacaaatgtgtgcatagaacaaaacttgctttctcatggcttcttgcctagggctccaagagctctgggtttggccacagagcagactgggtgcttctcgccttactccagccagcccaggcaaggaccggacacccttcctccctgggatagtcctgccaactatgtcctacacgagggcatctagaacctgaaactcagcccaccttctgctcactgagcctcatacctggcgcagggctgtgtctcaccagataaaaaggggcatggttatcaagtcggcacagaggcccctactggccatattagactgcctgttctgcaaagtgagctgcttcccagggctccaagacctcaggcttcacaggaaggagcactcgggccccaggctggactagggcggcaaagggtcgtccttgctcagggtgtggaccctctactgggcctggggcggggtgtgtcttgtgggaagaaggctggggtgcccgggaagctgattctgggaggtcctgggccagcacttgtctctggatgcagatgcattggggtgggcaggggaggaagacagggaggtggttcctggaagtggcaggatgtgccccagcctggctcattactgggaagaagtgaggatgcagcaggagtgggagggctccagaaggctgagtgtcctgagcttaggaaccacatttcctggctgcttcccagctagaaatccccataggcgccaccttaggaaagcagggcggggctttgtgctcacatcacagactgcacagcttgaagctcctccccacaggcccctttctgcacaggtgagctcagtaaggccagagcaggttgaaaatttgcccggatcacacatctagggaactcgggtcttcctattcctggtccacggcttctcagcacattatcatcacctgccccggaagagcacagggggtaggaatgagggcaaacctctcatctccaggtttcctctaggggtctttagggctcagaccttggcaggtctgggctgatccttgcagcctcacattcctagcccatccagggcaccctcattggagcagagcctgcacttaaaggcctctgggtcttcccagactacgtgccggtacaggcacgcctgtgtgggcgctcctgtgcctgggcagagcagccgagtcctgacgcccttcaaaaggccttgccaaccatctgctcgggccgctctttgccgttacttctgggaagcatctaatgtggcatttcttccccgttgtcagccaaactcttcccacattttggaaattgatgccttgttattcctcttttgctcaaatgcctttaaatcttgacggagatttttttggggagggatggggttttgtatgtacccaccgcaagtaagtgcctggtttgagggctcagcctctgagcttcaggctcacatggctgtgagctgttatagaaagagaatgtgggctgcaagtcaaggagctgggttccaggcctgagtttgccaccacctggctgtgtgagcttgggcaagccccttaatctctttgtgtccagattccctgtcctgtaagatgtgtatgccctacttacctcctgggatacagagaattatgaagagcgaatgaggtcacgtggctggaaacccgaagaagtatgctgccctgtgagggcccaggcactgcatgccaggccatgatggaagccggcgggtgaggaaggggtggctttccttactgtgtttgtctgattgatttcctcttgcctggcattacttcaaagtgctttctttccagtcatctggagcctccggttggaggggaccatagatccctgcaggctgcccagtctccaggcccggagctggctgactagacctcttagagccagcagacttgtgctatgaagtccaggaagggcagcttctctgctctgtctcttggggcttgaatctcccccgactcactagtccatatttcatgaacacttgggctgccgcaggtgcccaagagctaccgttgtgggtctcagagccatcgctgggaccagagaggggaagggggcctgtcactggccatagcactcaccgcagctgctgaggcagtctgtgctgtcagatcttgttgccacagctctaccacagagtcctcattcagctctaccacagacccctcattcagtcatttgttatccctattttgcagctgagaaaattgaggttcagatttgccaaataaatgagaaagctaatcctataccataccctttttcttactgggtccagtccatacctttgagataccgccattcctagatctgcacctaagtccaggccaagtgaacaactaaatatccaccctacagatgacacagcctcggggttagccaggagcagggaagtcgagcttcagagcaacccatggagtcattgcttgatggtcatggtcttcacagccacacctggctggaagcttctggcattactgagtctgtaattggatagcagctttccagagcaaataggaggcctctgcttataaaatcacggaaagagttcccagaagcccttggcctgtcctcaggcagaggcagacttcacacaggcatccccgaggcctgtaagacagcagcctgcagcctctctctcttgctgtgcctgcaaagggtcccttgtagctaatctccatccatcctgttgtactccccaccctcacacctctggtctcagatgcagagaattgtgaaccgagaaaggaagctcggaggttgtccagctcaatcccctgatttgacaggcaaagagacagaggactagagaggggagattcttgcccaaggacacacagtaagttagtggctaagcggaaacgagaggtggactcacccaggccagtgctcctctggtgactcctacagagcacatcccatctcatagaaactagggcttaaaaggagtgctttacaaaaaacagcagggcaatgagaacagccaaggtcacagctcagcagtttcacctgcatcctctgatttgtttagatcctcacaataaccctacgactgagtcactgattcctcaaccataaaactgaggcccagagattactcatttactgtctcccagatgccaaacgtggaacaggtttccacgttttccacgtttcacttccgttcagcaaatactgatagtgcacctgctgtgtgccacacaccgtgctgggtgcaggggaagcccagaagggtgaggtgctgcccctgccctgtccagctcccagtgcaccgaggatgatttcagtgagctgaagagcagaacaggagcgtgcatgatgctacaagaccactgagggcagggacagggataggcaggggtctatcctgttctggcagcatggacatattgctgcccctcagcctttgcagacacagccttctcttacatcgctggtgtcatcagggattgcagcaagttgcagggacagagcctcttcccttctctgcagcttctctggtgtctttgttttccccagcctggtggaggcgtggctacagtgcaagagttgagtttggagttcaggtcttggctctgacccccagcattgcatggccttgggcctttctctcaccctctataaacctccattaccttgtcagcataggactcaacactggctgccctggctgccttagcctgttctgagccattgagccaatatattggggctgagatttgctggacaggtgagagggagctgcagcccagtcttggtcctcccagcagcccctcctgtggcctgcactggcacagctaaaatccagattggggaataaggagcagcagaaggccagaggcctggcagggagttgtggagggtccctactgccctcctgctgtgagctgtttgcagaggtgggggttggggattttcttagccctctggcccctccctacccacagctctgagggactgcctttgggaggtgacagcagccttgccatgcgctgtgctgaagggaagataaaaataggctggagccatccctgggaagggaaggatggacagagggatgtaggaaggaggggagtagtgcgggctgcaggcttcacctgaagtgggaatgcttaggcttcccgggctccagtgaggagctggctgtgcctgcgtgccagggagggagggagggaggcagggagcggccaggtgcagaacggctggatggctgacagctgggtcatctggcctcacgacttgccaactgtttgactctctcctctctgaacctcagtttcctcccctggaagtgagaacgatactcctcgcgctgcctgcctcagagcgtgtcgtgagggtgacatgagataatgacatgaacatcttaccgtctgcagcaagcactgaacttcgagttggaggctaggggtcgtgtctcatgggtggtattggctgagtcacttaactcctagagtttgcgtgaacatctccgagggagggttgatgatgcccctgcccactgggcagagcagcctctgaagcactttcctgggccttgtctctgagccgagacaggacacctgtgttcaaaagagaaggcaaaatctagttcacaccaggccctcgatgacgcacccatcaggaactatcctcaggatggcacctggagatactgggccagctctgccccttcctgagcctcagtttccctatctgtaaatcaggaagttggaccattgatggctaagctcctcgtagcctcataggtctacgccacaggagcagggggagaaggctcaggtgttagttgagctgtatattcattgagcagctgacagatcttggagaaaatcacatggcaatgggaatgcttggaagcacttcatttaccaaagacagaggagctgaaaatggagtagtactggcatccgggtaaccaaaggagggtttgaccttcctttgtttgttagaattctcttacagccaccagggaaacattacaggggtcctccaggaagctttagggcagcaagttttcccgaccgtctgatcccatccccctaccccctgtggcagtgcctccacacgtcctaaatatgtaccccactgggtgttcactagatgccacagggtgggggaaaggctttttaaacctagctccgttggctccattcatcctcatcccccaccccatcgatgcctgctacttagtctgaaatgacagcctttgaaagtgaaagccaactcggtgcagtggttcatagcactgactccagggctaccttcctggacttgagtcccagcccattgcttaccagctgggtgaccttagacaagttcctttatctgtttgtatctctggttactcctcagagaagtggggctgatattagtgtctaatgaccctacacagagtcatcgtgaggattaaaggaatgaatgattataaagtacttaggtcagtgctgaacaccttttgaatgctattgttatttttatgggccagtggtattcaaagtgtggcccttggaccaacagcatcagaatctcctgggagcttgttagaaatgctctgcgccagacctactgaatcagaaactttggggatagagtccaaccatctgggttttaagaagccctggggggattctgatggaggctaagtcaggacccctgttaaagacagtcagagcttcttaagtctgactcactcacaaggcagttgcctgatgatcttgcctggtctctagcctccctctgtgaggcagggcaggctttttcctaatgatttggtttcccattcgatggtggcaatgagctttgggtccccagtgtgtgtcaccttggaacccttgtgctatggggagccaggatggttggtcactttagtacccaagaaagggctcctaccttggtgccagaggtatgccacgggggagtggcaggaggagaggctgagaaccctgctcagactcagaatgggaaagcctaacacctccatcttcatgcgactgctgctgctcatgggctgtgtgcccttcgacaaatcacttgacttctctgagccccacttccttatctcttgtcttcctattttatgtaagaggagcctgagacacagaggtaagacctactggggctctgggtgtcagtgaatgtatagactattggtccaccctcctacttcagctcctactggatccacagctacttgggattgagcagaacaacttctctggggctcctgtaaccagtctgacctaaagcagcttagtgctagataaccaagatgcgggtggccagagttccagtcacatcctaaggaagaaaccccttgtggtttcaagagttgggaattttgtgctgcagctgattacaaaggaaagagcctgagtgagaacaagatgtttttataacaagaattgcagatttcttccagaccagtgacaggcatggtctgaaccatcatcagtatctactttttagtgtttcattgttttcagaccttagaaagaatttctgggtctttgtgtcagattaggtgtccagactttcttttccagcgggctgctaaatacagtaagcacggataggggagctggtatggaaataatgacgttaataagagttactaggccaggcgcagtggctggctgggggcggtggctcacacctataatcccagcactttgggaggccaaggcaggcgcatcacctgaggtcaggagttcaagactcagcctggctaacatggttaaacctgtctctactaaaaacacaaaaattagacgggcatggtggcgcatgcctgtaatcccagctactcgggaggctgaggcaggaaaatcacttgaccccaggaggcagaggttgcagtgagcagaggcagtgccactacactccagcctgggtgagagagcaagactccgtctcaaaaaaaaaagtaactagcatttactgagcacctactaagtgccggattctaagagtatttaatcttcatagttctattaactaggtattcatattattttagtatttaacagtatttttagacgaaaaaaattctatgagacattgagtaatttgctggagtccaaacagttaaaatgtggaggagccaggatttaaacttagatctgactcccaagactgtgttatttctaccacacccgactgcttctccaaacccctaccctataccccaaaggccccagcccctgattgtccctctgccggcagggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtgaggcagccccctgggaggtgggcagcttgggcaggggcccagagtttggggtcagctgcacgagctgagggttgctgcctccaacagccagtgcatcatgtgtgtgacaccaaggggcaggacagtgcgggagccatggttacaagctctcaggtcagatggccagattggaactgactccattgtttactgtctgtgggattcccagccttggcaaggcctttagtctctctgtgcctctgtttgcatctgtaaaatgaaggggttgttggaggataaagtgaaataaagagtctcaaagccctcatcacagtgtctggcaccttcagagatgctcagcaactgtcagctgctggtattgccttcagcagcagcaacatgaccacctcaccctgccttgaccatagctccccacaacctcaccttgcccacataacatagaaaaacagcccagccctgcaagcaacatggagccatgagggtagaggtagaaattatttcaaaagtaggagcaggaggaggcgggagggatgtaggggaaggaatgatgcaagagccatcctagaaggaagggaccgtccagggtcttgatgtgaaggcttctctctggccctgtttgtcaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggtagcgagggctggggtctctaagacaagggacagtgtcccgagagctggctgagcagcctgagtatggaggaggccactcttggagccccccagggagaaccccgcccagaatctgcaggcaaggaggtggccctggatctacactcctagctgggccatcactggcccaacaggggccatgtctgggcctggggagaaacacggagcccaccgccccagtggtgcaggtgtgttagatgatgctggggggctgacacctccagttaatgaccttctctagtcacagccaccacaggcttgacgtccccaccatctctggtgcagtgggatgggtcacctgaccaaggttctccaggctcttaaagtgctcgagtttacatctgaggtcccccttgtgagcaatctgggacacgagcttcggggaggcagaagtgcacacgggaactcgtcatctttgggtcctattgcaggtgcctatcttgggccagtggccatcacacatggtttcttacggttttccccaaagcactcatcagagggaggcatttttcatctgcctttttacagaagaaacagaggtctcagcattttctgagtgtagcattcacataggccacaagaagaagagccaggagctgggcccaaaggtccaagcaggaaaccacaacattgactggatcctctgagcctccatttcctcatctgtaaactgaagctacaaaatcacgccttatacaggtgttgtgagcatcagtgagataatctttgcaaagcccttagcacaaagccagacagactatgcccttagtacacagtagcaaatcattaggtgggcagagggaggtgggtgctgagcacaaagcacccacccactgtacaatgtttgcaacttcttatgattctagaattaggaaattagaggccaggcacagtggctcacgcctgtaatcccagcagtttgggaagccgaggcgggcagatcacctgaggccaggagttcgagaccagcctggccaacatggcaaaacttgtaataaaactacaaaaaaattaactgggcatggtggcaagcacctgtaatcccagctactcgggaggctgaggcatgagaatcacttgaacccaggagtcagaggttgcagtgagccaagattgtgccactgcactttagcctgggcaacagagaaagactccatctcaaaaaataaaaaaattagggaattagaaaaatcaaaaaatagcagccacagaagcacttaatagatgctgttgctcttgttttgatctttagcttgggaatcagtttctcagtttaaatctaggtttttcataacatcactatagtcctcaataggcatttttagtttcctatccggcagaagaaaaagaaaaaaatatacattccaagtatttggaatttgttcatgtgtccattcactcatataaccacctaccacgagccattcactaaccagcattgcttttgttttgcgggtttcccggtccttgacttggagcacttcagctcttcgcttctgcttttgttaagaatttaatgatttgtaagcaaacatttgggaagataacatttgaaagggaccctaagaccccagttttaatgtgaggaattctttcaaaacaaagattctcacctcatttgtttgccagttcaatattctgttctgcagttcaatatgctgaatccacaatgtaaacagctgtcctgtgtgggtgtccatcgtagggtaatgggagcacccaccatgccccctagttgatactgggacccctgcatgggagcccaccaaacatacctagatgtgagcaggctgggagggacaggaggaatgagaggtgggaggaccttgggacgtgatgctctgaggggtgggagatagggccctgtctgctcctcctccaggagtccttcagccctaaggccttcctggctcagcctcaccctaggaaggaggtgagaagtacccaggctaacacttgccctagaaagctgtgggtgttttttgcatttttctgcagcagactagctgtgcttcaccctgtgtactggcctcttcccagcttctggagagttaggtggccagagccagggtaggagcagaaagctgtcaccctatcaccctctacaggccatggagaagttggtgttctagactcgaaaactttcaaaattgcagagacctgcaaagtggaagatatttcttttatggtgtggtgtgggttgtcatgtgaaggcaagaggagctctttcaaaatcggcatgcccacctgcctgcctgtgcctgctgtgtcaaaccctcggggacagtcatgccttgctaatgacagggacacatcctcagtaatgcattgttaggtgattttgtcattgtgtgtgaacaccatagaatgtatatacacaaacctgcatggtagggcctaccacacacctggactatatggtatgatgacctattgcttctaggccacagacctagcatgtgactgtactgaaggctgtaggcaattgtaacaccatgtatttgtgtatctaaacatagaaatggtacagtaaaaatacagtatgaaagataaacagtggtatacttgtacagggcacttaccatgaatggagcttgcagaactggaagttgctttgggtgggccagtgagtgagtggtgagtgagtgtgaaggcctaggacatcactgtacactgctgtagacttctttagaaacactgtacacttaggctacactatatttatttttagaaacattttctttcttcaataataaattaacatttctactttacagacttttttttttttttttttttgatacagagtctcactctgttgctaggctagagtgcagtggcgcgatctcggctcactgcaacctccaactctgggttcaagcgattctcctcagcctcccgagtagctgggaccacaggcatgtgccaccatgcccagctaaattttttttgtaattttagtagagacggggttttcaccatgttggccaggatggtctcgatctcttgacctcgtgatccgcctgcctcagcctcccaaagtgctgggattacaggcatgagccaccgcgcctagcctacaaagtttttgactcttgttgtaacaattagcttaaaatgtacattgtatatctatacacaaatattttctttatatccttattctataagttttttctatttaaaaaaatttattttttacttttttatttttgtgtgtgctaaaaactaagatgcaaacacccatgctagtctaggcctacacagggtcagcatcatcagtttcgctgtcttcacctccacatcttgtcccactggaaggtcttgagagatagtaatacacatggaggtgtcatctcctgtaataacaatgccttcttctggaattcctcctgaagggcctgcctgaggttgttttactgttaacattttttttaaataagtagaaagaatacaccctaaaataacaataaaaagtacagtatagtaaatatttacataaaccagtaacatagccgttatcattatccggtattatgtactctatggaaatgtgtgtgctagatttttataccactggcagcacagtaggtttgtttacaccagcatcaccacaaacacataatgcgttgtgttgtgtacagtagctacaatgtcaccaggcaacaggaatttcccagctcccttattgtcttctgggaccctcgtcatacgtgtggtccctcattgactgaaacattgtaatgcagcacatgactgtattttgaaaactctcctcaggtgactccgatgagcatcctgattaagaaccataatttggggatgacctttggcttctgttatgatttggttttagtaccctgtgccctgtttggtttttgtttttgttttcactaagtggggatagaatgtgattttcctacctcagaagggcgctgggggagtgaacgaggtaatgtagtgaaggcacttgcggtgattttcaagtacagtataacccttattaaagtagaggcccacatgacccagtctcagaggtacagcattcaagagacatgattcaatagccaaaactgacttaaagagaaatgtaatgatttcctctctggaatgacattgaaggggattgaaataaatagatcatgccaatacttgttaaatttccctttcttccccagcccctacaacccttctaccccctactgaaaaatcccatcatcagcccagtgggcctttattcccctcctctctcataccttcgattaccacgtgatgtccatcagctgagcctctaggtcacaggtctttcattgtagaaagggatcagctgtgaacattctggtgctcataggaggcacgtgataaatggagggctctcctttcatcgtatcctatcttcatcctctctcctcctcttcccaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccatgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtggcccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggta

SEQ ID NO: 38469 - DNA, 5662 bp, Homo sapiens
agcgcagcggcgtccgaggcaacaagatggcagctgcggagccgtctccgcggcgcgtgggcttcgtgggcgcgggccgcatggcgggggccatcgcgcagggcctcatcagagcaggtggggcggcgcggggctaggcctgcggtctggagtgggagcagccccgtgggaggtgtcctgccgcgagagtggggccgggggcgcgggcccagccaaccgggtctccgctccgctgggcgcagccggggccacgcctgtttgctcttacttttttgacgtggctgcgggaagatttgagtcacacgtggctaggtgccgcttccgtggccggcttcctggccgcgtggccttggccaggctcacctcttccagcctctgattttctctttgcgcgccagcccctctcatggggagcagcagggcttctcccccagacaccttggctctagggacacctgggccagactatccatcctgtgccagcagcacccccacgttgtgacagccaaaaatgcctccagacactgccgaatgtcccctgggtggggggaggagacaggcaaaatcatcccctgttgagaaacactgctttatacccggaatatttatgctgaccatatactcctccaggcatttagaagcctctctgcagattgtggatagggagagctgggtgacttttgactctctgccttcagccatacttcagggtccagaagagtcaagatcaatcgggaaatagcttactatgagtctcaggagtcttccctgtgaaacctggcagtaccgcatgcctcccagagctgtacaggttaaatgagacataaatgtctagtgttgagcttagtactggtgtgtttggctgccactgtcatgattaattgctgtgttcaggttgtggtgtacacttgtgccttcctgttcgaccttaccaaaatctaacccaatctttccaccccgtacccgacaaaagcagataatttctaccaagtaggcatttagccttttcttagacattccagcatagactctccctctcgaagaacctgggccccgattgggccttctgtggccaatcaactgcctttgtacccaccacattcccccaaggcctggtgttcctccagaggtactgcctcttctgctccaggcagccttcccttccctggaggcagaggccccagggatctgtgtcctcaccaatgaggtaagctcctggcctccatacccagcagcagtcaggggcgttgaccgccaagtagaatcagtggatctgattgcctgggcccagtgaatggtgcatcccgctttgggttcctggggccaggagggggcccaggatgggccaggcgtggctgagcctgagaggccaagtgagctccctctcctctccgtgccatcctatcccaccccttcaccaacccctcttccttttcctttctttccaggaaaagtggaagctcagcacatactggccagtgcaccaacagacaggaacctatgtcactttcaagtgagcatagagcccaggttcttcataccctcaggagcccaggatagctcttggctcctgtcccactaagacacttatcagagccagggatgggtggtttatttagctgaagtttgcagactggctggtctgggctgggaaaagggagattagaggccaggaggaaagtaaggttgtggagggccaaagcaaagtgtttgtgtgtgtgtgtgtatgcatgtgtgagtgcatgtccgtgagtgtgtgtatatgcacgtgtgtatatgtgaggctatgcgtgtgcatgtgtgtatgtatgtgctcatgtgcgtttgcacgtgcgcttgtgtgtgcgtgtgcacgtgtggtgagtgcatgtatgtcagtgcatgtgtgtgcgtgtgtgtatgagtgcatgctcatgagtgcatgtgcacctgtgtggtcgtgagtgcacgtatgtgcttgtgcatgtgtgcctgtgcagatgtgtatatgagtgcgtgtgtgcgtgtatgagtgcgtgcgtgtacacatgagtgcatgctcgagtgggtgtgtgtgcatgtgtttgtgctcatgagtgcattcatgtgtacatgtgtatgtatgctcgtgagtgcatgtgtctgcgtgtgtgtatatgaatgcatgctcgtgagtgcgtgcatgtgcatgggtgtgtttgcatgctgggtggtggtcacagacattcactggggatggagggctcagggcttggggaggcgctgacatcaggatggcctgtgaggagtagggctagtctgggggagtcttgggcactggagaagtcggggtggtctagacacttgcaatgggagaggccctgggaccatgggaacgtgtggcatccagcaggaagggctgtgatggagagggtgcgccgcttacatggcccctgaggcttggtcctggtgtccctggcgcaggctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggaggtgagtgtcccttgggctaaggccttggtcccagtataggctctgctggccaggcttgggcggcaggcagccccccagagagcctgagaggtggccgtgtggcccacctggatcaagtggctggatttagggttccctcctggtgctgtacctgggaggcagacgctggagcccaccgcgagctgacgtggacctttcctgaggcccctgctggggcctgcccagcagggcccagtcctacagactccctgattctgacctctctctggccagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgagtattgcctcgtccatccccggccccaccctcggcaaagagggggcccaccccagtccctctgacagcctctgccctcagagtccaaccttgaggcctgcgtggttgctccccaggcccactgggagctctgcttgtccccgggacttcactgccttggggatctttgaggccagcccctttgcagaccgttgggctcaggccttggttctggccacccacggctactgctctgggcattgttcctgaaggtcctgagcccccaggctttgacacctatcccccccaaccaccatgccgcggctacaggtgtgtgcattctccgaggccctggctgaaggagccgtcaagatgggcatgcccagcagcctggcccaccgcatcgctgcccagaccctgctggtgagtgagggtggcccctggggaacatcgggaaggcccaggcctgtacctcttccagtgcgcagggaaacagcaggctcgagaagctggggccaaggttgggggatgcaacgagggcaggccgcacagtggggaccgcaccacctccccccgtcaccaggccctaacgctctcctcaggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaaggcaccgtggtggtggctctgccccttgctgcagtgagcccaccttgctgcaacattggttctgaggggcccaagagatggcgtcttggtcatttgcccgcatggttgggcagttggttgaggccatgaacagaacttacggtaacaggcacggctggcccaatgcctggtctggagctggagcttgcctttggctttccaggtggctccgtgcagctacagccaggccggctgcctcatctcagctctagggggcacgagccatatggggtctgcacaagagaccctctcccctgcagtaaagccaggggccctggcctgatggggcccccatggggagctggagcctgccctgcagcctggagaagagggtggctgtggtgggcgtgctcatcccctgctaaggagcaggagctgctgggccaggtctgcggcagtgctggggtggcaccaggtgggcagtggtaggtggggtggcttgaggtctgggagggtggccctggccagccaggacacatgcagacccctggctttagtctggatacaggctccctctttcctcccaatcctaagctcctgacaagtggccaggtggctctgggccctcctgccccgtgcctaggtcaggggtcctggaataccccgtagctctggcaccaccacactggcctctgatggcaagacttggcccctccacctgtccctaacggacggcaggtcaggaaagccaggactcaggggagaagcaaacccccaggattgaaggctagggttctagggcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcagcgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcaccaagtgagctcatgtttcaccagaggtggataaaaccaagttctgggctgggcccagtggctcacatctgtaattccagcactttgggaggccgaggcgggcagatcacaaagtcaggagtttgagaccaacctgaccaacatggagaaaccccatctctactaaaaatacaaaattagctggatgtggtggtgcgtgcctgtaatcccagctacttgggaggctgaggcaggagaattgcttgaatccaggaggcggagattgcagagagccaagatcatgccactgcactccagcctgggtgacagcaagactctgtcttgg

SEQ ID NO: 38470 - DNA, 6357 bp, Homo sapiens
ggaaccgaccgccgccggccgggttgcaggcggggcacctcgggcaggacctccctggtcggaagtggccgtgagcccaagccgcggtcccgggtgagtacggggcggggcggaggcatgtgcgaggctctctgcctgtacgctggaaagtggggattgcaactcggggagggatggagcacgcgtcgtcgcctgggaaacgggtcgacccgcggaaggcgagcgggtgggacttccggagcagttaatggtggggaaactttctagtggatgtgggaggaggcgggacttcctgcagcaaattggggctgtgcgccgctcaagcccgtttacctgctccccaggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaaggtgagcggggcctgagctggagggggtgtggcctgctgcaaaagcgggaacaatccagagggacgcttggctgctacgcgggattgcagtggtgcagccagccccgaagtcggaaggtgctctctagggagtacaggaagataaagtttgtgcttgatttagaattagctagatcctttgggggagaggggatcgagccgatttagggaggatgttcactgcgcggatgatgctcaggccatcgggaaatccagaaacaggcgacgaccttcgtcaagagaaaaatgatcctgtggagaaaagtaaatgtcgctaggttgggatggatggtaacaggccaagccccggacctatatctagccacattttttgtcaaggaggaaaccaattctgtagagaaaagtacctccctgtcccttgcaaggaccagtgtcaggcaatcctagtgccactatctggctactgcatgtcaaggagccaatcccatgtagaaataaactgcctcttactccctggatgctatagcctgaagcaggccacactccccagaaatgagggacccaatcacacaaggatgcaaatcctgactccacccctccaatcctcagtggagctggtcgcagatcctgagacccggacagtggcagtgaaacaggtatcagtgcctctgcaagggccagcaaggcctggggatgggatttggggaggaattgcaagccgtcagtgaaggggtacattaggaaaatctgattggggccgggcgtggtggctcaagcctgtaatcccagcactttgggaggccgaggcgggcggatcgcttgaacccaggagttcgagaccagcctgagcgacatggtgaaacctgtctctctaaaaaattagcgggaatggtggcgcgtccttgtagttcctaatcgggaggctgaagcgggaggatcccttgagcccagtaggtcaagggtgtagtgagcagtgatcaccacactgtacttcagcctgggtgacagagcgagaacctgtctcaaaaaaagaaaagaaaaaatatggctgggagagaaggggatgtgtccagtaaagaaagaagtgttgcctgtttcagtggggtgggtacctgtccaagaccttagaaattggacaaggcggccaggcgcggtggctcacgcctgtaatcccagcactttgggaggctaggcgggcggatcacccgagatcaggagtttgtgaccagcctggccaacatggcgaaaccccatctctactaaaaatacaaaaattagcggggcatggtggcgggtgcctgtaatcccagctactcgggtagctgaggcaggagaatcgtttgaacccaggaggcacaggtttcaatgagccaagattgcaccactgcactccagcctgggcgacaaaacaagcctatatctccaggggaaaaaaaaaaaaaaaaaaaaaaaagattcggacaaggctgaaaacctgtaaccgttccaaagcccgttccaaagtgaagaggtggggcctaagggtctgatagtggtggagaagggctgatttttccgctgggtatttgattggaggaagctcccggtgggggcggagccagtcccagctcctccctctctttctgcagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtgagggccacgccgagggctgagggagccgccacagactgggacccaatcccacgtttgttgcgtgctctcaactttttagcctctacttacttttctgagaaatgggcctaatgataaatgcagggatcgttgtaagcagttaagcagtggggagaatgatatatgtcagctcctgcgttacccacagtgaccacccagtaatcagcaatgaccatgactgtctcagtaggagctattacgatgaggattttttatgtccagagagacttgagttcaaatgctgttaccaccacattctgagtcccatgtgtctcatctctacgatgctgaatccataaaaaaagcacgtggcatagttcctgacatgcagttagcacccaaagctttgctcctgcttttattttcacggttattagcccaccgaggtggtgaaggccaggggaagaaggaggctgggtaagacattaacccccattttaaagactgtaatcctggggctggcgtcataaggagtaacaggagacagtaaggttaagatgtcgggccccactcagaggcatcacggatgcttgagatggaggtgctctgtgactcggtttccccatctgtgagatggcagtgataacaccctgcctggcagggttggtgtgagtcagcctgtgagtgaggagggtcagaggtatcacagtgctgctgtttgtctttccttggtgacaccaggtggctggctttgatctggacgggacgctcatcaccacacgctctgggaaggtctttcccactggccccagtgactggaggtgataagaggcaaaacaagggagtgagtgaggcctggagtccacctctggccccgggtcacccctgccgcttcatacctgccgtaggatcttgtacccagagattccccgtaagctccgagagctggaagccgagggctacaaggtatgtgcagccgcctgtctgcatgggcacgtgcacgtggcggtccgaccgcagtcagaccaaggccctggtgagcagagcgtctggtgacaccctttgctccccagctggtgatcttcaccaaccagatgagcatcgggcgcgggaagctgccagccgaggagttcaaggccaaggtggaggctgtggtggagaagctgggggtccccttccaggtatggctggaagggaggctgggagctatgtgggggcacagagatccagagcgagggctttagactccagggtaagcggggcggaggcctcaggcagtgtgatgctgataggaacccatcatcagctacaaattctgggctggggtggcatccagtaggtgcttgagggggagctaaagctggtggccccctcccatccacaggtgctggtggccacgcacgcaggcttgtaccggaagccggtgacgggcatgtgggaccatctgcaggagcaggtgagtcttgcagcctgcccggcccccctccttttcctcactccagcccctcactcctgggctccccggcctccggttggggcctccttactcctctgtcctctctcgctccctccttctgttttttgctgtgacatcttagatgttggtttacgagaccagtgctttcagactttctacatcagagtagtagggaagctgttcattccttcgttcattcgtttgtgtgtgcatttgttctgaagtttagcgcattcttgagctgaaggtatcagtgagcgggacggcctgctccagcagggccctcacggcgagggcggtgactctaggcggatgggcagactggcgtgtaaaacagcaggagggagggagctggagaaagcaggcatcacccgtggtgggcagggatggcctctgaggaggtgacatcagaggaaaaggcctaaggcagggaaaggagggagccaggtggacacctggggaaagcggtccccccccttgtgggagtgacagcaagtgcaaaggccctgaggcagtccctagcctgggctagttagggacagcgaggcccatgcggctggctctaagcgagggaggggagagggcagggccacagggagggccccgcttttgccctgagggagggggaacctgggaggcgccggcacgccggaggctggagctgtagcagggtgggtgccctccggtggccgcgtggggaacgggaggaggtgaagtcgggagacctggagggagggggctgtgtggagagaccacggaggggggagggggccaggagcacggtgcaaagtggctggagagtgaggacatgaaaggtcgggggatgattcctgatgtggggcacagaccaggcgaagcagccccagggacccgctaccgctgcggggggacatttgtgggaagggcctcctcactaccgtctcccgtaggccaacgacggcacgcccatatccatcggggacagcatctttgtgggaggtaagggcctggaggctgctgagggtgggctgggacgcctccctccgagctggtgggaacggggtgtcccgtgtgttccagacgcagccggacgcccggccaactgggccccggggcggaagaagaaagacttctcctgcgccgatcgcctggtgaggcccctgccccctgccccgcgcccgagcccgaccctggcctgtgtctgatgttcgtcctcaacccctagtttgccctcaaccttggcctgcccttcgccacgcctgaggagttctttctcaagtggccagcagccggcttcgagctcccagcctttgatccggtgaggccctggggcgggggtgggggtggggatgggagggctcccggggatggggacggcatctcacgcgtgtcccccgcccctcgcagaggactgtctcccgctcagggcctctctgcctccccgagtccagggccctcctgagcgccagcccggaggtggttgtcgcagtgggattccctgggggtaagtgtcctgttcctgtgcgcgtgccctgagccccgcctgggtcctaggccacccaccgacactgccccccacacagccgggaagtccacctttctcaagaagcacctcgtgtcggccggatatgtccacgtgaacagggtatgaccaggcttttgccgccccaaatctattataaagttcccatctccacctctcaactggtttggggcggctttcctccatcattgcctccccgtccccgctcggggtcttctctccccctgggtctgccgatctgtttgtgacctctcgtgtccccaggacacgctaggctcctggcagcgctgtgtgaccacgtgtgagacagccctgaagcaagggaaacgggtcgccatcgacaacacaaacccagacgccgcgagccgcgccaggtagcgtgaccgcggggccgtaggtggcctgcggcggggtgggcggggcctgcacatccagctccttcccccacaggtacgtccagtgtgcccgagccgcgggcgtcccctgccgctgcttcctcttcaccgccactctggagcaggcgcgccacaacaaccgggtgagcccgctcagcccggacaccccccgggctgcaccccctgacccccctcctcccctgacccctgggcctgccgcccctctgatgttccccacagtttcgagagatgacggactcctctcatatccccgtgtcagacatggtcatgtatggctacaggtactgttggggatagcagggggcaggggcactggctgggccacatgatccaggctgtccctcactgttcccaccactgccaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttg

SEQ ID NO: 38471 - DNA, 24662 bp, Homo sapiens
gcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcaggtagggagaaatgggtggacggcagggcggcgagatctaggcatagacactgccagggctccgcgtggtccggaccccaagctccgcccagtcggcctcccagggccggggtaggatacctgcctctggaggagttgacagtggtggttggagattggagggtgtgggagcgcctctccgtatttcgcaagggttccccctcaactgggcgccacgttgtggtcgcgttctccgaggcagaggatggtggagaacagccaagctccttgtcggacctcccacatctcgctagaaggaggccgaaagggagagaaattgctgttgctgctctagtgctgaggagtttgatattctagatgacattttcctcgtatgagatggctcaaagagttatcagtaattcagaactgaagcactgaaattccctgttttttcagtgtagttctttcagccttgacacttctagatgggacagagtttctgagtgaaagataatgcaagtgatacggtatgcctcaagccattccctagaggtaggacatggagagagaattggtttggaagaatttgggtgaattaagtaaagactggtggaaagctgaaatagaaaccaaacattcatggactctcccttagttctactagttattagttgtgggatatagctaagttctgtattctctttaggcattagtaagtgtccaatggtgactattgttgttaaatgtagttatttctttattagtctttatttttcaacaagtatttattgaataccttcttgatgccggatttttgctagtcactgggtgtacagtattgaagacaaaccctcagagaccttttgatctagtgggaaatgcagacatgaaataagtgatggtatgtaacagagaaagtatgggggtcatgtaatggggagggggcagggataatctcttaagaaaatgatttatctgagacctgaagagttggaataagccaggtgtgagcactggggtggggccaggaggaggaaaaggagtgtacctggcaagggaatagcatttgtgcagtttgtaattgaaaggtcagtaaggttggaaaataaagtgtgagaggaaaactggtaacagataaggcaggagagttattcaggcccaacacggagtgccttataaggcactgtaaggagttttgactttattgctaagggtgatgggacgccattggagcattttacatagtggagtgctaaattttggttttaaaaagtacacttcttagagagggcaagagtggatacagggaaatgttcaacatgatggtggccaaaattgggatggtgaccctggggacgagaagtagaaacatttaaaaaatgtttaggaagaatagtagacaggacttggtgaggattaaatgtagatgatggtggagaggagggttagaatagtatgtaaggttttatgaaataatcagactctggcagtgattggttagcttttcccatatgcatattgactcctctatggtccattttcatctacctctggaataattgtccattgaatcattagtgacggcaaaccgattgaaaaggaatgtaatgtttttctgttattctctaactcaggctgtcttttgaagaagatcagaatggggaagagttttgtaaattagccatttaaaaacaatctgccatgttgattttggtccataggaaggtaactgcatatattgcattatatggatgcactgtacttcactaattttttttttacatgtttacatttactttgtttccaggtatttacctctgttaacagtgcagaacagagctggtgcttcattttctataggtagattaatatatgtgtgcacttaagtagagagataataatcaaagacatagaaataaatgacattgcttagagaaagtatatagtgagagaaaagcctaggtttggggttgaacatccaaaggatgggttgagaatgaagaaccttcaaggagaccgaggaggggaaaccaataaattaagaaaaaaaatctggggagttagtctttggatgcctgcaaaaaggaatggtttggaaggtgagagaagtcaacaatgtaaatttgtttaaagaatatgcaggatatggccgggtgcagtggctcacacctgtaatcccagcactttgggaggccaaggcggacggatcacctgaggtcgggagttcaagaccagcctgaccaacatggagaaaccccatctctactaaaaatacaaaattagccgggcatggtggcacatgcctgtaattccagctacttgggaggctgaggcaggagaatcgcttgaatccgggaggcagaggttgcggtgagccgagatcgctccattgtattccagcctgggcaacaagaatgaaactctgtctcaaaaaaaaaaaaaaaaaaaaaaaaaaaaaaaaaaaatgccagtcgcagtggctcacgcctgtaatcccagaactttgggaggcgaggcgggtggatcacctgaggtcaggagtttgagaccagcctggccaatatggtgaaaccccgtctctactaaaaatacaaaaattaactgggcatggcgatgggcgcctgtaatcccagctactctggaggctgaggcaggagaatcacttgaacccgatagtcagaggttgcaggagaatcgcctgaacccgatagtcggaggttgcagtgagccaagatcctgccattgcactccagcctggacaacagagcgagactccgtccccccttccccctccccccaaaaaagaatatgcaggatactgagtgaaaagtacccattggatttaggaatttacaggtcatttcaacacttagcagagcagttgtgtggtgggaaacaccatttagtggtttgaaaagtgaatgggtaagaagtgaagcaactaaataccagctgtcaaaaggacacgagattgagcttcatagaggatatggggatgagcaaggattgtttttgttttgtttctttacttttttggtattgtttttaaaagaaacagatttataaatgtttaaatactaatggataaaataaaagtgagagtttgcagagagaggagagagtctgatgttctagaagaggcggaaggaaagatgcacaatatggctgaaaggtttagccttagatagagaagcaactgccttctttccttatattcggagatataagtagaggtgggtttgtggacttggaaactcaagtgagctcccttttgatgactctctaggaggcagagtcatctggtgagaatgcagtaggaagaagtagggtatcagagatttgaagagaggaaataggggtttgaatagtcacaagaatggggaagaatgttgaccagggaaggatgttccatggatttagagtggcaccatttagcctagtatgtgaatttcttccccccgtccagcagtgttcagtagtctgagcccagattgtaccatcagctctttgaggatatatattctaacgtatttgttgaattattttataacacacattagtgatgtttaaaaaaaaaaaactcaatgcattccagattttgtcagtttctcacactcaagttaaaaagataaaccaaaatataccaaaggaagacattttctttaacattatgtggtaccttaagacatgagtgaataaagatgtaattaaggaaaatcagttggaatacttaaatagacttagttgtaaaaataaaaaaaaatgtgcttgttgaacgtataaaagcaaaataagtaataatactcggaacttcccagagaccctaaggttgctttagtaacattcctctccagccagatgagtactaagagttgattccaggttctcatgtttctcttgagccttttagtgtacagctattaagaaagtacaaataaactaatcaaaaactcgtgggttttttttgtttatttttggaggcagagtctcgctctatcccccaggctggagtccagtggcgtgatctccgctcactgcaacctccgcctcctgggttcaagcgattctcctgtctcagcctcttgaggcattacagatgcctcccaccacacctggctaatttttgtatttttagtagagacagggttttgtcatgttggccaggctggtcttgaactgctgacctcaagtgatccaccttcctcaccctcccaaagttctgggattgcaggagagagccaccgtgcctggccctagtttctttttaaatatctgattgggttctctttagatagcattaccgtgaaccattgatcagttcttttgaaacagtatactaggaaattttgaagaattattatagatggttaaatcattttttgactactatcattttttaggtgtgacttgtggaagctttaatttcgtgggtccactaacaaatacttgtagtaacgtttgtttaagtagaattgaaaagttcttcatttactttataatgactattagggtgagcatttcagtttttcatttttgactcggaatttgtcaggaattggtttgctatagagatagtgtttagatttggaaagcaagtttagtaatcaaagtaatttaatagagataaaagtacagggagaattatggctcaactttagggactgagtaactttaatactttaattctagtaagtttattagttaaacaatgtaaagaccttgtgtaacattctagagctggcttgtaaaaagatgtaggggatatttggcaggtcgtaatggttgctgttactactaatatatacaagtgcttttcaaattagaggtaacgatgaagtccttcattcactttaagaactaagtagctttctcttgtaccaaaacctgctacaatctaagctaaagcgaacatttcacctttccttgttgttgaaaaaccagatatttaaaccagaatgaattaggtgaattcttcaccatctctggaagaacagttctattcatgcagtcatagcatatgatgagtagaaagcacagccatgtctgtctggataaactgccaagttttaagccagaaacagtattcattaagatattgcaaatcaggttgtaaactggatttcagtttttaaactggattttttcactttctatatgcatctttatataaaataatgagtaaattatataaaattaactctgaaatattgttttcttctttttagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcacaggacagattacaatagccttgatagaatcatggcatccaaagggatgcgccatttttgcttgatttcagagcagttggtgttctttagtcttcttgcaacagcgattttgggagcagtttcctggcaggtaagcttattgtttgtccagcaaccccaatgacgtgtaataaaatgctagcttcaataattgaaattaaagttataaggtcaagttcctgatttcaaaaggatattcatgtttgctcttaattttgttcatggaattgaagcactgaatgtgtttcaagaggataatttatttgatctctagcaaagaggtaccaaaatgttatgaacactcagcgttgagatgcctcccgcttcctgactgttcattagtgaaacactcatcgattaaagagtcttagaatactaacatttggaaagtatttaaagattgtattttgatcctttaattatacccatgaggaaactgaaagccaaagaagacacatccagagtcactagtactagcaggaacaaggttacttaacttctgtctattccctggactcctcactgtaacatgtttcttttatgcagccatttctctgaaggttttatataaaaggtgatcagatatataacaacatagcaggttcttaattatagattagaggttatcctaagaaagaaaacatgggtttcacagtacctttgctgcccagaaatgttttctaaaaggttcttgtagacaaagacatttgtacagttggagtttgcatctgcagtattaacaaacccagtcttccattaattgagcatgtattgactatgcactatatgccaggcactatagtgggtgcggaagatctcaggatgtctgtcaaaggtggcacagtctccaatgggaggaggaagaggctggcatgtaaacaaacaattatgattacagtgtgataaatactataatctgtgtacatcagactgggatgtggggcataaaggaaagtcagctctgcttggtgcagctctctgtaagagtttgttgctgctgactgatttctagaggaaagtcagctctgcttggtgcagctctctgctttgtaacagtttgttgctgctgagtgatttctagaagtgtgttttgaagagggagatgtgaagacttgcctggacatggtgctagatttctagtcagctgggctagggcagggatcctgtgtgggagtcagccaaatgaggaaaacatcttgggtgtggcctgaggatattgtccttactttgctctacttgctggtgttaggtactgtcagaattatgttgttgatgtcaaaaactcaagcatgagttttcctccctcttccttgcccctcctcctgctagctcctttcccagccctaaatactttttcttttccaagtcagcctcattcatgctggatgccattccaggctttcaaattctgttaaccaaatatgaatattttcttggtctccaaactttttcttacctagtggtcttcagatatggtgtgtaccactggaggtacacaaaaactttccaaggagtctgtcagcagagataattttaagagaatcagtttcctgattctcaccttccattctactctttcctaaagttgatctacttgagaatccctttagctgtaggtgatagcattgtggttttaatttatgtctctaatgactaatgatgttgagcatctttttatgtgtgtattagccatttactttgttgtttaaatattcacatcttttgctcattttaaagctgaggttatttgtcttttaagagttccttatatattctggatacgagccctttgtcagataaatgatttggaaatgtttactcccagtctgtggcttctgtttttattttctgaatgatacaaatttttgaagagttttcaagagtaaaggtttttaattttacagagtccagtttatccactttttcttttatgggctctgcttttagtatcttatctaagaattctttgctcaacactaggtcacagttctttcaaaagcattattgttttaactgttacatttaggtgtatgatccattttgagtatagtatgagataaggatctaagtttgtttttttttttttaatatatagatctcattgttcccagcaccatttgttgaaaagattaacatttcgcctattgaattgccttggcgtctttgtttaaaatcagttaaacataaacgtaaggttgtatttttgagtttttttgttatattgacctatatgtctaccattgtgctagcactatgccatctggtgagatgttttctaatttcctttgaaatttcctctttgactcatgggttatttataagtttgttgtgtgatatcctaatatttggaagtttctcacatttctttccattgatttctaattccatgtagttggagaacactgtgtgattttagtcttttaggccacttgttttgtggcatggcatgttttattccatgttcacttgaaaataatgagtcctctgttgttgggtacagtgtactataaatatcagctagattaagttggttggtggtggtgttcatgtatctatagccttgttaattttctgtctaattctgtaatactgagagagatgaaaatctctattatagttcctgaattgtctacttgctttttcaattctgtctttttttttttttgcttctttattttgaagcactgttcctagaggtaaatgcatgtttgttatatcttcttaccatattaactcttgtaattatggtaaacagcatagttgagtagttaaaacagagattgtatggcctgcaaaacaaaatattaactatctgtgcccccgttttttttttttttttttttttgatacggatcatgtatttgtgtgaccaccactaccacagtcaatttgtagagcagttaaatcactgccaaaattccctcttgcttccttgtagtcagtccttctcccaaccccaggtacttggcaacctgttttccgttcctagacattttccttttccagaatgtcatattcgtaaaatcatttaacattgtagtcttttgagcctgacttttgtttttgagacagggtcttgctctgcagtgtgggctagagtacaatggtacaatcatggctcactgcagcctcgacctcctgcgctcaagcagtcctccctgccttggccttccaaagtgctgggattataggtgtgagccactgcacctggccctgagtctgacttcttatttaaatcatttgagattcatctgtgttgctgtgtgccatcagtaagttagttacttttattgtgagcaatatcccattgtatggatgttccagtttatcccttactcagttgagagacactgaaattatttgcagttttttggtaattatgaataaagctgctataaacctttgtagacaagggtttgtgttaacataagcttttattttagtgtgatgtgggattgctgggtcatgtggaaagcatttcttttaactttatactgccatacatatgtatttctaatctacagaataagctcatgacataaattatctctgtatatattccagaaatcaagactcaaaaggttaattaacttattcgtgtacacatagcaagtggctgagctgggattgaacaaaagtctaactccgaagcttgggtcctttccactatgccctacttcttccacgtaaagaagtcatttgactttaaaattatacagtagccttcataatgttcttaaatttcctgaaacaagcaaagttttgaaagtcgcctgtggtttcttaaagctggatttctcacagtctctccatttatatattgccgcatttacgtatactgtttcttagttgggctttactttctttagacttctatgtatgttttccaaatctggtttgcataaggtgactcatacaagaatgcttctaaacaaacaagccgtatatgtttatgtaaatgttacattttaaaaatgacattgcataaagaaattttgttcctgttatctgaaaaattttaggatatgaaacattgaatactttgaccatgacttgaaagcccagctgaatagagatctaataactagtaacaacttttattcaaagggcattacttacaggttgtttattggtcttcttttgtgctcagtttatatctgctctgaaatatgagccatgtcttaaaatttgataatgagctgaggataatttggagaagcaaaggagaataagtacttgtaggcttgaatcaattgatcttatttgttacttggaattaaggtgtaaggagtactccaaagtcacaaatgacttctagattgaagctatagaataaaggtttgcaggccaataaaattgaagctctctgaaagtggcaagcagacaaaacatcctaaatttattttggcttcccctggacatacttgccatctgttcagttaagattacgaatttttgtattgccaaaatactaacttgtgtgtgatcataatagaatatttaatactgtttttctaagcttgctttttcaaaataacctaatagaagtacttaatgattttttcctgataaatttgctttctaaaaatgtatgacagggccaggcatgatgactcacatttgtaattccagcagtttgggaggccaaggcaggaggattgcttgaacccaggagtttgagaccagcctgggcaacatagggagaccttgtctctacaaaaataaaaaaattagccaggcatggtggtgcatgtgcctgtggtcccaagctacttgggtggctgaggtggtaggatcacatgagcctgagaggtcaaggctgcagtgaatcgtgatcatgccgctgcactccagcctggacgacggagtgagaccctgtcaatcagcataaaattctcagtttctaagattttttaatataaaaagcaagtagtaacagatcatctgttatttatgagttgtgatcaatagacccctaaatatctacttatttagtctactgtatcaaatatcatcatcaatgttgcaaaaccaacattagggtattgaataacatcactatcaattaacattttaattggaattttgaattattaggcttttcatttaagtcatctacaaattgattgacaattgaactttatcatttgcttagttcactgctaaatcaaactgtttaatacttttttctaatagtaaaaacatactgaagattgagaagcactggtttagaaaaaatatgtaaatatataaaatgtaatagcctggaaatcaatcagaaaattggaactgattccatttgtaagaacagaaacataaaataagttttaaacttataaaacttttattttaaaattactacaaacctcaatgtaggttataaaagaagacttcaataaatggaaaaacacaccatacttcctgggatgaaaagactcaatgcggtgccttgcaggcatttgtatacatagaggaaactgttttcaaagctgagctgcacttttggtcccctcaagagtggcaaaaataaaagccaagcccagggcctccagaagtgagatctctggtaaattacctcccattttacgcttacacactgaaagaagagggtggagccatgtgtgttatagccctctcatgaacttgctttctgcccttgtgtcctgttggtggttcaacctgggattaagtggtcaaacctgaattaagatatgtagactcgtaatgtccgcagctctctggaagaaacagattgcctctaggagaaggtatcattatcctaggcctaaagttaataataatataatttttatatccagtgttcagcttataaatttaaccaggtacacacacacacacacacacacacacacacacacacacacacacacacacacacacagcaccaagagcaagaagcagcaaaaccaacagacaacagaaaaaaatctttaggtattggaattatcaaacagaaaaccatcatgctaagttgcaaaagtaaaaggagagatcaggacataatggtagtacactggaaactttaaaaaatgacaaggcagattttacaaagaactaaatagaaatttagatcaggaaataaattatttcagtgttgcaaacataacattagacaaagctgaagtgggcattagtgaactggaagatacagttcagaagaagctatataagcagcagcatgaaagagcagtatggaaaatactgaacagaaggaaaggataagactcagaggatatggtaagaagatctcatattttataagagtctcaaaaatagagggaagaaatgaaggccaaaggaaatatgtgaaagaataaaaaatagaacaacagaacagaagaagagagaccaaaaacaggtccatgaatacttatgacaaaagtggcactgtaatgtggagtggttgatattttcagtaatttgtgcttgaacaattgagtgtttctgtagaagaaaaaattggaccattatcataaaatcagttatatttggattatagttttaaatgtaaaggcaaaacaataaagcctttagaggataatgttaaaatatcttcttaatggttggatagagggattttttttaacaaggcataaagtgactatattataattaagaactcatgttaagcaaaaaacagcattaaggtagtcacagagtcaccaacaaaagactttcattgaaactatgttcagaaccaaacaaaactaaatcagtgaagaaaaggtcaaccccatagaaaggtgggcaaaatatttaacacttcatcaaagatgatacccacatagtgaaaggtacttaacctcattaataatcagaacttgatatttattctagttttggtgtaatggcaaactgtaagcaatttaaataccaataatgggatccactaattaaagttttatatgtatcataggaatgccatttggtctttacaagtgatttagagtaatgtaagcttaaattaaaatgttgatagattatgtatcccattttggtaaaaaaaaaaaacatacacatgaatatgtatttgtgaaaaatacattgcatgaagtctgggaatatttcagagtagctgtgcgtatagatgatggtatttggaatgattttaatcacatatcttttttacttatttgtattttctagtgtttttaaatggagcatgtactgtgttatttatgtcattgacaaaataggatgtaccaaaatagggcagtatattcatttttctattgcaggaattaatttttttattaaattttgatcaagtgaaccaccccttagtgttaaaagtatgtgttcatgcacctaggcatatagtatgtgcagtagcaataccggaagaatgtaatagtttaatattctaaagaaatgttcaagtgactatccattttcttttcacttaaatgagtcttaattttttctgctttttcattgcagttaatacctgattgcctcctccttatttcttctgcctgtctactttccattctgcttttacaatgcttatatgtccttaatattttcttctgttaaattttgattgcacatctagagagttcagtgctttataaggtaaactatatcatataaacggaattcgtttttatagctttagggtcttaaatttccttaagaacttatacagaaagaaagtaatagagaaagaatacagaaagcatatagaaaaaagtaatagtttaatattctaaaggtatgttcaagtgactatccattttcttttcacttaaatgagtattttttctgctttttcattgcaattaatacctgattgcctcctgcttatttcttctgcctgtctactttccattctgcttttacaatgcttacgtgtcctcaatattttcttctgttaaaattttgaatttgcacatctagagagttcagtgctttataaggtaaactataccatataaacggaattagtttttatggctttagggtcttaaatttccttaagaatttactttcataatttcatggggaaaaaatgacccctttctaaagcactctttttgataaagtaaataaatctgttatttgaaaaatgacataggcatgtgggttttaacaagatatttgttttctggcattttctctgttatatcaaagagtggttttggtttgttttgttttttttttttttctcgtctggataggatgttatttgacaattcttttttaaaaatgatgtgccgtgttttgccacaacttccaaaaaactaagagataaatttaggatttattgcactagttagctcatccatgtatacgtgtctgctttaactgaaaattgtttttagatcattaattgttccttttatcctttttgaaagtagaagctaaaaaatgtgaatcaatgtgcatgcatgtaaatatatacacatatgtacatgtactatgtaaacatgttttggatttcttttagccaacaaatggaattttcttgagcatgtttctaatcgttttgccattggaatccatggctcatgggctcttccatgaattgggtaactgtttaggaggaacatctgttggatatgctattgtgattcccaccaacttctgcaggtacagtaatctagtatagttagtgataactattcacttcataacattttcttaatatttatatgaataaaatatagctccttttcaaaactgttttcaaaatataacttgtgcatttcttccaaatttttaacaaactttattccaagtgataatatcttcagagttaaattgaaatattttgataaatatgataagcttatattttagctagaaaccagaaaatattcatgaataacttttctaaggaaagatcttaccctaaagggaatattttgttaagaaagtgtcctctggctggtcgtggtggctcacacctgtaatcccagcactttaggaggccgaggcgggcggatcacctgaggtcaggagttcgagaccagcctggccaacatggtgaaaccccatctctactgaaaatacaaaaattagccaggtgtggtggcaggtacctgcaatcccagctactcaggaggctgaggcaggagagtcacttgaacctgggaggcggaggttgcagtgagctgagatagggccattgctctccagcctgggggataagagcaagacttcgtctcaaaaaaaaaaaaggaaaaaagcaaaagaaagtgtcctctgaagcaacatagtgaaatatagtaaaacgtgctctgggcctgagaggctggaggtctagttctttgttacctttggtacactataactactctgaaccttattatctgtctttgcctaaaatgtatatagtgataactcttctgttcatctgacaggaatggtatgaagcactaaaaaaaaaaaaaaaaaaaaaaaaaatgtaaaaacactctgcacactgaaaaatgccatacaaatactaggaattcagaggattggcagtgaagtttaataaatgtttattgcagttttattccaaaataacttttacccacaaaggtggtgacatctgtataaatctgtaaatgttgctacattttgatttttattttatagctaactacctttaaaataattctttgccataaatgaattctgatgacagttttcatcacactttccctgggggagaggagagtggaagtaaagttttttcccaatttcaagtatttgacataaaaatctccaaatagactatttgtaggaaatattttccttcgttaaagacttaatacaaagttgaaggtttaagaactgaaggaaacagatttggaaatgtcacataaagtgagaaatgacaaccttgtagaaagaatgtgtggaaatagtaatatgcacagttagatatttattccattgtaatttttttaatgtattccttactcttttgtgactgtaatgaaaaaaagttagtagaatagtactgatgatatatgaagcaaaatctaacgttttcaaaaatcccgatagaaatcccttttctggataggaatgatgattttttctttctcaatattaatggtattttgctagttataagacttgctttatcatctttgtactagagtaccattttatatttgttctaggagtaaatctaagtcttcaactagtgtccagtggtataaagcaatggacctaaattttaataactttttaaatgcctattaatagataatttcttctattatttatgtaccttaagttaataaaatttgaacacaattttattgactatttttcaatacagaagtaaatatataattaaaatattgcttttttattttgtgttataatatttttaaagaagtttttttaatagtccccacccagatgttcttgaaacagtgtaatcctgcttttaaaaaaccttgtccaatatttgtcatgtaagaaaatacgaataaggaacaaagagtaatactatctacatttggagacattatcccagcttttaatttgattattgttttaatgatagtaaatataatatttagaaaccaggttttgattttctaagcttaattctcagtactataggaattttagaaagggtgattttttacaaaaatcctgccacttagcagcaactatattataactgattcttagataatcagttacaaatgacagatgagaatgtgatatagaatgagtacttcttgttttttctcctacttcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtaaactcacctttggcagtttcactattgtaaagatacacatgtatatgtagaaatctgtacttcacacacagtcgttaaatttccaggattcttagtttactgaactatgcatatgactctaatttgtttttctttgctctagcatacctgtttagcctaatttaatctctaatgataagattgggaattacgtcttatagtgattagaaggaaaaaaatgctttgagacttacagtttcccttaaaatattttcagaattgctaaacatatttttcagaagctgataaactcctttgactagtatctttaagtttttaaatgttatggatgcagatttcagtagtccttcacatctgtagttttatttatgttataaagctcaccaaaattttaaacagcagatcatgtagtatggtgggagtagcacttaggtcaggagaccttggttctggtcctaatttgccacagctgtgttattttaggcaagttagttaacttctgttggcttcaattttctcatctgtaaaataagggggtaattgtaaatgaccattgagttttattctaaggtacaaaattctgtagggatttttttgcatttgaaaaaacataaaataactttggtttgcatgcattatgggaaatagaaaacttcttagttattgccaagagagaaatgagatctctttatatcatatataaatttgtcagtctttccaactattaatagagagaaagtcaagggctttgttttatcaactgttacttgtttaggacctataacagagcccaatacatagtagaggatccttaagtagctgatagatagatgaaatcattgaataaatcattaaaaaaggtaattttcttattttagattagaaatagttattttagatttaattacatgatttttttttccataaaagtgtagatgttttaaaccaagaatatataaataataaaatagtcataaataaagtggaaacattcaggataaagaaaaagataaatagaagtagtatggaaggacagaggcagagttgccaatataagaactccagaaagagacaaacaaaaaggttaaggtagagatgattttaaactagcatgatctcattgatttcatgccagatttgtaactgaggtttttatcataaggagaaatatttttttgaaatttttcttttttgcaaataaatattgaataactcagtggccttctagtagaaagacaagctaatatttattgggtacattttaagcatcagcttactgtacttagtaccttacacacattgttaatctttatgtgaaatcctttgagatagataccatcacttctgttatcttcatttttcaaacgatgaaatggaaattgaaagttgttatgtaacttatctgtggtcataccactatgtgatagaaccatgatttaagaccagatctgcctgattcctaaagtgtatttttccccccactctaccatgttgcctccaagggtgaaagccatgatgataaaggaatggcatgttctggttaagtggatatttttgttaacatgggtcacccatttcaaaacattagaatgtacaagactaaaagatgcactgaacattaaaactaattgaatatagtttataaaatcatttacttgacctataactttttaattacaacgtagaaagcatctttttaacctttatggctacttcagtttcaggtaaagtataacgttctgtgtattccaactcagagcacaagagaaagcttttagtcaattaaaatagcctttacagaaatagaattttagatctaaaagcagagattgctgaaacttactataatccttatgataataaactctacccagatcaaatggaaaaaacagggctaatttttggtggccatgcatatatccctagttattttaaagtgttagagtaattttagaagtaagctttttatgtgtgtttatatgaaggatttattacttaatagaaacacttttcaaaaagtttgcatttttcttaagtaatttaaaattcattaagtatttcttaaagatagctatggaaatcaattctagatgttcatttactaatacttatatcagctttttatttttctaagaaaagtaaaaacactaagataaacacacacacacatatatatatctctcgcagtttttctaaattttcattcactgttaggaataatttttgaagactttaagaacactaaaatagagttgtattttaggtaaatgtttagcagttacattctagaatgatgtctttataatttttttgaagtatgctaccagtaaattgaccgttacagaattcctctgttagctaagatttgttcttgtgtaactttgaggcttattataagaagtttaaaaaaaagagagagaaagcatactgatctcccttccctgagaaaggtagattttatcttataattcagcaactgcatactgtcatgcatggcctgaggcatctcgcatacttgtgggtagtcaggttgaaccaggcccagaaaagcccgcttttcagttagttcatgccctggcctgctttagacgtagtcctcaagggctgattctgcctcacaaatagtattgaatatctctgctctgaggaaaatactttcatctattccaaattaagtgacaaagagctttaagctctgctaatttattaatagttggggattttttgttttgttttttgttgttttttcagcaaactttgaaataggaaacatcacaactggattttacttgggttagcaagttgatagcaggcccagtattaatatcgctgtgggaaagagaatctatatttgccctttatcccataccttcactcacagtagttagaatatgtagtcttcttatatttatggagtttcatgatatggaacctaatatttttgcctctgcttgaggatagaaaacaattatggtaattacaggagagacagaaataaatggaaaaaatgtagataatttataaagcagtttattacaaataaaacctttaaaaagcagtctcaattacttaaaatgcatcagatggatattagcttagataaatgtaagtactttgaatctgggccaaaagccaaatgtagcatagaacctattcataggagaaagcagagcaaaacaagagaaattgtttagaaagctttaatgctgctttaggtctcgttgatatctaaagagcatttatataagagaattagggtagaatatgctcaagaatgtttattgaaatagttgtggatggcatgttgggcaatgatgttttgtggcagatggaatttacataatagttcttgtaatctgtgtcatcttctgatctctagagaaatttaatagagctgacaataatggagagttaacatttggccatttttgaaaaagtatcttttggaggtatcagtggaataacacattagtaatatgtggagacaatgtactgaaatagtgtctctgagataatatgtgtgagtgttagagcgattaataaaaaaagtttattttcaggttcttaagcttactgattaataaaacattaataaatgacacataaagaatatgatagaatcccaattctaaaggattctctctctggtggtgtccatttttaatggtgaaaccaagaggacagttgatttggggaaaatgttgggtcttgtgctggtaaattgtaaaagtaacttatgctcaatgtaaaactgtcagaaaaatattttaaaaaccacatggaagtgaaacacccagcaatagctgctgttataatttttgtagatgtactgtcatgctttttctaatatagacattttctcatcaataaattttctttataaatattttgttataagatttcctcctaaggttttaggccatagttcatttccatttcccaaatgggaaggtcgtctttttttgtaattttttgtccctatgtctgttctttccttaagatagattcgtagaattggaatgatcgttatcagtgtaccattgagacagggccagatgaggtgagggtggcagttgcctcaggcacaaaacataagggaatgccaaaaaactcaataatcaaaatgaatattttaatgtagtatacttaaaaatcaaaattaatgcaaaaaaataacgagatgtaaaacctgtagtcagaagtttatttactttagaactttctgggtatatatatttttttaatcccttgttcttcagctataaaactgatttaaatgtaaatctgttcttaaactcattcttgtacaggtaggaacagggtttattttcattcaataggtacctacatatgaggaagagaaggaaacaatgatacagaatggggaggcaaactttttctgtaaagggccagatatttttggctttgtgggtttagatgcctgttgcagctattcagctctgctactttagagcaatagcagccatagacggtataaatgaatgaatgtagttgtgttccaataaacttatttatgaaaataattatatgaaacaaattgcatacagtttttactatcacaaaatattctgattttctttcaaccatgtgaaaatataaaatcaattcttagctttcaggccatacaaaaagaggtggcaggctggatctggcccatgagttgtagttgctgcccctggtgtagaatgttagcttttctgtatagttgttttcactaaatacaactgtgtaaaactatttccttaattttatactagcagattcctttttatgtgagtaataaggattttttttacctcaagttgaaaatctgttgtaaaaaatatcttttcaaaagatactttgaaagtgtcatttaaatactttatttttttgcttatttaattctaagaacttaaggaaaatacatgtataacaagagtattttctctctagaagaaaatgattaagagggttttcttaatgagaggctgcagaaattattgctccattgaattttctcttgttcacaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaattttgttaaaaattaa

SEQ ID NO: 38472 - DNA, 103333 bp, Homo sapiens
gccccggcccctcctgcccatggcggtggccgagctgtacacgcaggtaggagggtccgctgggctcctgggagcgctgtgggggagccggccctgctaacgctgactcgacctggcgcccgggccacacctgccacacctgcgcacctgacacggcagggcgggcgggcgcgcgctgggggccgcggaggcgccgcggaggggccacggggaccggggacacgagcgagcgtcgcccctccagggccccggcgtgctccgtccctgcccgcgggtaagccccctcctggctccgctgcgcctgggtgccctgtgggtgggaagaccctgtgggaggggccgccccctccgccgctccggcctcggggcctagaatccccagtgcccaggggtcgcgcgtgcgtccccatctcccgggactggagcgcctcggtcccttcctaccacaccacgggtggaatcagagttgcccatgcggacgtaggaagatgagacgccggccagtctcctggcccctcctgggacccccttgaacgagctggcatagaagcttatggccgcagtgttcgggctgctttctagaattctgtgtcttcaaagtgcgtgaacgtgcatgtaggctcatcagaagctgaagcagcctgggtcacaggcttgagggcactgcagtggcaccaagcgcttggggagcccaggggccacgaggtgcagtcgtaggctctttgcctaacatctgtactgttagcaacagtacaaacaccacagtttctaaagcgcctttcatataccctgactctgggaaacactagagcattcctcagaagcttcctttctgctggctggggctccacctcttacctcggaagggcagcgttcccacatatgtcccaaaccctctgagatgggcttgggtaattatttggataaagagtgtgacagtgttagcacttttgaaaaaaaaaatccatttgaatagccataaagcctgatcctcctatacaccagttggggaaatctagagacctcagtattcagacgagtggaactagaatccatccatttccccggacacatgctctagctttctactttaaaagatgcttttgctgtagatagaaaagatagttatttaaaaaatcatgtttcaatggtttaagcaaacgtttttcttctactttgattacttagtaacagtccggacacaaagcaaccgaactgtagtttctcctctattgcatctccattaactggagttctaaatggacagtgtttgaattgccctagttttgttctagaatattttcaccagtgagactgtgagccctcagacagccaacagcgcttcttcagccttcagtttactggaagtgaaagaaaagtcttggactagtcttcgacgatactttggaggacagagaaaaatgctgctgctgaacctatttgaggtgacagtatttccagaagcagaaacacacaggtgcaagcacccctatttttaggtgcctcaaacctcagatatttattaaatgtctagtaagtaccaggcacaatgtaagaaaactgataggaaggagtttaaaggtacaagcttggagggaatgagaatctgagaatcccagagactgacgcagcctgatggccattcccactgaccttgtgtccacgtagacacctgtgttcctaggctgccacctcccttcctggtgggcagttagcccccattttgtctgttctggaggtgtgaaggggagggccatggcagccagagagcgaggtcagggctttattccccagtgtgggttttgagtgggggctggcagaatcaagggtggtgtgttaggactgttagatttgttatgtatgccagcagcgcccttgggctgtggaggagagaggccggggtcacgtagctgaattctcaggtcattccagctgttggaaaagaattagagctgcagtgttggccatggagggtggaggcaggtgaggctgagaggctggactggggagtggggtgggggttgaagggaccagccaaggatgacatttgaggttagagtctgtatgagagacagcagggtggtgcccttgagtgaattaaggatgtggcatgaggaggaaatatttcttaagaaagtcatcaggcaagttctgtatttgcaggggttgaaggggtgagggggcttccaagggaaggtgccttgcagggtgggaggtgtcagagggaggggatgggccctgccgagggtcttctgcccagaggtggtcactgaagccaacaagacactgagggtctcaccaaggtgggagaaggcagacagagaagagggtgagggacaggccagcggggaatgcatctgtgcaaggagtgagaggaagcagaagggctgagatggagccatccagaggaggagctaacaggggagctggaagccaccctgtgggaacagggaagagggaactccaggagaagtcttggtgaggggagcaatcgctgccaggtgaggtgtaaaatcatccatctcttttgaaaagctacaggtgccatgccttagaaatgttcagagcagcagttcccctatttgaaatctctcttaagaagagccggtctggcattctctgctctaccacctctagaggctcccattgctttcagactcactgaccagccacgaggtcctgcctctctccctgccttcctgctcttacctggctcatgctctgccagactccttgccattccctcaatgccttgcttgcacgttgccactgcgtgccttggcacacgaactccacctgtctgagcctctgtctgtcacctttgctcatggcacctgcaccttccaccttcaatttgagcaggacctcttctgagaaagcctctgcagctagcccctccacacggtgccttccatattgcctggtaacagctcgtgaactctgtgtctccactattgaccaagagctttcagtgagcaggggacagtgggagcttcataaatgtttgatgtgcacctgtgtgcatgactgaacgtttttgcttacagaaatagctaggaccatggagacgatgatatggatgatgttatttttatctctatgtgctagatgccatcctcagagtttcatgtgccgcctctcatttaatctggataaacaactctgtgtgttagatgatctcacacttttagaaatggctcaggtcaggtaagttgctaaggtaacatacaagtgatggagccggagttgaaaacctatgttcttagtgtctctcactaccaccaccttggttcaaccgcctttattatcttcctcttcttcaagggatctgaccttttccccgcacacagtgggcttgtgagaagttcatccactttctacctacctctcctgacacctgcttatttgtatttttccttataataactaaattggaaccaatcccagtgtccagcaagaggggtaaagttaagtaaattatggaagattcacatggtaaaacagcatgaagccattaaaagtactatttctgaagagttcataacatgaaaacatggttatgtgaaaaatggggcacaacagtttatatactgtatgaagataaatataaaatatgcggccgggtgcggtggctcacgcctgtaatcccagcactttgggaggccgaggcgggcggatcacgaggtcaggaggtcgagaccatcctggctaacacggtgaaaccccgtctctactaaaaatacaaaaaaattagccaggcgtggtggcaggcgcctgtagtcccagctactcaggaggctgaggcaggagaatggcgtgaacccgggaggcgaagcttgcagtgagccgagatcgcgccgctgcactccagcctgggcgacagagcgagaccctgtctcaaaaaaaaaaaaaaaaaaaaaaaaacataaaatatgcaaacaaagaaaaaagaccacacatatcactgcctaaagattggacggtctttctttctagtagctgcagagaagtcaacaaggatgaaggctggggatgggttgttaggtttggccgctagttttggtccctggcgtcgtttctgtttgggtagaactgtgaaggggaaagggaaagtctgacatgacccgtgaaagggaggaaaccagcagaggactgcagtttgaagacataagaaaggcaccaggcatgggttaacctcagaaaggagtgagggcctgaggccacagtggcaggagttgaaggcacagagatactgacagagaaggaagaaagcccagagagcttgacagctgctgagcaggaagggtgggtaggacagacggcttgaggagagtgacagtgccaccaaccatttctctgacagcatcattccagaccctcagcatccaggccaccttcctctgggtgaattttcacaccttgatgcccattttagtggcactattctctagccttgatctgctcagccatgagtacggtgcaacttcttgtgagcatccctcagtgtatcctggcattatgttagtgctttaagcagagctggtacatgctctgcccctggtgggtcaaatcaagtcctggtcctgccccttactaactgggtgacaccaggcaagttacttaacctgagtttccacaccagtataatggactgaatcatgcttaccagctgaggaggtcactatgaggattaatggcgtgtaaaatccttagcacagcacctgacacataatgcttaataaagattactcaaatactgatgctattataatacagttgattttttttacctaaatacagactttacatttatccctataaaattttctgttttgtttagtgcccagcgtttctgtagcttgtaaaaaccttttgaatcttgatcatctttagctaatcaatcatttcatctgcttgtttgatacatgtgttttgttttttcatctacgatactggtgaaagtgttgaatgaaaggggaggcggtagagctctgtggcatgcctctggagaccttttttttttttttttcctaaaggttgctcttgctcattaattagaactcaggttatgactgtgtagtgacaggttcactacagtcattccaccatctgtttctttcacttgtgcaagaggaactcacaaatatcttcaaagttctgctgaaactcagatgtgcaaggtcaaaagaagtgtcttgactagcagtccagggcccctgtctaaaatgaggtcaaagttcagcgtaacgattttttttttaatttggctaattctaaatagtttttagacttctatataccattaacaactctggaaaattaaatgtatccattgtattatgtatgggtagttcaaagagaaaaaaagggatgaaaagactgaaatacttagtctttaattggtgcaactgaaccactgggaatttgaatttttgttcaaaagttgtttatggagtgctagttatgggaagcctttgcattggattccaagcacaaagaccaggctcttaaagttcaaatgccagtgggggagatgggaggcagcctagatacctgggggaggagcagagagcgctcaagggaagcatccagctctgctagatggcaagtggcaaggagagtgccaagatgaggagtgtctccagctactccagactgttcagagctgtttgctcttggatggggagaggatgggtggggctagggtggaaggaacagaagtacacagcagaaagccaaagaaggcctgccatgttccagaaagtgctagtggttttgggtggccacaggcagagggtggattgaaaagagggtgaggcctgagcaggaaattggccagaatgctggttgcccaggcctggctcttcctcaaaacccatgtgggggttgattttcaaagcttttctcttgccgggccccacccacaggaattccaatcaagtacggatgagagagtctgtctgcccaaagaaacctcgtgctcagcctggctgaggaagcctccgggggctgctgcaccagtcaagagaggattggtgggggtagggttgggggctgacttatggccatggcaagggggctggtaggcaggggcggacaggagagggcttttaaaaggcagtcttttctagcacctggtgactgttgggctgttggggtggagacacagaggggtgcccagcactgtcccaggcttctgacatgaggggcaagagagctaggaaggaggagcgtcggcatcactggagtttggaatttatgagtctatgaggacatttaggggctgacatcttggaggcaattggaaatgtggtgtagagctccagtgcacgatctgggtgggaggtctcagatgcacaggtgccaggcagttgcagaagctgtggaattgggtggaactctccagaaacagcctatcatgagaagaggctgggaaggaccttgggagacacggacatggggggcagtgggaggggcaggggagccaggggaggggcccatgaggagcgaatgaagaggaggaggaagagaggggcatggtgtgacaatctggcctggctgacctggagtgtggacactcccagtccagaaagcggttctaggagggaaacacatgtcgtcccatcttgtcccatcttccatataagtcttcaagtcatttctgtggctcatgccagaagatccctcagaaaagcaggcggcgtgagaagatgctgttctcatctcacctgtgtgccttgggggggtggctggcatggtcttgagctcataaggttcagtggtcccgagcctctgcctcagcttggcgccttggcatggggagggcactcagggaagttgggaggtggccctctctttcctggctccgctgaagggcttggcgagctgttccatcccagtccacagactcctgcctcatgggaaggccccatattctggaggtcagttgacagctggttacattgtttgcatgaactgcggactgcatctgtttggatgaatgctgtaaagttaactcttcctccagtttgaagcattgctttgtgggtagaggaatgtgagggaggaggggacaggaatgaatgggtggaacttacccggagctgagtaaactcaccgttgtttacttaccaggctgggtttcagctgcagggcactcaatgccagcagaagcaccaggatcgcagggtgtgggcggcctggggtactgggctgaggagtcactggtcttcagaagagaagccgtcagtggttacgtatgtcctaatactgcctgccatttaataccacttttagctgaaaccaatcctaaattatagttaggagagcacatggactctcaagtagatggttgcagttcagagttcaggattactttcagggccagattcgcttaactaatacggagttcaaactaggagtcacaggccctagctctgctggagtcctggtcctttgagactctgtctgctgtttggtgagttatttctctctgggcttcagttaggggctctgttaaacaaaaggattgattggcctagtgactttcacattacttctcagagcccaggcttccttggaaggcccccagggctctcagctccagctcccatcagaacacctccactttcaccagcttcgcttagccagctgttacaacttaatttttttttttttttgagacggagtttcacgcatgtcacccaggctgcagtgcaatggcaagatcttgcctcacagaaacctccgcctctcgggttcaagcgattctcctgcctcagcctcccaagtagctggggttagaggcatgcgccaccacgcccagctacttttgtatttttagtagagacggggtttctccatgttggtcaggctattctcaatctcccaatctcaggtgatccacccacctcggcctcccaaagtgctgggattacacacgtgagccaccgcgcctggccagaacttccttttgaagtaggctttctgcagctctaaaaaggagtttgacaaacaacttggagtagataatcagttctgagactctgtagtggccaattcttgataaatttggtaattcatgtacaattcttttggggggcatatattttgatatttgcctttaaagattaacattcattgttctgattatgaaagtaataggtacatattgtagaaaatacatccaactctcaggtgtctcttatgaggatcccattcctaatccattttaatgaagtaagcttcatgacgttagtaataaatattttcaatagcagacctggggtaggagctgtgtagcccgtggcaacaaggatgggtgtgggtgtgtgtgcctgagacaggcgtgtctgtgtgtttctttatgaggcctccatcgtcctatctgcacaagagtgtgtgtcactgcctgccaggtcattcttccattctcgttctctcaaaacttacacatccatgtcacgtttcggcaagcttctgctttttgctagctgttaaggattaaagcaactcaaatgatttaggggtagtcatgattgatatccatccagtgacttttctgttttattgattaagtaaggcgatttatattaactaatagataggttcctcatccagcattgtcctagtctagtacttgtaactgtgaactttgtttgtttgtttgtttgtttgttagtttttcttttttttttttcttttttcttttttttttttattgatcattcttgggtgtttctcgcagagggggatttggcagggtcacaggacaatagtggagggaaggtcagcagataaacaagtgaacagaggtctctggttttcctaggcagaggaccctgcggccttcctcagtgtttgtgtccctgggtacttgagattagggagtggtgatgactctcaacgagcatgctgccttcaagcatttgtttaacaaagcacatcttgcaccgcccttaatccatttaaccctgagtggacacagcacatgtttcagagagcacagggttgggggcaaggtcacagatcaacaggatcccaaggaagaagaatttttcttagtacagcacaaaatgaaaagtctcccatgtctacctctttctacacagacacggcaaccatccgatttctcaatcttttccccacctttcccccctttctattccacaaaactgccattgtcatcatggcccgttctcaatgagctgttgggcacacctcccagacggggtggtggccgggcagaggggctcctcacttcccagtaggggcggccgggcagaggcgcccctcacctcccggacggggcggctggccgggcggggggctgaccccccccacctccctcccggacggggcggctggccgggcggggggctgacccccacctccctcccagacgaggcggctggcctggcgggggctgaccccccacctccctcccggacggggcggctgccgggcggagacactcttctcctcccagacggggtggctgccgggcggagggactcctcacttctcagagggtgcggctgccgggcggaggggctcctcacttctcagacggggcggccgggcagagacgctcctcacatcccagacggggcggcagggcagaggcgctccccacatctcagacgatgggcggctgggcagagacgctccttacttcccagatgggatggcggccgggaagaggcgctcctcacttcctagatgggatggcggccagacagagatgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgaacgacactccgtctgcaatcccagcaactcgggaagccgaggctggcggatcactcgtggttcggagctggagaccagcccggccaacacagcgaaactccgtctccaccaaaataatatgaaaaccagtcaggcgtggcggcgcgccactcggcaggctgaggcaggagaatcaggcagggaggttgcagtgagccgagatggcagcagtacagtccagcttcagctctgcatcagagggagaccgtggaaagagagggagaggacggagaggagggagaggagggagaggagggagacgggagagggagaggagggagagggagagggagagggagaggagggagaggagggagagggagagcgagagcctgtttgtttttttttcatttgagacagagtttcactcttgtctcccaggctggagtgcagtggtgcgatctcggctcactgcaacctccacctcctgggttcaagcgattatcctgcctcagcctcctgagtagttgggattacaggcatgcaccaccacgcccagctaatttttgtgtttttagtagagacagggtttcaccatgttggccaagctggtctccaactcctgacctcaggtgatccacccacctgggtctcccaaagtgctgggattacaggtgtgagccactgtgcccagcctgttttattcttattctttatttcctccagcatttttatatgaacatgttaagcataatgcaatgttgaaagaactttacaggtcaggcatgatggcttatacctgtaatcttagcactttgggaggctgacataggaggatcacttgaacccaggagttcgaggctccagtgagctgtgatcacgtcactgcactccagcctgggccacaaaactagatcctgtctcttaaaaaaaaaaaaaaaagaaagaaagaaaaagaattttatagtgaacacctgttttaccacctggattctggtgtggacattctaccatattcattgtatcccatgtctatccatctttctgtccttctatctgaccttcaattcatctcacttttttgaagcatctttgagtaagccatatatcaatacaccttctaaatattttagtatgcatattaactagagttccatatttgtttaattttttgtgtaaaatttacagaaaatgaaatgcacaaatcttaagtctgcattgtctgaggtttgaaaagtgcttagcccctatgtaacccgagccccatcaagatacagaatgttaccatcactcccagaagatcccctcatacaccttcggagtcactccctggccccacccaccctcagaggcaactactgctgtgaattttttcccagcatgctttagttttagctgttccagaacttgatttgaagggactcacataggaggtactcatttgtgtaaggcttctttaactcagcgtgctttggtgactcacccatgcttttgcttacatcagtagttcattccttttatgggtaagttgtatttcattgtatgggtattctgcaggtgttttttttttttaattctcattaatgggcatttagtctgtttccaatttttggccactataaataaagttactatgtcccatatcacagaatttatgtaccattctttgaggggggggcttatattttgatatttgcctttaaagattaatatttattgttctgattgtaaaagtaatagatgcatattgtagaaaaatacatcaaactctcaggtgtctcttataaggacactaatttttaaatcctgccaggcgtggtggctcatgcctgtaatcccagtactttgggaggctgaggcaggtggatcgcctgaggtcaggagtttgagaccagcctgaccaacatggtgagaccctgactctactaaaaatacaaaattagccaggcatggtggcgggtgcctgtaatcctagctactcgggaggctgaggcaggagaatcacttgaacccgggaggtggaggttgcagtgagccaagatcgtgctgttgcactacagcctgggcaacaagaatgaaaatccatctcaaaaaaaaaaaaatcctattgggtcagcgccttaccctcatgacctcactgaaccttaattaccttctgaagatccttctcagatatagtcaattgggggttagggcttcaacatatgaatttgggggacacacagttcagcccacagcaacgtggttctacctaaagacttgtacatcggcgctgagccaggcgtgccattgcctgctgggaattgagctgggtggctgtgtctggacttctgcatttcccactgtgggagtccttggcagcccaccagtgtgataagattatgatgacattgctgtaacaatactttcgtagcattttacaaagttctttcaagtacaaagtctaatttaacctcccagggaactggtgaaaataggtattgttgtgccaattctatggatgagtaaaatgaggcactagaagttaagtgtctggcccagagttccatagtcaaatcagtggtgaaagaaatccctctcctctaaccctgtagacagccgtgagatgtttccattaagggactcgcggatttctttcccacgtacaggctttcagcgttcaaggtttatctaggaggctttgggagttctgttgcctgtaaactgaggcagccaggcctggtgcatcacagatgcacgaaagatcacctcataagcaaaattaggtagacgtattcctcatgaaggagctgacctagtgcacagaaagaaaccttcctgtgtctaaccatgcattgatccataattttggaagtcctgaaattcagcttttctcatcctgttggtcagtacaacagggtctggattcccgatcctgaagaagtttggaagtctgctgaaatagccaaggactacagagttggtgacaaggtcctgcgactcctgctggaggatggaacggtgagggtccttgctgttcacagctacgtcgatgtgtaaagcggtagctggggtgtgtgtaaggatgggagcacgtggaccccgtgggaggcacccaggggagggcgcacgagtgggcaccagcaccattcccaaatggcctcctggtgccgggactcactgatgtgtctgtactccttccctcccgcccctgtgctgccctgcatccaccgggcctctctctgtaatgagggcccagctgcaggagccaggtctgtgccacggcactgcatttccaggcacccagcattactgggagaatgctgaaaagtgattcgccattttggcttcctgagtctcagcccagagattgggcagagatgaaaaacttggtgagaagtcgtttgagcccaaggcatacgctggtagagaaaaacatcaagatgtgaaggggaggaaaatgagaagagggagatagaaaacaggcagggagagggaggagtgggaggagactggagggagtcggtccacagatatatagaaatgtgtaagggagggagtgtggcagggacaagaagacatggacacccagctttgtgtgacattatgaggtgcctctgttggtgctggtgtggtgagggggaggtgaggatgaactttagcagttgctcctgtggtaggatgagctattgaggagcttccctgcaaggctgcatgtgccttctgatgacgcagcttctgaagactttgcatttgctctaagtgtccctcatgagttgtccttgcccaccattgctgtagtgacatcccactggattagtagcctagggtgactggacgggtttagaatcaagtatctgggtagagaactgggcaggggatttgtgctccatctagatcccagaggtgggtctggggaacatcatgtgaggattaattgacaaagcatgtaaatgggttctgcagacacaggacacactacttctaatcagactgtcctggatttgggagacatttcctgagatcctgggaaggcagatgaacacagcggttaaagacacaccctctagaatcagatggtctggcgtcagatcctggcatggccccttgttaagtctttggcccaggcccccagtttccccatatgtacaaaggaggtaatgactgtgcaccgtcccagggttgctgaagtgcgatgagacaatcctgtgtgcatgtttgaaggcaggagctctgggaagaggctcctgctccccggggcttccctttccaacaggagctcctcgcagtttttattgagtgtctcctgtgcacaaggttctgattagggatcagatggctttgtttgggaaggaaaatctcaaggcagcagctgcagtggcagtttgctgctttggtaatatctgcagggcttcaggtggctacattcccggccttgacccggctgcagaggtgagtaggatggcgggcagccagacctctctttagctcaaccctttgtcagtactgtaagagacaaggcctgtgtgctgtaggaaaatgtcacctctgcctccacctgtcaacataatgttcattacattttctcccctcccccaaagactgtctgtcctttctgtctccctgttgctttcacacataacacacacagaggccaaaccagaagtgggggttgtggatttacaacagaaaaacagagacaaggaaagtcagtatgtatgagaagcatttttcctgattttattttcaaaaatgtttaggttgagaatattctggtcggggttaggtcacaatacaattgcattggtaacaggggagcaggagctggcctgagcatccgtgtccagttgtggattgccctgagctgctcgctttatgcagaacagaccaaccagccagcaaaacccccgccatggacaaggaagcactgtgctagtgagagagcacaggcttcagagtgaggctcagattaactgtgtgaccttggacaacaaactccaactttctgaacctgtctcgttgactttcttggttggggtagtcatgtcctccctggaaggcagttttgaggattaaatgaaacaatccatgctgagtgcttggcatggggtctgcacagtggcacttgatgaaaggcagctgggccaccttgtggagctggtccaggaccagagatcagaaggaatccagagatactgactgaatacctggaaggcggcctaggaaggtggaagagaaacaagcatgctgggtaacctgctcaagtcgctttagttgggcttcacttcccccagcggtgaaatgggagtgtaggaattagaatactctgacattggaaaggcccagtcatctgtggcacagatgccacggggcatgctcgcctcaccttcgttctgctaaggcagctgctttaggaatactaggttaaatctagcagaagaggagcaagcctgggaaaattccttggcccagggctgagactgataggaatagacagccctgctgggggagctgtgagccctcgggcatgtgggcaactgcagacaggagacacctgcaccaggggcctttcacggagagaccaccacctgcatggactcctttaggtatctgtcaccaccaagtgtgtcaactttgagcagagactcaacaaccttagagttaaagagaccgtaggtcactgtgtcattttagctgcagcatcttgttttcaaatgaaaacttgcatggcctcaacatttaaaccacatataggtagagccctggtgggagattcaggaatggggcacctggatctctgcccttgtagcttccccaacactccttattgaggcctctgtagatctaaggacccctgctctagctcctcttcgcagatgagagaagtgaggcccagagagggtgagtgacttgccccagtgcacatagccagtgccctagtcccctgctcctacttttcattattccaggagtcagctgtgaagattttcttgttgctataagtacatttgctttttaatgtcagtgatgactctgatggaggggtggataggacaaaggacagtgcttcaacagaaacaccaaaaatcttttatttccagagctttaatttttatctttgtccataggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggtaaggagagcaattctaggaagtaaggaatggcactggaatgtaagcttgctgtctagagcctcctggttgttttatgtttatactgagcacccagagtttgttgtaaaaagaagtgtctgggtggggagaatcttcaacaagaactaagactggactacctagaaaaagagatgtaacaaagctcgtgtttgagtttctcatcagatttcatacatttattacttattttgggcaatgatattacttacactgcaaattgcaaaaacctctccatttgcgagcatttccacctgtcctgtcaaccaaccgtcagaacagcccgagggtgtaggtgactggcagggaattaattcagtgcgtgaagtgacttgcccaaagtcacacagaaggtttaataagcgacagagctggggtttcttaaaaaaaaaaaaactggagatgcaggtggcagtaagagtattttaactgcatctaacatctttccccaggaatcattttggtggccatgaatccttacaagcagttgccaatatacggagatgccatcatccacgcctacagcgggcagaacatgggcgatatggacccacacatatttgccgtggcagaagaggcatacaagcagatggccaggtagcttcctgccaagctggacttccccttgctctgccaatgctccctgcatttgccagaccatcacagtggaggggagatatctaggttgggctcattaaaagagataggccagaggtggtgctttgttgagccgactacctggaatgaatagcaaacgactgttccatgtacctgacctgtcaagactggagtttcctgggttttgttccttcaaggtagtcaagtcagtcctaccagtctgggaatagcagatgcttttcttgcagtgtgtttggttggaggagtgttgatttattctctgctatgagacgtttaagctttttttttttttacccattgcaggaagtaggatctgatgacagggtttttagctgcaggaggttttaggtgcaggagacatggaattttatcctaatttcactgctaggtgtttgtagggccctgtggagttctcgtttcactagtgcacatgtatgaaaagcctcctgtgaatgaggcaccgtgcacacattcccatgtgtcatctgggatggcctcagaatagcccacgatgcaaatgtctgggcagtaaacagcttcagggaataaccaacccagggtaggcagcaagtaaaaggcagatctgggatttgtgctcagatttttaaactctagtttatttttcccataactatcacttttggcttcagtgtcttcatctgtaaagtatggagaatagaaacaccaccctatctttgtagctgcctttacagtttgcaaaagaactttcacatacagtggtctcccttgagtcttacagcactcctgtgaagttgactgacttcattgccctcatttcacagatgggaaatctgaggcacaggacctggacctgctgactctttacctaaatctttactgcataaccccagccgcagctcctgagctccctccgctttatgtcttcgtctgtgagctggactctcagagggcacccattcctggttctgatgcttataatgagggagcaggtggtgcttacatgaggtagaacacgtgctgctttcctgcacagatgtctgatgggcagtctggggctagaccgagcttcttcagagtcatcagagacccggtgccgtgcagctccctgtccctggggtggggccgtcatcctcagggacaagccagttctcacctctgtcttccatattctaggtaacaaggcatatgaggggaagggtatggccctccaggttaaggagactctctggaagccccacaaagcacttctaacagctcgtcaggcagacctcactcacatagggaggctgggatgtgcagtctttcaaatgcacagaggggcactgcctggccactggggcctagtccctaagaaggaagaggagaatgcaaatgcatactgggtagagaattagcagcttccgctgcaccaagattccttctaaccctaaaacccctgtggttctgagatttttccctggctccctgtaggtctcccaggtatcgtggtgattagggactgggtatgggtgggatgagctctttggcactgtagggctgtgctcacttcagccctaaagagccagtttctccttggaggtctgtctgtgtaactgccataacagaacggagcccaaagcaggctcgtgttggccttgtttgatgctagacaggtagtgtccctcagggctgtagaacagggctgggattactaaagccctgttctatgccctgagggacactgagcatgtcatttcacttctcagagtcttcatcttctctctttgaaatgaaaatattggaccggggctctgtatccaaagtctcctctagcatttacatgggaggctgtggctctgtgctctgggtcaagtcactccacccctgagtcaccattttactcttctgtaaaagagatatctatgtcgtaggatttttgtgaagcttaaatgagaatctgtattcacccagcacctggcatgtgagcggtgccacatccacagagccatgttagaagcttccaccatcacagtcttatgacatgaaaagtttaatgcatttttaaaaaatctctaaattatataacagagcatgttggcttagagagcgcatatgttcccaagcatcttttgaataattgctctcaaaataatgtccttgaaatgtttttatatttaagtgggatgtgcagaaaggagttgacataaggcctgaggctgctatctttagaggcctgcttgcaaggtggcccatggctagcctctgatttcatgacggttcctgacatttcttggttgaaaaagtggctcattttacctaaactcaagctgtttgtgtaaataatgtgctttatgctgaatacgtgctttccttctgggagtctggaatattggcatatgctaggcagaaggtgggcactgcatctctaatgagcttccctggcagccagcatttcacatgtgctgtcaaattccttgctggaagaattgaatgtgtcctgtgtgacccgactgggagaggacccctggaagtttgcacccgtgttccactggaccttgccccgtgtgccttttccccgtgctgcttttgctgtgtatcctcttgctgcaatcagtcttagctgtgaggatgactatatgctgagtcctgagagtcctcttactgggtcattgaacctgaggttggtcttggggcccctcaacatggtactcaataaatacatgttgacaggcagcatgatgacctacacagggtccatctagaaagagggtgctcaggagagggtggggaaggcagaggagagatgaaatgagaggtgaaattcaagaacagagtttaaaagcaaaaatcctgcccagagagtgggaaggatgggaaggagcagttttttggttgagtggaaaggttgagtagggaagcagtaaggagtaaggatttgaataaggttggatgaaagatgtgaacttttaaaattgtgtgttctgcacgatcacatagaaaaaaaaatctagaaggaaattgattgagatttaaaaatagtagagtgacaaaacagtttccctcttttgtcttgtccacatttgtcttaattagcacatgttgcctctttaatgggaagaaactaatatttgaaaacttttatttgctttagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggtgcgtaccactgcggaaggcagctgggtgttggtgatggaaatgggggttggttggtttgtgtgctctcctggctaattcaagttcccaccctttaaagactaaagaagtgagggcaggaaagacccgggaagcctatttgctggtgggatttgaaggagatgggggcagaattgttactttcaaggctctcttctgctctacctgctgggctggaaatctaccatcagactccaggagtcctctgtttacatttacatcccaggggaaaccaaacatcactggtacactgaaatcactggtgttctccacccagctggcatcagcattcatgagctgattgttaaaatattcaggaattttgcaagctgattgataaacctttggtagtttgacatcagtcaggggagaagtatttataccttctgccttggcagaggccacatgtcaagactcttcctcctgccctccccaagagccagttcatcagcacactactgactgggacagagagtgggcaaggccaaccgtgacggtgcccaggggggtgaggagacagccctcaaggaagaagaggcacccaaaaggcacagaggagggtcctgcaagccaactccagctgccccgcaaaatgggaagaggattgatttgaatttatttggaagcaaagcaaaaaattaagaatattagactactagacctcttctccctgttttctcaaatcaaaatcctcaatgaatatttatcagacaatctactctgttgaagtcactgcttagctaatgtgggaagtgatggaaaagaataagacccaatctccaagtgtaagattcttctaacctaatgtaagaatattttaaaattaaatagaaacatatgtcggggggggggtactaagaaacactgcaaagctcataattcagaggcataggcttacttagaaacataaattacaatccaagataccaatagaaaagttatcaaggctgggtgcggtggctcacatctataatcctgcactttgggaggctgaggtgggtggattgcttgagctcagaagttccagaccagcctgggcaacatgatgaaaccccatctctaccaaaaatacaaaaaattagccaggtatagtggcacatgtctgtagtcccagctactcaagaggctgaggtaggaagattgcttgagtcaggaggtggaggttgcagtgagccaagattgcaccactgcactccagcctggatgacagagcaggaccccatctcaaaataaaagttatcaagagccagtgccaagttaaatgcccagtggataattttgtgtaaatatttagggtttgtctcctctactagactgcacactccatgaaggcgggactgtatctatttggtttacctttgtttaccgagcgcatggcacatagtaggtgctcagtaaagacatgttggcaggcagcatgatgacctgggtcatctagaaacagggtgctcaggagagggtggggaggggcagaggagagatgaaattgaagaacagaagtaaaaagcaaaaatcctgcccagagagtgtgagggatgggaaggagcagttttttggttgagtggaaaggttgagtagggaagcagtaaggagtagggattggaataaaggttggatgaaagatgtgaacttctagttgagcatcataggtatttggggcctgaatgagttgaggcacctcatattctctcatttaatcctccctactctgtaagtgttctggtcagtctgggctgctattataataataaatataatgtactttagtataatatactttagtgtcattgaccaggtggcttataaacaacagaaatttatttctcgcaattctggaggctggaagtccaagatcagggggctagcaggggtcaggttctagagaggcttctcttctgggttgcagactgctgtcttctcacggtacccttacatggcagaaagagagcaagagaggtctctgggatccctattatgtaggcattaaaatcccactcccaggggctccaccctcgtgacatcattacttcccaaaggcccaccttatgataccaatacatagggttaggatttcagcatgaagattttgagaggacacaaacattcagtccataacagtgagttgcttatgattctcatattacagatagggaaattaagacctggaaagatgaattaacttttttgtttgtctgtttttgagacagggtctcgctaagttacccaggctggagtgcggtggtgcaatcatagctcactgcagcctccaactcctgggctccagcaatcctcccatctcagctttctgagtagctaggactacaggcacacaccaccatgcctgtctaattttttttttatgttttgtagagacgggggtctcactgtgttgcctcatctggtctcaaactcctggcctcaagtgaatttcttgcctcagcctcctgaagtgctgggattacaggcgtgagccgctgcacctagccagtgaattaacttttaagacattacacagatagcaaagatagaacccaggaccctgaaacatcagaacctgtgctctttctggtcctccccagtatctgccagtgggaccaaggagaaccttgagcagcaggctcatgttctgatttgtcatgttccctgccagcgtggggttgctttctttccccagacttccctctgccaatcagaccttcccctagggtacaggattgccttttactaaaaacccctccaataattttgaggcaaaaatcttttaatgttgttatttcaatagagtcttattttttttaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaagtaagtattaaatttccttttccccaactttttgagcattatttacatttacatacttattatacatactcaggcaagctacactatgctgtgagttgaagagtagggttttcttgtctttcatttgcagtttggattcttttttctgtttattaaaaattgatggatgaataggtgtaatatcaggtgagttgtatgtctgcaggaaaaggttaatgactttttaatttgggggatttacaaaatccttatagtttaaaaagcaagtatctctttctagagtacgaaaactgtttgaaataggctaagctgacagactggctttcctatcaggaagggaatgggatcagagctattgagggggttttaaaagaaaggcttttctgccagtaaatggagaaatttctcatcgttttggcccaggaggagagcaacagaaagccttgtattgcaggaagtttgtaaaaatttcactaggatgagttacgccattcccatttcataggacgttttcatttaataacactttctctgggttgctcattacttggaaggccatctcaggccacccagttctcagctgagaggaagggcctgcttgtgaactggccagatcacatcccagacagagaattatccatgcggattagatatctaggaccctctagttaaaaacctggcatttttgcttgtaaggatttggtgtaattttgaggacatttctttatcttacagtcggaaaatgaacgaaattaccacattttctatcagctttgtgcatctgcacagcagtcggaatttaaacatcttaaattgggtatgtgatggatcgtgtatgaaagggtctctcttttatggagggcttaaattctaggttaactttcttcttatagtaatatatttgttttaagtatttgcccaaagatacaagattctttggtttcagggacagaattggtgcatctaattaaggggatggattagggccggggggatgagtttagagagagggggcacttgtaagactgagggttatttttaaagctcattgggcctggcgtgatggctcacacctgtaatcccagcactttgggaggctgaggagggtggatcacctgaggtcaggagttagagaccagcctggccaacatggcaaaaccctgtctctactaaaaatacaaaaattaaccgggtgtggtggcacgcacctgtagtcccagctacttgggaggctgaggcagaagaattgcttgaacccgggagatggaggttgcagtgagccgagatcacgccactgcactccagcctgggcaacagagcaagactccgtctcaaaaaaaaaaaaaatagctcattgggtatttatggtcctccagctagaaccacctgaataagacctcctgacagctggaacatatgatgtcaccaaactttccattttatttgaacatgacatgttaacccacttattaaaacaaaccacctgtatcataatttgaccttccttgatggctcaaggtcattcattacttgtagtcataattaattatattccagagatggctaaaacatagggctgtttgtccttcagtacaaaaggccccgagccccgtgctgtcacagctctcctgccttagccatttgtgctatgctggtagatgagaattgttggagataacttctagtatgttggagttgaactcacactctctaattttggagaagttgcttgtactcttagaatctaagtttctccagatttcacatgaaggtaatatccttggccttgtctaccaaacagaatgtgaatagtgaacctgcagaagggctttctgaaagatcctctactatttaaacattagatgtatgtgtatatatatacacatacatgtgtatacatacatacatatatatacatatataaatgtgtgtatatatatatatacacatacatttatatatacatatataaatgtgtgtgtatatatacatatatatgtagagagagagagagtcattatccggattgtgctaatggttttataagagtatatgtatgtcaaaaattcatcaaatcgtacgtgttaaacatatgcagtttattgtacattcagtaaagctcagtaaagctatataaaaatgttaggtgcaggaacaaaaaccatgagctttagagttaggcctgcatttaaattcttgtgtgccatcagctattggaacttgagaaagtcacttcactttcctgagtctcagcttctgtgtctgttatgtaggattttttttgttgttgttttgtttttgtttttttgagacagggtcactgaggctggggtgcagtagcgccagcacggctcactgcagcctcgaactcctgggctcaagtgatcctcccacgtcagcctcctgaatagctgggaccataggcatgtgccaccatgtccagctaattttttatagagatttggttttgcccttttgcccaggctagtcttgaactcctgggttcaagcaagccccctgcctcaggctcccaaagtgctgggattacaggcatgagcctccacacctggctgtaatgcagagttctaaggaataaatggaataaactgtgtaaagtgcatgacacagttctttgagtatgaacttcccttcttctgataaatgtgtatgtccaaatttctgtgttacagacataacaaatcttactttttgatttcagggagtgccgaagaatttaattatacaagaatgggaggcaatactgtcattgagggtgtgaatgatcgagctgaaatggtagagactcaaaagaccttcacgcttctgggtaagggaaaatatcccatccaagtatgtagccattttctcttaaaaaaaaaaaaaaattaaggccaggcgtggtggctcacacctgtaatcccaacactttgggaggctgaggtgggcggatcacaaggtcaggagattgagaccattctggccaacatggtgaaacctgtctccactaaaaatacgaaaaattagccaggcgtggtggcgggtgcctgtagtcccagctactcaggaggctgaggcagaggaatcccttgaactcaggaggcagagggttgcatcgagccgagatcacaccactgcactccagcctggcaacagatcaagactctctcttaaaaaaaaaaaaaaaaaaaaaaaattaaaaggtggggattcccagcaaatgtgtattctgaaggctcctaatcaattctaattttaggacaaaacatcagaacatatttggagactaagtggtcaagactatgcttttcccttaaaagagctagaaattaatttgtttttttcctcagccttcctggctcggctgtgagaggcatgggctgcaagccctgtgactgccgtaagctcttctaggctgagtacaagaatgactggtaaagccaaggtccaattcggttcagaagtggaacgttggccctctgtggccttcataggtctcctgatgatgacagtaaaatagtgagcactcatctggagcttgcaatgtgctgggcaccatcctaagcactttataactctgtgtgaactcattcaatccctacaaccaccctaggaagtcagtgctgctgtttctcccattttacaagagggaaactaaggcacagagatgggaagtgatttacccaacattaggcaactgattcagagtggaactggcttttgcactccagggtcttcaagcatctcatttggtacagaaaaccccatcttctattgctcagatgccggcacaggtggagcaggcacgactgtcacagcacagccagttgttcccaatccttctcgccttacttttcccacacagagctcatgttcagaaaggctgtctaccagatggtgtttataaaaacaggcattcactctctcattctgtatgagtctagacatccacatgaagctgccagtcaaagcttctgatcagggtgaggccatcggccatttctttctttttttttttcttttcttttttttgagacagaatcttacactgtcgccaggctggcctggagtgcagtggcgcaacctctgcctccccgattcaagcggttcccctgcctcagcttcccaagtagctgggattacaagcacacgccaccacacctggctaattttttgtattttagtagatacagggtttcaccgtgttggccaagatggtctcaatctcctgacctcgtgatctgcccgccttggcttcccaaaatgctgggattacaggcatgagccaccgcgcccggccagccatttctacgtcttgctgaaatctctcttgctgaaatgtcccgccgattcatactaagtgctttcattcttgtggcctggttgactgtatctgaatgtaaaaaactaagagtttcaggttaaacatatccaaggaataggcaagacgatcacagctggataatggagaatgaaaacaagatggttttctaagcaaaatcaccatcagactgttccctcaaacctgcttcgaggagaaaggcagtttaaacattttataataataagataaacactttcggcactgacttacatttgctgaaaataattatggtcgtcatttcaatctttgtataatgtactccatggagagggggcttggtgcgtgaggaggggacaggtggccaagctctggctgggctgaaggatatgccctgccctgcccaccctcatctccctgatccttctactctctcccacctctattatgtcctcctcctcacagcaagataatgtagggcaaatagagtaggctttgggatcaaatgaatgtgaattcaaatcctaattggtatgaatctaaggttacccactctgagacttggtgtctttttttgagatggagtctcgctctgtcgcccaggctggggtacaatggtgcagtctcggctcactgcaacctctgcctccgggactcaagcaattctcctgcctcagcctcccgagcagctgggattacaggcacatgccaccgcccccagctaatttttgtatttttagtagagatggggtttcaccatgttgcccaggccaatcttgaactcctcacctcaggtgatccgcccgcctctgtctcccaaagtgctgggattacaggcataagccaccatgtccagccaagacttagtgtcttgatctgtgagtggcaacgcaccttatctttcatgacaactcgtgaggaagcatatgtaaaagtccccagcaccaggccaagcacatagcaggtgcatagtaactgctactccctgcctgctagctctctacattcccaattgtccaaagcctcaccatactttgagtaaaaccatctcttcttccatgaaaccttttctaattgttggagatcagcaatttgcagccatttgcccccatgtttcacacaacttaggttatgtttacagatttccacatcacgttcctcagtcccagggccaagactgggacgagacgagagaggcactcactctcagggccctgcatgtgccgggttggccctggacacttagcctgtgcacagacttagaagttttagacaaagccctctggagttttgtggagaggtagagtaccgtgtcctctcaaggcattaatggtgatggctgcctgctgtgctgtgtgaagtgggcaggtggtaagagattggggccactgcacctcttccctgcaactctcccttcaagagagggtacctcagctcaaacttttccttcaccttgcacgaggtcatcagggacttctctgtttagacatgctagggcgaagctagatggcctcatgaacgctgtgggtcttttctcatattgcggtgggcactggtgttaaactgcttagatataccttacccagtgtgacctcgggtgagttccctaaccttcctatgccttagtttcctcctctgtgagatgggaacaatactaggattccttcgggtggttgtagtgagcatgagaggagctgatgcgtggaaaataccaaggacggtgcctgaggcagtgttcccttcgccttcccctccatttctgctgctgagatccctcagttagcagtgagattacccctggagaagcgcgaggggaggcattttgattaaaaagtccctttcttctgctcttctgctgtgtctttctcatgtgattcatccactgacccctgccatttgagtgttgctatgatccttgccctctgatgggacgaacaccttggaatcaggctgtccctgggacctcaggctctaggaacttgaccagtgagctccccctggaaatctgattcaggctggcattgcttttgtgtgacaggctcactaaggatgattacttaacgcaggtcttgagttctttcttttgtattaatgttttggagttgttatctcccttttgtgtttctggaaggcctggagtagtttaaggggtttagttatggatcacagaaagcagggaggagtgccagaatggaggctcctgcacttggcatttttagttgctgctcatgatcacttacctgtcattactgtggtggaggcctggggtatatttctgttggacacatctgtccttcggatggaggagttacctccaaatggaaaggcagcaagtgcctggactcagctggagctggagtcttccctgtgttcttggattgaaatcttttgagactgattttatttaatctttgtagtagaggagactctgggccaggtgcagtggctcattcctataatcgcagcactttgggaggccaaggagggtggaccacttgagcccaggcattcaagaccagcctgggcaacatggcaaaaccccatctctacaaaaaattagctgggcgtggtggcgcacatttatagtcccagctactcaggaggcggaggtgggaggattacttgagcctaggaggtcgaggctgcagtgagccatgatcacaccactgctctccagcctggacaacagagtgagaccttgtctcaaaaaaaaaaaaacaaaaaactgtaggttttgaaattgttaaagaacatgacctacctgctaatggaaactccaggtatcctcaagtgaggggtcattggcttccattccagtgtccattccagggtggaccaggcagcctgcctggtgtgaatgagcctgcctgccagcccgagcgcatctctcagctgcttaagtcaccacagtgtcattaacacacactggggggatcccgacctggcaaaaccgggctcacagcgtgtgggtctacactgtgatttacagggtttgaacacagtcctttctagcagctggttttctttctttttggctccaggaaatgtgctaatcccctcacggtgactgaatatggtatgtagtcataatttatattctacttactgcaatcaaagtcccaatggggaacatggggcaggctcacaacagaatacaagagggaggggttatttattatttacaactgcagaggtgtgagtggagtctaggggagctattaatacaaggggcagtgggcacctggggggcagcagcagaactgttcactgctctttcccatgtgggcatccaagtgtttctggagcctagaaggagagttgggtaaagtcagccccagaggagcagtgaccttctgtcagtcaggccatgcagccagttggaggcagctttgcagggaagggggctggggaggacgcactcggaaccttctccgctcctctctctgctctcctgctagggctccccatgaatcaaacccaaccaaaggccagagggcatgaaaggccatcgccttggtttataccaagtcccctggggcagagagcagagaatctggaggggcaaacggaatccctccagcaatcccacctaaaaaataattcagggattcagagagcttgtgagcaaaaagaaaaatgaaaaacattcaaaatcaagcacagaatcaaggcaagatgactctccgaggaacctaatgtgaaatgattactgggatattaatttttgtgttgaacttcctagcagccatggcagaggggaaacctgtgtatagacacatgtggtatatgtctacagaggtcgactagaaggaacagtgccccagatgcccctggggtccacttcacgttcctgtcccagagcttggcactgatgctacctgcatatcttgaatgaatccaggtgcccatcttactagtcagagaagagatgcagtattctaatctgggaaaatgtttgtttttaggtttcaaggaggattttcagatggacgtttttaaaatcctggcagccatcctacatctgggcaatgtgcagatcaccgcggtgggcaacgagaggtcctcagttagtgtgagatgctcatttgttttacttttcctttgtctaagggtcatagtggaactggctcgcagctgacctgcctttgctttttagcaccagatatagtcggcctcctgggtagactggtttaacaggaggcaggcggcaagggtttccagggcttgccttcaaagagtaaagcctcctccccttgcaacagtagaggaggggaaatggatctcctgtgtgcttttcttttattcaaaaagtatgtatgaagcacctactaagtgccacggactgtcatagcatctggggaaacagcagtgaacaaaacaaagcaagaagcccttcagggagcttatgatcaagggtagggaggagacacaacaagcaaatatgggctctggcagctgacggctggcacagaggaaagtaaagcagagggggcatgcagaggtgctgtgtctttcatgtggggtggtcagagaaagactttctgagaaggtggtgggtggcagcctgcaggggatgaagaagcaggttgtgcctgtggatgggggaagaacagcaagtgcagaaacccgcaggcaggagatgtcatttgaaaaacagcacgaaggtccatgtatccagagggtgagtgacagggagggtgtggatgaggccagagaggggagggggattgcagaccacataggaccttaagggcactgggtagttttcagcagaaggacacccactacctccttacacctgcttgaatcagacatcagtggtgctggcttcctgggaatgtattgtaagttttgtgaaagatttctttatttaatggacacaagttaatttgatgtgtgtttcttctatgacatatactatgagtagtgattcttgggggaggggtatgtgtttaattagtctcatcaatgtccatgtaaagaagaaaacaaacacaagtaaaaaatgtttctatgaaacacagaatctgcacacctgtaaagctttgcattaacaataacatgtctgtcctagtcaactcagactgccatatcaaaatgccacaggctgagtggcttaaacaatagacatttgtttcctcaccgttctagaggctggaagtctgagaacagagtgtcagcctggtcggttctggtgaggactttctgcctggctcctagatagccaccttctcattgtgtcctcatggtggagagagagcagacactgtgatgcctcttacgagaacactaatcccatcatggcaggcctcaccttctcaactttagccaaccctgattacctcccaaaggccccatctccaaatacggtcacattgggggttaggacttcaacatatgagttttggagggacacaaatgttcagtctgtaataatgtctgttttcatgtccctcaaataactgatgggaatagttgatcattttgtgtaaccggtgagttcttggctgtctgctaccaacggtttggggagagagcagagctgagtggagcatgagctcctgggcttagcgttttaggccttttgccatgaccaggaagtaattctccttcctctcctccagctttcacctcagcgtccatcccatcctgcctgcagtgtccagacctcccagaatgagtcaattccccaagtgggaaagcagggagagaggtgacgagaggcctgggggagagtgtggtgtgtctgaagtggcagatccccctctgttgccttgctcagttacctcagagaagctgggcttctgcccttttttccccaaacccccatagattaaaaatgtgatttctacccaacaaatgccatcacactgagccctctcccgtgaagcttcttattaaggtagcattttggaggaggaattaaaattgattgactgaaaatcctttggaaaggcttctaagaatatttgtagaaaattcccagtcctataattattggtcctagatttgggatccatctccacccatttgtatcaggaacttgaaatgttggacacgttaaatttggacaaagccatctgactttttgaaaagctgccgcccctttgcatttttttcccatagcagcacctgcagctgaattgtttttgactcagaaggtttcattctttcttagaaggaaggaaaccaaatgccactgccagtcccttcccttataaggtcaggcacgtcaaagccagctctgtgttactgtgatattggtcagcagggggtgtgggtagagcgcagggaggggcaggactgtttccatggcttcctacactgtgtcctgaggctttttagtgcaatcatgtagatttcctggtgggctggaatggtgccggcaggggagcctgccttgggagttctcctgcctgagagaggagctgggagtcacatccttgcctgaggacaggagccctttgtccacactggctgaagggaaatgggagcacctcttcccttttttcatctgctgaccagcggggcagctctcatgccctggcttgggggagaagcaagatttcactttgtgtattcaggaaaagtcccaccccagccctcgtgtcagctgaggcactagctcagccatgggactcccaccagcttctgcctggcagcaacacctgggtacctcctggaccaaccatccaggcaaacccctggccacacgaggtggggcagggtgagtgcacactctgacaagtggcccaggatggttcaaagggaagagagagggctgcatccacatccacaggaacagggcagggtctagagagggtggcctctatggccttagtcaccgctgacattctttggttaaaatgaaaaatcagcgtgggacgcagccctggactccctggcattgctgcaggggtggtctgccaagggccaggtgcaggacccgtgctgctgtagcccccttgctctactcccaggtctatctccacctcctgaggctgggcgtccttgtgccagctactactcagctcttgcacaggcctgagtgtgggcacgggggccttggccgggtgggattgtgtgtctttggatggctgggccacctgacggggcttgtgcttgtttttgaaggaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatgggtaagattctcttcagtgagcctgtctttcctcctttaaatgttgagagccgcatggtttttagatcattttgttctggttcttttgtatttcacatgattagaaagataacattctctgcttttgcccctatagatgctaagtacactctcctgggctatggtgccatttattcaaagtgcattaaagagatgctgaattaggaatgaccaatgtcaagagcttactgtgtgccagctctgaggctgcttggcttccatgggctttctcacttaatttcttaaacaaccttataactatccccgttgtagagctgcaacaaccaaggcttagaaagactcaataacttcgtcacaattgctccgctggtgggagaacccagcacagttgtgaggctcctgcttttgcttttcccaccaaaggcccctgaggtgtggagccccaaggtcccttcccattcgaatcacaggggatgacaagtcacctaggcttgcaccttgcccaagcccagcggccagaggtggactgaacccaggtctctgatcaaccacccccctaccccaatccttttccgttcttgggtgagaaggtcttggattttccccagccctcctccaggaggtcttacccttcatcccaccctggagttgggttctttttcattctctctgcctggtcctccttttctaaaccccgggctcagctcgtgctgaaacagctatggagtaaccagagtggaagctggcatggagggctctgtggagattgttatccttcaggcttttctagcagctggccccagtgcccagcccttgcccctctcctgggacccaccctggtttcttaacaggagaaggggaagattgacccatgaaaggcatcctggagtgttccacctggattgggggatcttccccacaccatggcaaaaagcagctcaaccccattccccatgcaaaggggagagctgagctctggccttcacggccctgctgctgcctcctggggaggagggggacagggccacaccacgctgttggacttgcacccaggtggagaggcagcttttcccatagctgtcaaatgggagacagtcaagggagctgctttgtttaatttagatcctaagttaatacatatggctcccaattaatagtacgtgtcaacagttataaaatgcttaatacattactgggatagcctagtcaattatttaccttgtcttcttcccagaaagtgtttgagcagccagttaaaagcttaagtgaacttttaaaaatggatagtcctcattaaaaatagtcctgtttcattgtggtggaaatacgtaattattctgttattccctgttcttttgggtgtttttaagatgtatttttaaatgacagtcctttattttaacagtatattatttctttcttttttttcttttttttttttttgagacggagtcttgctctgttgcccaggctggagtgcagtggcaccatctcggctcactgcaacctctgcctcccaggttcaagcgattctcctgtctcagcctcctgggtagctgggactacaggcacctgccactacgcccggctgattttttttatttttagtagagactgggtttcaccgtattagccaggatggtctcgatctcctgaccttgtgatctgtccatctcggcctcccaaagtgctgggattacaggcgtgagccactgcacccagccattatttcatatttttatctaacagatgtttatgtcccaggcactgtgttggaggcagtggttgaacagcatagatgtacggctcctgccaccgtgggactgagactggtgagggcagcaggccggcagtagaggttaggatgagtcctgggaagggaggaaggtgtgctggaggttagcagagggtggggacagagcaagggcagccatgtgcaaggagtagtgagctggacggtggcccccaggcaggatccagaaccactgtaataaggaatttgaatttttcagctatgtggaaaaacctgagacaagagtatttataaatacacaaagacttgttagagtaaattattttaagattcctctcaaaaattctaacaatagcctgtttgctgccacccttgagttcatgatacgcctccaaaaaaatcagctttcctctaggcagcagggctgcagcctggggccaagcctttcccgccccctccagcagcctcgcttctaggctaaccctcgcctaggcatacctgcaacttttgagaaagctctttttgacttggaaataaggaagcctcaaaggaagacttagcatctttgaaagccagtaaagctgaagctgtgagcttcaaggtctaagctgagagtgaatgaaggctggtgactccccagcctgtcgtgtatttatgttctttggacccagagttggaaaaacctgggtctgggggtcagacccctgggaatgagctccgtagcataccagttacgtgacctcaagaaagtcacagaacctctccaagccttagtttctgcatctacaagatggggcctctcttgcagggtgattttgaacatatgatggaagaaattatgcaggtaccttgaaaaccataagcatggttccagtgtgaagtgttttcatagccaatgtgcctctagcattttaagtcacagatctaggtctttccatgggtcctaaacttcagatttttgtgccccaaaataatgcattgatgtttgacattttgccaggttctagaaagccctgcccttggccccagctgtgagctgcagagctcagtgagaccctttttaatcttcccccaggcccagccctggccttgcttccatgagcagaccagcctccgaatctctgagccaccaaggctgcgtgtggaatggggctgtcagagctgctatgaatcaccctggagctgtctagaggacagtccaggttcttaccctgcccaggaattccagattgagccaaaccagctcagtcaagtgagactcccaggggacctgtgataggagccggcaggaacctctcaggattagagcgattaagaacaaagctttggaggcaccaagcactggggtcgaattgcatttctggcaccacttgctggctgttggtcctcaccatggtcactccttctctgaccctcgtgtgtgacagtggagtcacaggagcccttcacatagggctgtgttagggttataggaggtgacgtgcataaatgctgacaccttaaaagtgctcagcaagctgccttccagcaggagctcatctggccaggtggtaaatttggtgcctctgttttgttcggcccacgttttgcagagtgggattattcacttaaaagtcccagttttctgacttttcttaagaatcaattaatctaacatcctgggccgcattcatccatggctacatccggcaggagctgagtagcagctgcctccccaagggctcctctcagttcttgagcttgcaactccaaggcaactgcagaggcagctgatgaaagtctgaatatggaagccagccatgtctgtctcgtccctgatggggtgtgctgggctgtaggatatgaaatgactttgcccttttcctctaggagctatgaaagcaccccttagggaggcaaaattgtgctgcagttgtgctgctcctcccctcaacagacaaggagagaataggaaaccacattgccttctcattggaggcacaggcatcacagtcaggcagcttcgcagctaagttctgacacaagctgtgtgacctttggcaagtttcttaacctctcgggcttattttctgacctataaagtcagaataataattgccaatatcactgttgttgtgcggactacaccatatggtgacatgcttattttaatgcctggcttgaggtaggtgttttatacctaccagatttcttccgggggacaaccaggaaaagggttatttataaactgactactaggatatcattaaaaccagaagctttgaggggtatttaaaacttgtagaagacatagcaaacgtttaagcttttaagtgtcaaaaaatatctataaacaaatgcatatgtcttgcttcaggttatattttaacttgtttaaattgtatttcagttttgaaacctttgatgtgaacagctttgaacaattttgcatcaattacgctaatgaaaaactgcaacaacagtttaacatggtaggtgacctttctgccttcttgactagttctcagccgcgcgcgcgcgcgtgtgtgtgtgtgtgtgtgtgtgtgttcgtggaaagaggcattcttctttcttgaggttgcaaatttttatgcaaggagcctcacgctgggtcactgcaccaccttgtggccaaatcttgaaatcacaccctctcatctatttcatcttttttgaatcacctgccaatgtgtgagcctcactgcccttcttggatacagaccctctgtgcagccagacaaaactatttagttggttgcctgaggcctccactttctttcgagcctctctgtctttgcacttgctgctttctctgccttaacccacgtgctcctgttatttccccattgctttatcttcacgtggccaactccagcttgtgttttgagatccagcttccctgagagcctcctgcgatacctcctggcctcttcctatgtgcttccttatcgcaggcctgtcacatggaattatcatcatttgcatgcaagtttccaaatagacttggtcacctggagaggccaggactggcattctttgtctctctcagcccagtgcttatctcggcacatgcagcactaaacagcagatggccaatggattatgggaatgagtttctccaaccttaatttagaacaagacatatatggtaccttcctaactaacaataagatcaaatgtatcatcccatggaaacagacaggagatggattccaattttttttttccactgggaagatttgtttattcaaaagacgtttttgagtgtatactgtgtataccaggtaccaagttaagtgctgaggtagaaagatgaataaaacaatttaaaaaatgttgagtaaatgctacttgtggctgtttgggcatttattattgctatgtgtattgaatacaatttcaacctcttaaatcagttccctagatgcaagaactttattgaattcacttttgaattcccaacagtactgacgcctttctgctcctaacagaagtcaatgaaattaaaagttgattgaacatctttctacattggccctaccatgaaactactctcatattttttttataattgcctccttaacatttatatttggctctgtttctgaaaagccatgaaagctaaaatgctttactaactcacattttccctttagcttacattctaaactttggctacatgtttatgggaagaatggtgattccagttcataatagaaatcacactttaataccctaacagttactccaaggaaaggttatacctttgttagtgtccagtcttatgctccctcagaacccctgaggaaaacatagcatgacgtcttggagagtgtgggctttggctcaaactaaattgggtttgaatctcagctctaccacctccctctgggaccttgggttctctgagcctctgtttccttgttttaaaaatgagtcatcattacacattgtatgtatgtgtcagaatatcacatgtaccacaaaactatgtacaactattatgtatcaatttaaaaagagtcaataataactgtctaatattgtgagaagacctaacattgaatcctactcagtagaagtttctttttttttttttggcccagaattaattcatgtataaccattaaatttcattccattgtaaatttcatttctttagcatttgcaaggctctcctggaagtttaacattaataactacagctgaggtttattccaagtgcatattcagtataactcacctgaagtcaaactctctgtggctgctaccctgttccctggctgcaatggcgtgctgctccccaacatgtccaccttaacctcaaagtgacacttataccagatgtcttgccaaaaatcacaaatcagaggctgtaattctatttttttttttttgcttttgttctcctctcctgttcttcttcctcttccacttcctcctccttctcttcctttttcctcttctcctttttctgagtcatccatcaatgtgtagatcctcccaggaggggtagtatcttcaattgtcagcacagaaagctttgggtaggactctcctgatctccagtccccctcttctggctgccactgggccttgcacctgatgcccccagggagctcagcagtagcaagtgtagaagtgccggtgccaccttctcctctcagcccgcttaccctccacgtgactttctgtggtcaagtcacgccatggaccccatgtcctgagcctgacattcatcctgacctcttcgctcctcttcctcctccctgagtcccagccatcaagagcatcgggctgagtcctcattggtctcactgcctccggttcttccctcctctgagccatcctccaggtctcatcataacccctccgccctccagcgggtcctcactgctcctagaaaaaggccataggcccagaattctctaaggagggtgtgaaggtctcaggtgatttgactgtaccattctttgccaccacattgctgctgtcctcctgtaatttctaacctgcttgaggtgcgtttctcaagcacccattgagctttcatgtggttcccactgggattcctccataggagggttttcttgatgccccaccccaccccaccctaccccacctcaccacctgccagccaaactttctttcatcctccatggtaagcctgagtacatcctctgggaagcctccctgatacccttacagcccaagtgagtagtgcacgaagatctctaagcagtgggcttctcccaccggccccgcagctagcattctcaggtagctggctccacccagccaggctgcattaggccaaagaggctggatctgtccttggatagctgctagcaggaaggggctgtaggaccacactgagtaccatgtggtgctggtggtgacacaggctggcccaagccatgtcctaggaggtagagacccactcagactaggtgggaggatgacagctagactcgctttaggaactcggcggtattgatcacggtatgggccttgtctatacttcagggtccttctttttaaacataaatattacagatcaaccatttacattttccaaatgcttacatcctgctctttggaaacgtattttaatattctgttttactttctgtattaactttggattcccagcatgtcttcaaactggaacaagaagaatacatgaaggaagatataccttggacgctgatagatttttatgacaatcaaccagttattgacctgattgaagcaaaaatgggaattctggagttactggatgaagaatgtttggtaacttttaagaataattgtttttttcagcttttaagtagtaacagatgagcattttgcaaagcagtttttttgaagtgtgcttgtgaagtcctgatgtttatccagttggttggatggatattaatgctgggacagcatccacagcagggaccccagagggcccactgggccttttgccctcagcctgtgtagaccacgcttggggagctgcaccacctcttttacctgacttccagcatggaggctgtcccaaagtgtatgtagaaacatgcatgaaaacagcaagtgactccactcaagttgtcggtgactaataagaattgagttttcttttacatcctgattcttgtgagtcatcaagaaaaatcaacatcgtatgattcaccagaagagctttctagagttttcttcttaccatttccctctgggaaactctgaagtaggccagcctggcagtgtctctcatggggccacaagaacaaataatcccaaagtgaggattaataaggtttcggggttaaaggattttttttttttttgagacggagtcttgctctatcacccaggctggagtgcagtggtgccatctcggctcactgcaacctccgcttcctgagttcaagtgattctcctgttccagcctccggagtagctggaattataggcgcacaccaccatgcccagctaattttttgtatttttggtagagacggggtttcaccatgttagccaggatggtctggatctcctgacctcgtgatccgcctgcctcggcctcccaaagtgctgggattacaggcatgagccactgcgcccggccaatttttgtatttttagtagagatggggtttccatctcaaaaaaaaaaaaatcacatgtatcaagatcaaatttcgcaactagcttagtacaaggaggtatgcccttatttcaaggagtgagttaattaggaagtaaaataagaaaaactattttcctgaggcaggggaaggggaggactctctattcaggtgccagtcttttcccattcacccgtgaataaaggtcatgttcgtgtaatggaacccacactattttttcctgaacctttagatttctttgggaagaaataaaatactgcctattttatagaaataaaattcttcattctaaagtcattgtgtgaccatttctttttaaagttttgttcttctaaagagactttgatgtatccattaaaatatcacatcaaataccccacaaatatatataattgttatttgtcaattaataataatttttaaagtgccctaaagattaagatcaaggataaattaatgcctaaagttgcttttttaaaagcctctaaggccaggcgcagtggctcttgcctgtaaccccagcactttggggaggccaaggtgggtggatcacctgaggttaggagttggaggccagcctggccaacatggtgaaaccccgtctctactaaaaatacaaaaattagtcaggcatggtagcaggcacttgtaatcccagctacttaggagactgaggcaggagaatcgcttgaacccaggaggcagaggttgcagtgagccaagatcgcgtcatcacactccagcctgggtggaagagccagactccatctcaaaaataaataaataaataaataaataaataaataaataaaaagcctctaattgagagcagttcactaagtgccaaatcaccttggtttcttagaattagtgcttttcctcacctgtatgaatctctggttttcttacttgctatttggtttatttttcttttccagttaccacatggaactgatgaaaactggcttcaaaagctgtataataattttgtcaacaggaaccctttgtttgaaaagcctagaatgtcaaacacatcctttgtcatccagcactttgctgataaggtaccgtgaaggtctccatcaatgctgtcaaccccggaacctgtacagcctccagaaggagtaggcaggccaggaatgtttctgatcagattcaagtcatacttaacatgtagctttgatgagtgtgtgtttaacagttccttatttgtttttgtggcgagatacatgagttccaactgtactactttaaagacgaatgtgttgttagaagaccacacttctgattttggatgtactgaagttactgaatttcattaacctcttatcagtttattttctatatgaaattgtgataatcaagacagcataattcttccttatgatgaaagctatatttttttctgaagttctatttgattaaactggactatattacagtggcaacataggttaactcaagatgataatgggttatcttcgtgctttttttcatcttttgtgtcttctttttctttatacgtctcctttttctttttactaaacaaatgttacttgtctaaaatgaaaaatttttgttaaaatcacattatagaaagcttagaaaacagaaggaaaaaattgccataaccacctgccctaaatgtacattcttatttgttttccttccttaagggagctcctacctcctcccatgtcctggttgggtgttgccttggtggcctagcccagtgccagggctcacaggaatggcttgtgcttgtctatgtttatcgcagaggccggtgctgtgagtcagagctggtcattcccgagtgactgatggtggagggaggggacagcaacctggaaagctgtgatcacctttgtgtgctagcagagtactgtaaaatattaaaatataggattggccgggtgcagtggctcacacctgtaatcccagcactttgggaggctgaggcgggtggatcgcttgagaccaggagtttgagaccagcctggccaacatggcgaaaccccatctttactaaaaaatacaaaaataagccaggcgtggtggcacgcacctgtaatcccagctactcaggtggctgaggcaggaaaattgctggaacctgggaggcggaggttgcattgagccaagatcacgccactgcactccagcctggctgacagagtgagaccctgtctcaaaaaaaaaaaagaaaaagaaaaagaaaaaaaaaagataagtttttagtgcttagactttttcagatgggctcctgaaaagatgcctatgaaatgaaatgatcatatgtcaaattatatttcctagctattgtcataatttcagggttctggtcccataggaaaagggagggggaaagaccagactccataaaaagcacatatgggatttctttcaagggtctctctttataggatgtagtttctggacatgtaattctctcacctgccacttccaagaagtctcccttaaaagaactaggcagcgtttgggctggactatggattgattggtgggaagaacccacatgcactatggggttagattaggttttcaatctcattggccagggaaatcaggtcgtattgaatgcaagtcagctgagcttagatgtagcagctcagcacatcttcctttggtcccagagtccccaacagaggcaccagctgcatgtgacactgtccccacagatgctcgcccagaccaggaaagctctgtatttgccacctttgtctatctgtcctagtggctcacaccaccattctggaagaatttgtacaacaatccaggtacttcattcacaaagaagtgtttgcaaacagccggtgttcctggatcttaacctacctaccggcaaggatacttccttacctgggggacaaagcagaggccatgcccagggaaccctctgcttacggattccagcactctcccctgtttcctcattgtcaatttttaaaattaattttaatatacgtttttaatttatgaaaaataaattatcacatattaagatatgcaatccagaggcataaactagggggaggttgaatgttgaagcagccaccctggatatgccatggtttgaggcattcgagaagccttcttcatcagaaagggcagcatggagagtttttctaagctagattcaagcagtgcaaaggttgacccactctaaacctgattctgagggcttggtggctcttgaaggcttggtggtcagctggtcggtttttctatcctttctaccacattaatgttgatttaggaaacgatgtctgtttgaacccaatgaacaccactaagctttttcctcctcctggtggcttcaaaggcaaagggagacctaagtcaggtgttcttgtaggaactgcacataccgcagggagcaactggacccctgtggccagagggagccaacaggtgagtgcagagtgatcagcaggcaggtgagaaacccaggtggtgggagagaagacacattcccagcttatacataatggggctgctgccatgatgcacagaagccagacgtctttttgtaagattgcctctgtagccttttttattaatctttcttaaaaaagagatgaaacttgtgcttagaggctatattctttggcctctttgggaataattaattgctttctctgtataggtagagtataaatgtgaaggtttcctggagaaaaacagagacaccgtctatgacatgctggttgaaatcctgagagcaagcaaggtctgtaaagtcctaggggtaactaaagttattatataattgacatggatctagatgtatataaggaaagagtaaggagagagagagagagagtgtgtgtgtgtgtgtgtgtgaactctctggacagtggtaagttgtagctcacagattcaaaaagataactactgtaaatctctactatatgcaaaatcagaaatcaaacatgcagatgacaggaaggacagctaatagaaccattgaagaatcacaattccagccagacgtggtggctcacgcctgtaatccccgcattttgggaggcagaggcgggtggattgcttgaggccagaagtttgagaccagcctggccaaaaaagcaagaccctgtctcttctaaaaatataaaaaaacattagcagggaatggtgacatgcctgtagtcccagctacttgggaggctgaggtggggaagactgcttggccctgggagatagaggctgcagtgagccatgattgcgccactgcactcttcttctgggcagcagagcaagaccctgtctcaaaacaaaacaaaacaaaacaaaatatgaaattcactctgagagaagataagacatttaaagaaataactgatacaaagcagaaggtagtaagtgctttaaatgaggtacaaatacaagatgaagacggttcagagaagttgggattaattcattcattgcgaagtgggtggggctggaaaacattttaagagattcctgggtagggtttggatctgcagggatgagaatgtggagtaggagggaggagattgcaggtggagacacagtgtgagccaggcacggaggtgagaatagtagatgtttccactttctgacacttagagtgatacccacatacagacatttacacacttttcttctctgttccccttctcgggaaagaagtcacgggccatccctatgaaagacgatcgtcttgtggaattgagatttggctgtagatgttggtgaggttgttcaccgcccactagtttagctgagttgttgtcaccatttacgtggcttgtatgagtgagtactgtgggcagttgcttttggacattgagatcctctctgttccttccagtttcatctctgtgccaacttttttcaagaaaatccaactcctccttctccttttggttcaatgattacagttaaatctgcaaagcaagtcatcaagccaaacagcaagcatttccggaccacagttgggagcaaggtactgagaaggtgtttgagagtgaggggtctaaaggcagggccaggccctggggagccagggcactcagaggacccgcattccaggcctggacatggacagacgctggggctcttccaatctaacatggactccactgcaaaaagttcatcgtcgtcatacttccacctccaaggcagcacgcactggagcaaaccacgctcttgcacaataacatggtttattcagttctctgctgtctgggagtattagtgttctgtccacaacagtaggacatgctgataaaccacagtcacggactgaaacctttcataataggtgtttatgcatgaggttaacttttcttcctattgagtaacttaacaaggttgggctgctttttaccgtgatgtaagcagtaaattatttcagagccatgtttgatctctagctttgtttcctagttccgcagctctctgtacttgctcatggagaccctcaatgcgacgacgccccactacgttcgatgcatcaagccaaatgatgagaagttaccctttgagtaagtgttcttatgcaacacacagcgaagacgtgggaaggcagtttctgccataaagttggagaatttgcttccaattgtcttgagattaccctgtttctgggtttttttttaatgattcagaacaatgctgccctttacataaaatgttagctcagcccctctggttaaaccccctcatctccagggctaagcaaaagggctagatttgaaagaatcttctacaactaaagtttttgcaacttgaaccttttacttgattaaaagaagaatgagtatgtgtgtttgtagaaggtcatagaaggtcagaacatttgtcctcagacatgatggcatgaggcattattcttgttctctgggacccatggaggagacccaaagcttgtgaatataaggtgtaacaagtcccttgtagcttgctagagctgaaagaggtgcctaaagggggatgagctgtctatggaggtggtgagtgtgtgtatgggtcaccagatgggtgagacctaagctgcagagctacctgttgggtgttctgtagaggaaattcaagcatcagtgggtgcttgggccaggcgagctagcatatttctttccacctggttgtcgtttgaagctcacctcaaaggccagttcccccatggccttctcaatgccacctccatcagagtcagctgctcctttctctatatcccactgcatctttatggactgttttgcagaggtgctatttttcttggtcatgcaatagaaacttattaagtatctgctgggtacctggcatagggtcacagtctagccaggtctgctgtgcctgtttatgggcatgttgagcaattacgatgcctcaacacataatatcattgtctttttaaagatttgactccaaaagaattgttcagcagctgcgagcctgcggcgttttagaaacgattcgcattagtgcacagagctacccttccaggtatgttgtccgtccttgtcttggagggaaaagtacctgacatcagagctatgctgagaaccaaggacatggctgccatgatttttgtcacatacttttggcttctgtaaagtgcccccaagattttcccactgccctgtggaagtccagaagaggttgagaaataggctttgtaggggtcggaggtcaacaccaccttctcaccccatcactgcatctcggctgctggtggtggccccaccgcctcccccgtgtactagggaagacgctgagtgggagaaagagcacaattgctggggcagacaggagtgctcagggtggtcttggtagtgtcccaggcaggcagggtatcaaagatcagtgcctttatcctcaggacagattgcaccacccccgccctatgacaacagtggcaggtaaggcagcggagtccccagacacaatgtgcttcctctgacactcctggctttgatcccctttgattttccaggtggacatacatcgagttctacagtcgctacggcattctcatgaccaagcaagagctttccttcagcgataaaaaggaggtgtgcaaggtggttttacacagactcatccaggtcagtttccccacctcctgggatcatggtctccttcctggaagcacatctcccaaacatgctgtttcatctttgtcttgaatgctcaggactgtaatcatgaacacctgaaaggaaagaaaatgtgccctgagcatttgtctgctgaagagaccatagcagagtgctcagtgggccatgagtccccgttagggacccacatccgaactccggcctccccagtgtcctcgtatcctgtttagctctcccacgatctaacccagtcctctgtggaccaggcttataggatatggtcaactggggttgtcaccaagccacatgggctccaggcatggtgccttgtgtggattgacatcattgctgcagcgatgagttgtgatgggaaagagatggggagttataaggtccagcaaaggggatggtgaagagaacccaaaatggagacagaaaaccaaacttccccagtttcttctactccaatgtggagaccacgagagagtggctgaagttctctggcagcccaactgagaatcgccgcaaatgacactcactccccttctcacccacaaatggattcctcagcctaagtcccatttcttcctccagggtaattttaaacaaacaactcaaagtatacatttctagatcatgatgtgagttttctgccttaaatgtcaaaatcacaatatttctggcacctttgaatccctaaagctcttttccaaatactgtattatagaaaatctgacagattttaattctaactatatcatttttctcttccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggtatgttggaatcaaggaacacatgtggaactgtggggctttctgtgctgatcatctccggcggggaggactcatcaaggacaagggacctttctcctgtgacccagggtgcagacgtgcatgggtcccctttgtggtcgtgagcattagggcaagaaaggtccgtctctcaggggcaggtagtgctggctctgcctggtgtctgtgtggtgagccgacacccagggccctgcagggaggaagcgctggtgagagtgttactaaggagagtcagggttccggaagctcagggagaggcccggggcccctttcctatgggaactgaaaatgcataagatcagcaaggccctagtgaagatccaaaggacagatgtcaagaatagccagcgaccagcctgccagcaacaggtggggtgcaccatggcagagggggtccctgcaaggcctggcagcaaaccaatcacagaacccctaagcaggaagaccacagcagccccagccaagccaagggctgaggggagggtggtccaccagctgcgctgatcctacctgcctcgaggggtcctgagagtccacacaaccctgccagcccactgaaggaccacggtcattccgggacttccagggctttggtgtacctgctggaaagcacaagaccagggtgcccctagataaactttgtgtttctctctgcctgctctgccccttctttgggatgctgtgaggatgcttgagaaggccggcgtttagggtcaggctgcgtctgcaagcctgacttcttcctgagctggaggctgaactgtggcagcatctggccttctctgcatgaccagcgtggtgtggcatggatcacacagctgggctggcttgccctcctgtgcttctgtgcccagttgataacagcagtctttggggaaggaaatcacagttatcttacccgccaaggccacgctcccttcccatttggggctcaccagagcctgatcatcctgccctgctggcctcctgcctatcccattcatttcatcccactcctgcccccagtttaggctcacggcatcacctgccttgcactctgatggcaccgtgctccacctcccacctccttcccatcttcctacatcagagcctgattgagacactgccctgcacctgcctttaaggcccgtgtttcctacagaatagcattcagtctctgacgtgatattcaaagccctccatagcctgggtgcattcataagaatggaagctccatgagggcaggggccacacttgtctggtcattcatacccagacctagcatggtggctgtcatagaaggtgttcaacaaatatgtttttaaaataacaaatggtgcacatctatttttctaacctcattgacgtctaattttcttcatccatcttattctagtgattccaaacaaactccttttctgagtatttcaggcactgtagagcctccatgcctttactcatgctggtcccttatcctgaaagccttttccagccttcactgtgtacagacatcctactgcattgggggctggctcacatacccactttccccaagcagaataactgtttttttcccctctcacttacagatctagttaggtggtattttatttttcctctttcttggccatttgttagtctttctgtacatgaggttgtaaactctaaaggtaaggacattatcttcacctctagtcatttagacaggggcagcaaactttttctgtaaaggacgagatgataactatttaaggcattgggggcttgcagtctctcctgctgctgtgtcatgaaagcagccgtgggggatatgtaaatagtacgtgattgagcaagtgcagcaccagtgcacagtctcatcatcgtctctgtgggtacctgagtggaggtgaatcgactggcctgaatgaaaagagtgaaagttcccatgtggttcctcaaggacagggaactggggactggcctcaagtaggcattagaataaactgcccacagagtttaatgtggagaggtgtaaaatatttgaaccttccttataaacacatgctagccaagcttgcagctctgttatggaagttgatgctctgtgggtaacagactcactcttcatccttgttaaccaaggaaagctattactgcagtggccttaaaagaagcttgggcagccataatcattcagaagcactgccgcgggtatcttgttcgcagcctgtatcagttgattcgcatggccaccatcacaatgcaggcctacagccgaggattcctggcaaggaggaggtatcgaaaggtgaggccaacctctgtctagaggaagggagggtgtacgggccttccttactgagaacaaaacagggcccagggaaagacttcactatgggcaacctcactttgtacaaagtgtcagccaagccagaaaggagattcttccaggtgctgtggctcatgcctgtagtcccaactactcagggagctgaaatgggagggttccttgagcccaggagttcgaggctgcagtgagctatgatcatgccagtacactccagcctgcgtgggtgacagagggagaccctgtctctctctctcacacacacacacacacacacaccagttgcactgttggtttctctttctcccagttggccccaaagagaccacaccaaaggaaagtacattttaagccaataatgtgcacctaacagacaggatatacacctaacagacctcacctaaagcagagactgggttggggaaagaaattttaaaagatcagcacactggctgggcacggtggctcacacctgtaatcccagcactgtgggaggccgaggtgagtggatcatgaggtcaggagatcgagaccatcctggctaacacagtgaaaccctgtctctactaaaaatacaaaaaattagccgggtgtggtgacgggcacctgtagtcccagctgctcgggaggctgaggcaggagaatggcatgaacccgggaggcggagcttgcagtgagccaagattgcaccactgcactccagcctgggtgacagagtgagactccgtctcaaaaaaaaaaaaaaaaaaaaaaaaaaagattagcccactgccaccccacagactgtagagagctctcacagccagatgggatgtccagggtgtccaactccaaagaaacgaattcaaagtaatataaaattgaacaagttttctacataagctattcaagatttctccagcactgactaatacaaagcacaatgagatggctcttttagaggcagcagctttagactcagaaaagggtgatgagatgagtttcatacggcaaaaaaataattttctttctttcaaggagggaggagagcaataagtgttcacttcaacataaggggtgcctgatccatcctgtgagtggatgggaaaggggttgagataggacaaaagtttggtctcagagatttcacaatcttaattcggtcacttctgatgaaaaagtaaagttgtccaaagatactttaaagctgaaaacctgaacagtatattttggggggtttcattctggctaactcctggaatcaccttttaaaacattttatttatttatttatttttgagacaaggtctcactcagttgcccaggctggagtgcagtggcacaaccatggctcactgcagcctcagcctcccaggttcaagcaatcctcccatctcggcctcctgagtagctgggaccacaggcgtgagccaccatgcccagctaatttttcttttttttttttcttttttcttctttttctttttttgtagagaatgagtctctatattgccaaggctggtcttgagctcctagactaaagggatcctcatgcctcagcctcctgagtagctaggactacaggtacgtgccaccacacctggctaatttttaaaatttttttgtagagatgaggtattgctatgttgcctaggctggtcttgaactcctggcctcaagcgatcttccctcctgggcctcccaaagcactgggattacggtgtgagccataggcctggccctagtgcaactgttttgatgttgaatatgacaagtatctttttgaaataactagtctctccaaaaaaagaaaaagaaaaagaaaagaaaaaaagaaagttatggcagagaccaatttcttgggacatgggtttctcatgccattttttaccaacaatagtaagactgtttttctgcataaagaccttcctggagacagggggttctagaatgagagtgtctgttcatatacacctgctacaggtaggatttggttattgtttgaaaagtctagctgtaatacggctgtgcaggttgacaagaagaaactcattttctacaccgtggtagttgcatcttccagtgttgaaggagttggttagagaagcacttgggatccagtttatgtttcacaaaatcttgttttaaagatgctggaggaacataaggctgtgatcctacagaaatacgcacgggcgtggctggccagacgcagattccagagtatccgacgattcgtgcttaatattcagcttacttacagggtccagcgtttgcagaaaaagttggaagatcaggtaggtgctcatagtgcatcttttacatttactttttcttacatggctgtagtttgttctggagcagttccttagctgtgctattaaaatttatgccatgttaggaggttcagtttacgtggaccacctgagctaggaaacagaagtacactgtaaagggttgctatggtggtgtaggttgtatagttgtatactgcacaagtgtgcctacctcagagggcaggtggggctgagatccagcctggctccgcttgccaaggcaggtgttcctgtgtgaagttgtgttgccttgaggcaaaggtacctcctaatttgctcaaagatgctgtccgcatgccaagcgtgctgccttgggatgacatcagctcagaggagctgccatttctaattttcccacaggtgccttagggtctagctgcagccctgcctagtttgggaagattccccataccattcccactggtatgaaaagaaacatccaaggccgggcgtggtggctgacacctgtaatcccagcactttgggaggccatggggggcggatcacctgaggttgggacttcgagaccagcgtgaccaacattgcgaaatcccgtctctactaaaaatacaaaattagccgggcgtggtgatgcatgcctgtaatcccagctactctggaggctgaggcaagagaattgcttgaacctgggaggcagaggttgcagtaggccaagatggcgccactgcactccagcctgggcaacaagagcaaaactccatctcagaaaaaaacaaaagaaaagaaacatccagctgggtgcggtggctcacgcctgtaatcccagcactttgggaggctgaggcgggtggatcacgaggtcaggagatcgagaccatcctggctaacatggtgaaaccccgtctctactaaaaatacaaaaaattagccgggcgtggtggcgggcgcctgtagtcccagctactcaggaggctgaggcaggagaatggcatgaacctgggaggcggagcttgcagtgagccgagatcgcgccactgcactccagcctgggcaacagagaacgagactccatctcaaaaaacaggcaaaaaagaaaagaaaagaaaagaaacatccatatgctctcagttggtggggagggctatggaacacacagtgtctagatccgtaaaactcactcccaggcctgtctccactaattctgaggctctcctaaggtgagctttaaacttagccttaagctatatcataggggtcctgaatgaaagggtgagtgggtgaagaaatagacttggtgtctggtggggtttccctcattgtgctgttgtgtaacaagcctgcatgctacacagcttgtgcagaatagcacttaaaaatagccgcagccggccaggagcaatgcctggtgggagtcccaacgctgcctgagctctgtcctaggtgtgttagtttgctaggactgtcatagcaaagtatcactgactgggtggcttaaacaacagaaatttagtgtcttacagttttggaggctggaggtcccatatcaaggttttggcagggttggtttcttctgaggcctctctccttagcttgtagatggctgccacctccctctgtcttcacatgatcttccctccatgcctgtgtctgtgtcttaatccccttttcttctaaggacgccaatcttattggactagggctcaccctgagggctggttttaccttaattccctctctaaagaccctgtcttcaaaacagcgatattcctaaattcaggggttaggacttcaacaaatgaattttggcggggggcacagttcataacactagggttgtcctggtttgccagaattggaaacttcccacattaaaatagccaccagtttgggaagatgtgtacccagcaagatctgccatactgtttcaccacaaagaagatgctaacaaatgtcagtgcagtgataagtgtgatcagcataaagcaacctctcaaatttggatgctgtgtcaaaggctatgagaattaaatggaacagcatctttgtttggattaacctctaaacatctgaattttcttttctctagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagaggtcagctgcgggcgtgtgagacgggatggaaatatgcggactctctgtgaaaaagatgagcgctgccagcttttcctatgaagtggatttctgcagagcaaatcagattttgctatcaacttccattaccaaagggagcctaccttttaggaaaggcgagatcagaggattagagtctaggggaagggaggaggttaataatgagagaaatgcaacataggttttctctttctttcaagttttgcaaaatgatgacaggcccaaagagccctggctggctgcctccctttcttccaggatgaccttggtctcctatcacttgtccttaaggtctatgccctggaaatgtcttcccctgaacagcgatgcaaagctagggtagggttttcatctctggtgtagtgaaaagagcagtcagcataaaaaccagatgccctagattcaaatcttgcctttgtctggctgggcagccttggctaaagtcccttaccctctctgaattttagtttcctcatataaaaaaatgagaataacaaaaaaggactgacagaattgttgtgagaataaaatcatcagatgaaatacgttagccaaatgcctaccataatgaattttagtttcctcctatataaaatgagaataacaaaaagagattgacagaattgttgtgagaataaaatggtcagatgaaataatgtagccaaatgcctatggtgagtccctgcaaaagtgtgagctagtgtgttctaagaaggtgatctttattatcatccactctgctgcattttgttttttttttgtttttttagacggagtcttgctctgtcatccgggctggagtgcggtggcgcaatctcggctcactgcaacctccacctcccgggttcaagcaattctccttcctcagcctcccgagtagctgggattacaggcatgcgccatgacgcccggctaattttttgtatttttggtagaggtggggtttcaccatgttggccaagctggtctcgaactcctgacctccagtgatccacccccgcttggcctcccaaaatgcagggattacaggtgtgagccaccgtgcccagcctctgctgcattttcaaagtcctagcacccagggttggtggcttggaggcccagaagacatccctttgccctccccatgacccggtgctgggtgcaccaacactgctgccgtgggcatcgccagctgccagtcaccatcagtcagcaccacggggcctgctgccagcccagcagacactttaccaggagaagttgaaatgataggaatcctgctgtgctcacacatccttcctgagtcataacagttgcaaagtgtgaatcccctttacgccatcaactgtgtaatcatagcatattcgacatataaagtcccctggctattgagaagctcgacaaaaggaagaagtatgtccttgacattgaggagcccttgaatgtgtcctttctccttgtttcagtcattgctggccaggtcgggaatagtgtcacctttgaagtcacgttgagctcttgcatgtgaaacaaatggcagcgtcttacagtggctggtgctcgctgttatctatagacaggagctgagaaaaaataaactaatttaagaatatacatctttttgtgaagaaaggcaatggtgacaacttgaagtgaggttttcaaaaaagtttgtttttcccccttccctctgctagaaattggcaaagcttcagaagcataattcagaactggaaacacagaaagaacaaatacagctgaagcttcaagagaagactgaagagttaaaaggtaaagcttggggggcacaaatccagacattcactgatttagtcactcagtaaacaatactggggttgaccagttttagaaccaggggtctctggtgtacacttagtttagtgaggcaatttttgctcacaaggaatagccatatttaagtcgtggtaactttgccctacagattcgtctgttttatttctgtcttttgtcagacagcacagcatttcctctctgtgcctcagaacctcctgggccctttgcaaagtacagatggtcggaccatgagcccggagcttttgcatcaggaaatgggtgtgtgtgtgtctgtgtgtgcgcattcgtgtgtggtggtgtcagaggtggttcagacatccgtaattttagaaaacctttacggtaatcctgatgtacagtcagagtaatgctgcagtcatgtttggtgctcaccaaagatttgcagaaaaaattctgatctgtcggagttacttagcctaagtgacacccatgtcctctgctactgtcctgccctgaatgaagaagggcagaccctggaaccagtaggtatcacttcctttagggctgtggaacagctacgcttagcctagctctacacatttgagcttttcagctcaagttcaacttgacaatacttgttgtaccccagaaaaggcaacaggcaacagagcctggtgatccctgaccagatagtttaaatcaccactctcagtgatcttgcctagggatctcttccttgagctccaacgtgggggcagcaggaacacgagggttcaggcctggggattctacacgcacctctagcccagcaaatggtggatatgatggggcccagaggagtgcagagccctgggagttcagggcggagagtgggaggagcgaatgttggtgaagagggagtaaacagcctgacaccagggcactggggcaggaaaggctgtgcaggtgctgacgaggagcaggccatgccctcctgttctaggtgctgcgtgccctccaccctgtctctgtagggctgatggtgtgggcacagaagccatgtgaatgtcagagatgaacaggagcatgtcagaggtccgggagtaaaccttgaacctgagttaggaaagggtttcctcatctccaccctttttattacagcacactcctcttgggtggttgttttggcttttttcccccctaacttcaaatagaatttcccacaagggcatttaaattctcaggaatataacctgaaaattatgtttctgagaccatgtcatgtttgggtgaataattttacatcctcttccaaaaagtccatgaaaactttcaatgtaatatttataaactgattatcctgtgcgcctcccccgacatggcaaacagtgttttgtgaatagcaccaacctttacctatgcttgtgacctaagacccagggatgctatcaaatgctgtttctcctttttgagattctaacttaacatggacataatcccattcctcttgagaagtaaatcacattcgagcagcttctttagcgcatctgcaaatggcctaagatggtaagcaccagaattaaagccaatgcttttggttaattgaaaattgaggttatataaaacgtgttggcttctaaattaaagcttgagcatttcccccagtatttcctggctgccttacaacgttctgaagcagtcattttgattcagaaacatttggcactatgttagacaaactattaaactgttggctaaaaaaaaaaagtaatttggagaattgctatcgacggtgcaccccgaggactccttctggggtggggctcagaggtgaggtagagctcaaggatgagatatcagcttagtgcaaatagggacatcaccatttgaggggctgcactgccattctcccattttgatggcccctgtggcatatgggtgtgttgggaatgtggggttgtcatagccatggaacgtcctgcccttcggcctgcagactttgtgtttgcgactcttgtatttcagtgttaacagctgccttttttgtacttcctctttcccagatagagacagacacttgattattttcttggttatcacagatgagtggttctcagctttgctgccacctcaccccccagacatttgccaatgtctggaaacaatttgggttgtcacaactggagcagaggtgctactggcttctagagggtagaagccagggttgctgctcagaatcctgcaatgcgtgggacagcccctctccacagcaaagaattatccagcccaaagtagcaatagtgccaagaccgagaaaccttgtcacaaatggatcattttcttcccaaagggtttctatttatttatttatttttttttttttttaatttttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtcttgatctcctgacctcgtgatccgcccgcctcggcctcccaaagtgctgggattacaggcgtgagccaccgcgcccggcctctatttatttttaataatattcattgtctcaaagccaatatctactttaataaataacagaccaacaaaagtactataaatgaaactatttattgataattccaatctgacaaatttgtgagaattattattttgaaaccccctcatctttatttcttgtttataaaaaatgagctatactctcattgtaagtcctgttaataataaacatcacatgattgtcctgacattctcactttcttaaacataacatgaaacaatcaaggcattgatttggcagacatatctcaaaaagcattctctttttacagaaaaaatggacaacctcaccaagcagctctttgatgatgtacaaaaggaagaacggcaaagaatgtatggaatctagtttgccttaaagctactttctttcttctgtctgtgctgttttatattttccatctcagtttgcatatagcagacacagatacaagaaagtggggtgtgactgtttttaggaagtgagattagagatttatgagagctaagttccacaatgtgtactgtcagatactgaacacattctagactagtccataaagcttctgctgggtgggtacagtggaccaccaggaattcttttcttttcttttcttttcctttctttctttctcttctttctttctctccttccttccttctctccttccttccttctctccttccttccttctctccttccttccttctctccttccttccttctctccttccttctttctttcttctttctttcattttctttcttttccttccttccttcctcccttcctcccttcctcccttccttcccttcctttccttcctttccttcctctccttttctttcttttctctttctttcttttcttttttttttactttattgctaagacagtgcaaaattcagagactaccaccaccttcaacttctaccaaatccaagaattaagattcttgcctaggaaataaacctccctcctttccttccccacctattgtccttgttagtttgtcttttatcccaaaagataaggtaagtaatggacctcacagaaattaaggcaggtgcctgaccttgtactgtaccagcccacctttcctatctcaatagcaaaccctttgctaacctccaaggactccaatctgggcttcccttctcttaaggagtcaaaggtttttagatctcaaagttggggtacatggcagggtcccggaaagagatagaacatgcttggcacatctcttttgggggctaggaagctcagggctgcctgtggtggtaggatacaaaacttccccatgcagtgagcaggacagcctgcgtctgggtgaggaagcaggattctaaagagaggagggaatatcacagaatcgctccaggagttaacaaatatatgaagtgtttcatgatcctccatcagtttttaaatatgtctaattaactcatttacctagaaaaatataattgtcgatgagtttttaatgtgaggagaagagctcggctctcggcatctgtccacgtgcagggaccacttgggagtgatcatttcaagcaggggtcttggagagccaggctgaggccaggtcattttgggctgtttgcaatcctaactgggtcagggcgaggcaggccagtgaagggattaaaactcttcaccctctctaggcccgtgttctgcctcctcattagcactcatctgtagcttggtttagtccctggtcagccaaggggggaattcctggcccctgtcaaaattctcaggaggctccaagaggcctgcagtctgtgggcaccctcctgaccagctcaggctgtgggtctaagattctttttacataagacttctgggccaggcgtactggctcacacctgtaatcccagcactttgggaggccaaggtgggcagatcacctgaggtcaggagtttgagaccaggctggccaacatggtgaaaccccgtatctactaaaaatacaaaaattggctgggcgtggtggcagatgcctgtaatcccagctacttgggaggctgaggcaggagaatcacttgaaaccgggaggcggaggtttcaatgagctgagattgcaccaccgcactcctgcctgggcgacagagtgagaccctgtctccaaaaaaaaaaaaaaaaaaggaagacttctggctgccttttcctttttcaaaggcattttactggtctcttgggagcactgcagtttttttttaaaaaacctggaaacaaagttcgttaatatctgtagaaaaaagaggttatgtgcagtgctcacacctgtaatcccagcactttgggaggccaaggcgggcagatcacctgaggtcaggagtttgagaccagtctggccaacatggcaaaaccccatctctactaaaaatacaaacattagctgggtgtggtgttgggcaccttataatcccagctactcgggaggctgaggcaggagaatcacttgaacccggggggcggaggttgcagtgagctgagatcatgccactgaagttcactccagcctgggtaaaagagcaaaactccatctcaaaaaaaaaaaaatctataaaaaagaaatcaaacaaatttattaggaatgtggctctctttctcagagtttttccctttgtgctataaaagcaagttttaaaaggaactgaaatgacagctcagcaggtagaatcatttagtaaactcatagagctcctggcactgcttcaagggcccctgtgggctgtgttgggcttgtctaggttatgtatctcttttcaattattttcttagttaatcatcaaatttttaattgagcaaccttctagagcagttggatttacatgcacttttgggcacgtggatttgctgccatttattctagaatttttgaagggctagacccctggacatagcagatagctctattgtttaggatcaaacaaacctccagcaggatccttggaacgaggaaggagccaggacttagcagagcacgccaaggtattcgctgaaggaaactggcccttccaggggactgcatggaacccggggggttgggaatacagtgccccaaaacccagtgtgtcttttaagttcagcctccctagccagtgtgccctgtgcgtgatcactgtaaagccacacctttcaaatcaggaggtgtaagaagttgtctttaacctaagggaagaggaaacagtttgctaaaaataaggccattacctgctggaactgtcacagtaggttctaattaacttgtctcctcttgttgttttcaaaatgatgtattctaattcaaagtaaagactgtagagacaattctaaattattttcttcttttttagggggtgttgtggggagggtctcactctgtcacccagattgaagtgcagtggcacgatctcagctcactgcagcctggacctcctgggctcaagcgattcatccacctcagcctcctgggtagctgggactacaggcgtgctccaccacacctgactaatttttgtatttttagtggggacggggtctctcttgttgcccaggctagtcttgaactcctgggctcaagggatccgcctgccttggcctcccaaagtgctgggattacaggtttcagccaccatgctcagctctaaattattttcttcttttgctgcgtaggcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaaggtagagcggctctcacgttcagccccgccctctggttacgtcatttgattgcaattccaagttcccacagattagacagctaaaagcatctgtgtaaaggccacaggcaactggagcctgattccttcagtccttccaactgtgcacctccaggctgcctttgatttagcaatcattgtattccatattttaaaagtcaactttctaacttttttgaaattacatttatgtaaagttatttaaatatgtcgatgtagagaatactcccaaattagactgtaaattgaggtgaatccttattatataatccatcactataaatctataaacacctgcattaaagttaagttaccttattatcaaaatctttcatttaaactgttattagaaaatttactaaaacaattatccaatgcacagtgtggtgaatgtagttaataagagcatattgtacattcaaaattgctatgagtaaatcttaaatgttctcaccacaaaaaatgacaagtatttgaggtgataacatgttaatcagcttgaattattccacaatatattcataaattataacatcaataaagctataaattttcaatggtagaaatttttaagtaaatttttataaagctgagaaggaaaaatcacatagaatttttaaaactgcataatgatatataaaaatattgttacctgccgggcacggtggctcaggcctgtaatcccagcactttgggaggccaaggcaggtggatcatgaggtcaggggttctagaccagcctgaccaacatggtgaaaccctgtctctactaaaaatacaaaaattggctgggcgtggtggcaggtgcctgtaatcccagctactcaggaggctgaggcaggagaattgcttgaacctgggaggcggaggttgcagtgagccgagatcgcgccactgcactccagcctgggtgacagaccgagactccgtctcaaaaaaaaaaaaaattgttacctgtatctatcattaaaaatatataaatattcctgggcaatttaataaaatgctctagagaaaaatgaatgaatggatgaagtaatgatccatgcttggacaatcaaggcttaagtgaattgtttccctaccagaaaagttaaacctgagtgtacctacgttcttaaatgtaagacatttcatcattaagttggaaagcttttaagcttctactaaatatgtgaaatacatattagtagagtatttgtaggattatggaaatagtctctgtaattgtcatgaactagccatgcgtggtttagaagagcttttggaattgcatccgggtggccactgaattccacaactgaagtgtctgtcttttctgggccccgtcccctattgtttaaaagtaggaggtcagaccacatgatcaggaagggtcactttcattcctgtgactgcttcactcttagcagccacatgagcctgatgtcagtcagtctgtgggagtcctgtcatctggctgaggtctgaggtctgtatcttaaatgtaggaacttgtgagactgcgcttgcagagaggtaccagtaggtgtcactcacttcctctttggtagctaagactggttcactctccaatgtgatccattaagattacttggggctgggcacggtggctcaggcctgtaatcccagcactttgggagactgaggtgggcggatcacgaggtcaggagatcaagaccatcctagttaacacggtgaaaccccatctctactagaaaaaaaaaaaaaaattagccgggcgaggtagcacacacctgtagtcccagctactcgggaggctgaggcaggagggtcgcttgaacctgggaggtggaggttgcagtgagccgagattgcaccactgaactccagcctgggtgacagagtgagactccgtctcaacaaaaaaaaaaaaaaaaaaattactctgggtttttgtgttttgttttttgggttttttttgagacagagttttgctcttgtcacccaggctggagtgcaatggcaccatcttggctcactgcaacctgcctcccaggttcaagcgattctcatgcctcagcctcccaggtagctgggattacaggcatctgccaccacacctggctaatttttttttgtatttttagtagagacagggtttcaccatgttggccaggctggtcctgaagtcctgacctcaggtgatccacccgcactagcctcccaaagtgctgagattacaggcgtgagccaccgtgcccagcctactctggttttcaaagaaaataactcatgatcatcaagttatatgtgttatagtcagtcttaaaagcctaagtaaatgcaaatctgacttggaacatttactgaaacattacaaagaaaagcatggccttcaggatttggatagtcctgagtcccccataaacctggcatgtgaccctgaacgtgccagtcagccttcagttaaatgtagctgctgtttgctaattgagaaaagatcactctacttacctcataggcctgttaggaggattaggtcttctaggtaaagtgctcagcacatatcagtttgattctcctgcttactctctgtagaaacaggggctggagcccttaaatactcagggtaactgaaaaaatatcaaggagagtttattcacctctgctgtccctgaaagtccttatatctccctcagatacaaagcaaaagcacagacctgtgattcttattcaagctgagctcacaagggagaataaaggcagaatactgcctcttccccacaaccagagctgcccaggccacctccttcccaacagccagctaactcccagacctcctggactcaccagtctctgccactgctccacatctaagctgagctgaagccaaaacccacagttatgaaggtggcaactttgcccatgtccttgcactcaatattttattatccattaaaagagaattttagcccgtgattttacctttctcagtcttccccctgtcccaccccaccccaagcttatagtaggtatttttttttctttatgtaacagggaagttaatttttttttttttcgaggtggagttttgctcttgttccccaggctggagtgcaatggtgcagtctcagctcactaaaacctctgcctcccgggttcaagcgattctcctgcctcagcctcccaagtagctaggattacaggcgtctgccaccatgcctggctaatttttgtatttttagtagagatgggattttaccatgttggtcaggctggtctcaaactcctgaactcaggtgatccacctgcctcagcctcccaaagtgctgggattacaggtgtgagccaccatgcctggcccagggaagttaattctactgatacaacccattagatctggcattttgagtagttaagcatgcttcaaggccaagctgtgtaggcagtgatggtttaacaagattttagctaagaaagaaactgcagtgaggatgtcttgcatagacacgcaacgctgtaattgtgttccctttgtcttatataaagcataatcgttgttttttctttacctgattccgtcattgctgtgattcagacaatctctgagttcgaaaaagagatagaactacttcaggcacagaagatagatgtggagaaacatgtgcagtcacaaaaacgggaaatgagaggtaataaaaatatgagtctcttagtccatgggtgcagactgaatttatcatagctgtgtcgctgctaaggaaacgtgtcctttggtatgaatttggttggacatatggtagattgcttagttgataggttgaatagctagttggttgaatacctggaagattggttagttggttgattggatagctggtgagttatttagctggagactgtgaagctagaaaactgggccctggaaagggaatgggaaaagataaatcatccacaaatgtaatatatacaactctgcctttccctttcagaaaagatgtcagagatcaccaaacaacttctcgaaagctatgacattgaagatgtaagaagcaggtaatcatttttgcattatcaaacattttaagacatgtaaacatgtaaaacgtgacagagatgatagattttcttatcttccttattttgcaggctctctgtggaagatctggaacatttaaatgaggatggagaactttggtttgcttatgaaggactaaagaaagcaacacggttagaaattctcctcagggatcttctttatttttcagagataataaatagactattggaaagtccaaagtttaccttacatagattgatacacaaattccttatagtagaatgactgaataaccactagaaatatttctctgagaagtaagtaagtagcttattcatgaagagcaatctctttgtgggataaaatgcctagtaaaaaaccccataacccatacagtgaaaactgattatcaaataagttagttaatgttgccagaaatatgtagatacatttaaatttaaggcatgtgctgcatttatttaaattaataaactttatttttcacagcagttttaggttcacatcaaagttgagcagaaatacagagagttcccatatatccctgccaccacacacacacaacctcccccactgtcaacttcccaaaccacagtgatgtgtttactatgactggtgaaccaacactgacacgccactgtcacctcaagtctatagtttacattagagttcactcttggtgtacattctgtaggttttgacaaatgtataatgactcgtatccacaactgtagtatcatacagaacatgttttgttttgttttgtttctgagatggagtctcgctctgttacccaggctggagtgcagtggcaagatcttggctcaccgcaacctccacctccaggtttcaagcgatttgcgtgcctcagcctcccaagtagctggaactacaggcatgcgctaccacacctggctaatttttgtatttttagtagagacgggatttcaccatgttgtctaggctggtctcaaactcctgacctcaagtgatccgcccacctcggcctcccaaaatcctgggattacaggtgtgagccactgcgtctggccagtattttttaaactattaagagtgtaaaaatataataacttctaaaattttcttcattgttaactacatattaacccccacataatgcttcctaactagctagaagattttataattaggcattcctgattctgtagcctgtaaccgtgagtgcataagtaaacttgatgtacttcgtgcacggctcttgttgtgggtcttcataactgcctcccagcagtccataaaacagaacaaaggccatgtggtttatttcttgacccctcctttaatagtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatggtatggtctcagccaggggccccagtcgtggccatcatactagagttgttctttgtcagtggcgtcaaattcagtttcttggcagtaaaagagtggatataaattactttttccagaagtgaaataacttggtctggtgattaaactataaaatgactgcagaccagagagcactctgatacaagagtgtgtgtgttcaccacaggatggctgcaggcgctgtgattgtctgtgtgtgcgcgtaagtgtgtatgttttaaagcctgtatatttaaatcaagccctaaccccttggaaagtgaccacaaaattgaagggtagctcttgagacaggagtgtgtcagaaggccagtcctgctcatgcctgaaatctcaccttttttttttttttttttgagatgaagtctcactctgttgcccaggctggagtgcaatggcatgatctcagctcactgcaacctccgcctcccaggttcaagcaattctcctgcctcagcctcccgagtagctgggattacaggcgcccaccatcacggtcagctaattttgcatttttagtagagacagggtttcactatgtgggcaaggctagtctcgaactcctgacctcgtgatccgcctgcctcagcctcccaaagtggcataagccaccgtgcccggccttcaaatctcaccttttcaagggcttcctcttccatgacgtgcattcctagccactgcatttgtctcattctttcttccaactcatgcctactggcctggagaaatgctttaggaatctcctcattcaaaaagccatctctgtcttaaccccacactgctgtggccatcacccatttctttggggtcttagtcagacttacaaagaccctctaggcatacttcctccgcacacctcccattcactgcccaccaccccattctgtcgtgtgtccccaccactggctgactctgcctgcacagagctgagcactaagggttcctttgcaccctcatcttactcagtgtctcagcagcctctggcgatgctaatcttgccctctctgccttgttctcttggcttccaggacgccccgctctcccagcattcttgtcccgcctcactggctgctgctcccctacttccttactaccccctcctctccctaaactgagagtgttaggaaatctcggggctgtagcagcagttgaggaccaggggtggacacagggaacggtagtgggggacctttacatctttgtttattccttggatgaaactttaatgaggaatttgcagtgagacccaattgcacattcaaacaagtacagatgctcctcagcttaccatggggctacgtcccaataaacccatcgtatgctggaagtattgtattgtaagttgaaaatgcatataatacacctgacctaccaagcatcgtagcttagcccagcctgccttaaacgtgctcagaatgcttacattagcctgtacttgggcaaaatcatctaacacaaagcctatttttataataaagtgttgaatgtctcatgtaacttatcaaatactatactgaaagtgaaacacagaatggttgaatgggtacttgaagtatggtttctactaaatgcatatcactttcacaccatcacaaactcgaaaaatagtaagttgagccatcgtaaatcaggggctgtctgtattcttcatttagacttcagaggcctggatctcagccactcagttttaaaatgagcatgtttataaacttggggaaggaaaaaaaaccctgttttaacctaactgggggtggaggcgatggacatgtaaagaaatatacagatagggacaaaggattgagaaacttaccgggtgattccagacctccactaacagagcagtgcatgtccttgaattcaaaagtagcagtgggaccctttgagatggcttttcctgttcctagatgaggagacgatggctctgggcttggaccaaagacgctggctgccatttcttcacctaattcctccctcaactcagcataggatttctatacatgtacacatccttctctccctgtcgtagctgtgtgagaactgcttcctctgagcatactggtgtttcctgagactatataggttttgaggttaaaaaaaaatgttaatccagtctaatgtcgtggctagctcttttacacagctatctgttctgcaggctgaacaccaagatagttcagtttgcttctaagattttaaagttcatagataaaagtattttatattctaatatttctaattcttctctaaagatgatcccagactttaaacagcaaatttcagaattggagaaacagaagcaagatcttgaaatccgcctgaatgaacaagctgagaaaatgaaaggtaactgaaaccctcattaacctgcttttagaaaacggtttcctgtaccccggaaatgacattgaaatgtccttgtactcagggcttttaaactctggttctctagggggctgggcaggtaacaaatgtgagaagggggctagttgaaagatatgggaaggtatgtaggacatttaaaggaggtgcaggctgagtgcagtggcttacacctataatcccagcactttgggaagcggtgatgggtggatcatttaaggccaggagttcgagtttgagaccagtctgggcaatatgatgaaacctcatctctacaaaaaaaatttttttttttttttttgagactgagtttcgcccttgcccaggctagaatgcaatggtgcgatttcggctcactggagcctccgcctcccgggttcaagtgattctcctgccacagcctcctgagtatatcaaattacaggcacccaccaccacacccagctaatttttttttttttgtatttttagtagagatggggtttcgccatgttggccaggttggtcttgagctcctggcctcaggtgatccacctaccttggcttcccgatgttctgggattacagccgtgagctactgaacccagcccaaaaatttttttaaaataagtcaggcttggcagtatgcgcctgtagtcccagctatgtgggagactgaagtggaaggattacttgagcccgggaggtgatggctgaagtgagccgtggttgtgccactgcattccagcctgggtgacagagtgagatcctgtctctgaaaaaacatacaaaaaaataaacaggctgctgcctccaagctccactgattgttgcccagtgggaatgtgggcccagtattgctagagattcctatttttaaagaaaacccaggaatccagatttttatgtggaatatttatgtggaacaatttttaaatgatggtttaaaaatgtttaaacattgttcagaccaaataaaagttaatctctgtctggatacagtttaagacaagcttgttcaagccgcagcctataggccacatgcagcccatgacagctttcagggaggcccaatacaaattcgtaaactttcttaaaacatgagatttttttgcagttttgtttttcagctcatcagctattgttagtgttagtgtattttatatgtggcccaagacaattcttcttccaatatgggccagagaagccaaaagatcggacacccctagtttaggacctctaaaaattgaaaataataccaaacccaaatcagaatgcagtgatatgtgcccccccaaagtactgacagttcttctcattataggaaaactagaagaattgtctaatcagttacatcgcagtcaagaggaggaaggaacacaaagaaagtaagtgtaaatatgtgtgtacctcaagttcatgctcgtgtaatgcttttctgaaactgtagaatataccaagatgtgttactaatgccaaaaagcaagatgctaattaatatatatgacatattgccattctgatgggaaggaaagaaatatgtgtatgtacaacacactcagcagcagcagcatctctgggagattgttaaggaacaaaacattggttgcctccaggcagttggttgccttcaggcttggtgactgatacacagaggaggggaggacacgtacttttcactgtatgcgtacacttttgtacccttgaaatgctataccatgcacttgaattatctgttcaaacaacagataagagtgtgtgagagaggacggtttctattagcagactatttagggtaagaattaaaagcccatgttgatggaaaatcttcattgctaatccccccaaatttccatcacgagaccaataaagggcctcgtgccctggcagagccttgtggggagaatgttctgttttgttgccaacttgttgagacacttatttttccaaaataataaatgggcacttgacatccccaagagcatctttagttatgtgactttatcagtaggatgaggacccaaagtagtggaaaaggagcgaggcaccattttggaactcttctaatggtctctcctcctctcttctgtctgatccctggctttgtgagtgtctggtccccaggctggtcacaaaggggatgactgcttagctgtcacagcgtatggtgggcgtggatgtcccatgggaacagtaagtggggctgaggttgggtggagaatggaactcttattgggggaaggagaccagagcagtccatggacagttttctatcccagccagtcctggtctcttttctttcccctggaaggacacccctattcgaatactatttgctttacacagaaattggccaaggtgttcttccatctttggaaatatcagcacttgctatgacagtgagtgacttctccatgaccgtcatactgataccagccattcctccctccctttctcagggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggtgagaagtcttctaacttggtgataaagactgtctgtgtgcagatgttgctgaaaggggggacatgccacctaaagcatatgattaacatctatagaccaaaagtccttccatcagagcagtctgttttcttatcccaaaagacaggtggtctctgaggttggctttgggaaggccttggggacttacaggcccgcctggggagggtgaaggaggagagacagagaggtgcaggccgtagttccccagcactatcagtgcacggcaccacccaggatggagtcactgtgctctggaacacactgaggatagcaaggcctacgtgtgagtgctttacccagcaaaactcaccccatataagtgcccatgctttcttctgggggtatggccttcctacaatttttagagtcaaaatgttcttctatgaaatgatcatgatgtcgatggaaggcttaaaaactttttaaaagtgtttaaggtcttttctgagttttaaatgcccttaccaaaatgaaatcgggtaaccttacatcaattcccagcaattattttgaaattgtgatgctgtgtggaacccagaagactgagaagtgctgaagtgacaggccactttcctaggagctgggaccctctcgggccccttcgaaacctgagagcttccagcttccaagagggtaacgcaggagggctgacgagtccagtgggtcagtgtggacatgcccacgtacccttctccctgctgacagggcccccatttccaatctcacaggaaaaccttgatagaggaaaaacatattttgagtgtcagggtttaactttgaagagtggttacatccaaaaagagaaattccaggagtttgacatttaataggaagtaacaaattccaatcagtgacacctacatgacagctgccttttctgaggtggatacaactttctcagagactggaatcctcgtgttacaacagagaagcaaccgcctgttgtccatgtgtgaggctgccttgccttgccttgcctcctgtgggcccctgggatctcaatggagtcagcggtcagggagaagctacatgggtgggtcatgtgtgtgctgcgcatgtcatcccatgtgatcctttactctgactgtccctgtgcattgtgacggatttatgagttcgttcctggtgccctggagcacagctcggtcctggcgccctcttctggagctcctccaagtgtctggctctgctccccacaggtgcgctgagctaaggagctggcaggcctgacatgctcatttcaatagctctttctgaacccggagtagcctcactgttacatagaagcagacggacacacaacaagagtatcatctctatacattagccggcggattctacccacaaatgagacctgatctgtattagtttgccagggctgctgtaacaaatgaccacaaaccaggtgctttaaaacaacagaaatgtgttctctcaattatggaggtcagaagtctgaagtcaaggtgtcagcagggcacactcctccgaagtctctaaggaaaacccttccttgcctctcccagcttctagagggctccaggcattccttggtttggaacagtgtaactccagcctctgcctctctgcacctggccttctccctgtctctgtgttcttttccatctgttataaggacacctgcattggatttacagcccaccctaaattgtagtagccacctctcatactgacccttagcttaccacagctgcaaagaccctatttccatataaaggcacattctggagtttgggttggacatgaatttcaaggtgacactgttcaaaccactatgtgatgctttgagtcaaagaaatttcttttttttttccagactcttttgtcactgaattcttattaagagattaaaaaaaaacttttagtaatcatttcactatttatcaaagaaattcaaaatcaaaactaggtactatttttgcctgtcaaattaacagagacctgggcctggcacagtggctcatgcctgtaatcccagcactttaagatgtcatggcagaagtatgacttgaggccaggagttcaaccagccagggcaacgtagtgagaccccatctctacaaggaaaactttaaaaatatatatatagtggtgcatgcctgtagctctggctactcaggaggctgaggcaagaggactgcttgagcccaggagattgaggctgcagtgagctatgatcacactactgcactccagcctggatgacagagcaaaatcctgtctctaaaaatactactactaataataataataattaatagagatcttatgctgctggagagaacatcttgaaatgggcactgtcatacatggttgctgggaatataaattggtataaactttcttgagggcttatttgaaggtatggatcatgaacctttggaaagtacattccctttgactcagtaacacaacttgtaaggttctatcctaagtaaatacttgaacatgtggacgagatttttgttcagagtgatcatcttagtgttattaatcatagagaaaaaaagcaacccaaaggagagaaatgcatacctaacaatagagcaaaggttaaattgttgtatgatataatatgacttggctgttaaaatgatggtttgagtatattatcaatgacatgggaaaacgtctgcagtataactagagaaaaatgtaggatttgaaattttgcatgtaatatgatcccaattttataaaatgtacatttaccatattgggaaaaaaggaatgaaatcaaaatgtgaagagtggtttttttctgggttatgggttgatgggtgacccattttattagatatattataagatgggcttgaattggagggaggaagctgtactgacaccgccacttctaaggtcaatagagttcctaacatgtctagccagggacacagaatggtggcagggagagaggtggccgcacagagtagaaacagcacaatgtccctcggccccaagagtccctagagggcacacagctgcagtgaccctgcatggtgggtctttctgggtcagagaagcctgaattctatatgtgtcaaatgctcagatgtggaagaacttaaacactatgtcctttataggaaatatttctaggtatccaaggactcttctggttcttgagccaaattcagcatgggcaaggccacctacttatcaggaaagaaaggcaaaaccaggcccaaatctctgaacatttctctagctccagcttctgaaatctagaaagcccattttcccacattcatatttttaaattctctatgatgggcactcctatgtaataagagcaagataaatgtagtatatgcatacaataggatattattcagccatacgaatatatgaaatgctgatacatgctacgacatggatgaattttgaaaaccttatgctaagtgaaagaagccagacacacacacaaaaaacctattctatgaatttatttatatgagatgtccagaataggcaaatccatagagacagaaagtagatgagtggttgccaggtgctggaaggtaatgagaaactagagagtgacactaaaggtcagttttatttttggagtaataaaatgttctggaattaaataatgatgattgtagcacaactctgactacactaaaaaacctttgagtttacactttaaatgggtgagttgtacggtatgcaaattgtatgtcaataaagctgttacccaaaaaaaaaaaaaatagattaaagtgcttctaagctaaatcctggtttctttttattgctgtaggatcttgaagaagaattagacatgaaagacagagtgattaaaaagctacaagatcaagtcaagacactaagcaagacaattggaaaaggtaagaaacaatacttgttttcttattcttttgagctaaggctaacatgcgctcaagtgtttattttctttctggtccaaagcttatgaaacccaaaggaatgattctcaagtggtgaggtttgtgacctagtgctgggctaacgaaaggatcctttgggtcaggaagacagctccctcccactcagatgataccagatacattcatgtactcgcaagagacatcctataattaacacattaacctcttcctctgttagctcccttttttaaaaaatgaaattgtgaacaatttttcaatttactgctttgaaattcaccttctctccctgttacatatgtaggatcagtaagtatccaaatttctattagaaaagtagagagctaagaagcagacatcctgaacatggactgcatggcacacataaagcatcctcgtgagcctctgtgaaagggaccctcctcccttcttccctccttctgcttctgtcactgaacttttctgtgttcagctcctgctcacatttctcactctttcattctttattaccttttccccttcctcccagccttactgccaaggctgtatcttgtttctttttctatattcatctctttgaagagcagctttattcttacttatccaactctcacctcaaatttgaaatgtccacaagcaaactgaggatccctttccttcagtaataaatgacaaatggcagtctgccccatgagagcagggcccaggtctgtgcttcccagcccccgctgcatccccactgctgggatgaatgaatgaaccatcattcaccaccctggctcacctttcagacttctgacctccagagctgtatgattaaacatttgtgttgttttaagcctctatgtttgtgataactttacagcagccacaggaaactaatacagctgtctcagtaaggatcatgcacattggtattttgcacaccaaatgtttcacaagtcttctttcacagtagcattggcatcttgaagacaaggcaacatcttggatttctttcctgttaccatgtgctggatacatatcaggcactcataaggctcttcaaaggataattgggccttttcagcagcagctgtactcactgatgtactcataaagaggaatcactacttggagaaattcttcaggatacaatacagtacagttttaatgtatctgaaagccacagacatttacgtgcaaaccagccagaatggggtaggagagtagtcacattgtgagacctgtgaaagctgcttttgtgtatttagctgattgtttgcctctgtctacagccaatgatgtgcactcgtcctcaggacccaaggagtaccttggaatgctgcaatacaagagagaagacgaggccaagctcattcagaacctcattcttggtagtgaaacctggaactctggatttttgctttctctttgagaacttgcatatcagtcagtgccaaagtcctgggcaggggtggtcctttttctactttttcttccactgcttcttcccccagcccagagtttctcaacctcagcactgttgacctgttaactctgtgaatggggagtaacaaaggatggagcagcatccttgacttctactcactagaaggcagcagcaacccctagtgatgacaataaaagatatctccaggtattgccgaatgtcctgtgggggccaaaactgtcctcagttgagaaccactgccctgaccttttccaaattgtaggaccagggtagaagagaaacatcacctcatttttgtgtctcagcacaggagccatcatggaagcaattgtggctctgtgctccatttgacttctgagaaatttctctgcgggcaatgtgatggggcttcccagccatgcctcagttacaggaatgtcccatgtgcatgctcaagagttggtggtcatagaaccaatcttactgcactgtcttcactgtgaccttccacgtggttttctggcatagggagaaaaatctgcctccctgtcagctggccccaagatctcaaaacagaaagccaacgtgtagccttccttcctcttctgcgagtgacccccttggctcatatgagcacctctacccttttctttcccctcatcactggtgtcatgcagtgtgagcctcttctttgttcttctgtcttcctgcagccaggggacatccttgtttgcttatcttaactttttttgtaagatttctctctccccttcatccccactgagcgtttccaccattctgttctcctcaaggccagccaggcatcctctgctgcactgggtgtgcctgctttccctattcaaggcagcttcatgtgactgtggacactgtacgccatcctcatcaaagcgcttggagtaggggtgcatggaatggagtttctttcttacaatgggggtctgaaatccagggtttccacaccagggaaaaataaagattctgtctcttattcaaccttttaagaaagagaaagtcctttgtaaacaagaagaggaacaagtgacacctgtgtatcttgtgccaagaaaggagccagatggaattcctcaaagaggaaataaatccatatacattcaggcactgtgtcaagcacagaaaagcaaacaagcccctgcccctagtcacaagttccttaggagaagagctgacctgtcagctgtaatcctcattggctctctctgcttcagacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggtaggaaatgcctttgacattggcccctggtatcacatctatgggaatgaccagatgcccagtctttgcccatcctgagcctccattgtgtggtgagccacatgattcctcaaacaagtttgaggcccaactagtgaagggagccacactgttagggaaagataaatggatgagcatctgccataggcctcaaagccttaccggcgagactgcaacctggtagccactgccccaccactgctatccccttagggtgtaaagttatcagctgtgaggggtataggttctatctctgtaacaagggtaaatcatgagaaatgaaatggagtgaaaaattattcatctcttcccttggcaattatataattcttcttcctaaaagcacattgtgtatttttattcccagtccacaaatgaagatgaactgtgtattagttaggttagttacttagtaaagttaagctattgtagctatgagacacctgccacctccctttgcccaatatacagtgtcttaaagaagatggaggatttttctttgctgatagcggttccataatgagccatctaggttggaaggtggctctgttccacgtgatcatgaagggacccaggttccttccaacttgctgttggccattccctaagtcggtgtccttattggaatgactggacaagcaggcagccagcagtttaccactgggcaagagggaacctaccataggacacagaccatgtgtgtatggtatacatatcagaagtcaccaactgaactctttatgagcaatcatctcttcatggtgtgacaagtggataatgatcaaaagtgacaatgacaaagggcgggattttgtgaaggctaacagtaacataaagtttattgctaatttcctttccaactgaaacataatcctaaaatcattcttagcatactgattatttttcctggaaactccataagtgatcaatgagtaaataactgtatctaagcattgaagatttttttaagcagacctggatccttgcttacagggatagttgctttgtaaaaagagttctctggtaatgcttggcgcattctggaatcttgggtgtgggtagggtggttgacttagttctaagccagacctggtgctaccctgaatgtggaaattccattagccacagtggagttagtacaaaaaccttctctctctctctttttctaggaaatgaccagtttacagttatgttaaaaagtacccgtttctgggaattacaatgtactgatccatattggaagggggcaataagacataaataacactaaaataacagtgttttccatgcccctccaaaagagaagtgatgtttgatattaggatatatttgaatttttagttagggagaccctacctcatttttagtaaaatatgtgttctaaagagtaatggggaattaaattctattttaaatactctagggaaggccaggtgtggtggctcacacctgtaatcccagcactttgggaggctgaggcaggtagatcgcttgagctcacaagttcaagaccagcctgggcaacatggcaaaaccctgtttctacaaaaaagacaaaaattggccaggtgcggtggtgtgtgcctgtagtcccagctactcaggaagctgaggtgggaagatcacttgagcccggaaggcagaggttgcagtaagccaagatcacaccactgcactccagcctgggtgatagagccagaccttgtctcaaaaataaataaattaattaattaattaataaactctaggaagaaagaaatataaaaactagatttgtgagagatcagagtatggtaattctcctctccttccaaaaatatcatgaattcattatttatctggagttaggaatagaaaattcacatttgtttggtgctggatactttatagtcaccatcttcacaggagccaccacagtgtttttggaaggggctcccataaattgatgttttccctgtccatatttgcataaattgggttttcttaagacaagctggcattgtgttccagcccaggacacacagtatttgcttccccttgatgctctggaatgtttcgccaaatattcataaatcaagagatgtgtggtatgaggactataagacccctttctcaccagcatcttcagtctcaacttctctgtgtccccctccctctgcctttgcatgtgcccaggacctgcctctccccacctccagcacacagcagttacagcaatgtgcccatataccctcttcagccactattcctttccctccaccccggactgccaaagtgcttaaactagtgttctccaccaattctctttgtcactccttgcaatctggcttctaacccatcactctacagagagatcaccagtaactcctcttactaaaaccagtggtgtttctttactttttattctctctaaattgaccaaagcattagcaccatctccttgaaagcttcctcccttgtcttttaaatcccaggattttctctgttttcccctctgatcactgtagctctgccttcactgcttgttcctcttcttcctgccctgtaagtggaggccttctccccaacagtcctagtcctgagctcttgtctctccacccatttccctcaaaggctagacctccttcctctctgaggtttccctggctgctctgcctccccatcctctctcctcgtcctctgagctttggtagcacagtctacagccatcgtatgggctcttgaccacctactaaaactctgttctatcttcccagtgagagtgtgaacttaggagagcaagaagtgaaacttgcatttctcatgcattccttcaggacccacttcacacttcataatgagtgacacaacctgtacagaaacatgttacaaactgtgacctattaaataaatataagttcttataagtataatatgaattggataaaggctttagtgaataaaagaaaaactaattttggtcaaaagctacaaataaccaaacaggtaaatgctcagaggtacaagtaatcatcaagaccaattttgtcttttcttattttcctaaggaacatttagaagactttgaaatgctgtccttttggctttccaacacttgtcattttctcaattgcctgaagcagtacagcggagaagaggtagggggcgcccacctgcttgttgttttgtgctgacagccagtctataacctcctcctgagccagagctcaatagagcctctatcctctccaccaggaggccaacagcacattatctgttggactcttgggcatacaccacaggcaggagacttctggaagcagcttagattttgggcatggtactaggcctcctaggtctccattacttttaaatcaataggtagataagatgacttttaagtttccttctggctgtaagacgtttagcattatgactctaaaatacaggctttggtttaaaatgcctgtttcttcacagctgttctctctacaggaccctgactgttcctccataatctataaatatgtttcctttgccattccgactctgcttccaggaggctgatgtcatgaaagagttctccaccttcaagtactcacagagaaaaatttcattgaactaaaataacaaagtggctttcagggttttcagtgctctccaaaatggctgtaccattgcacagccccaccagcagtgtatgatgtttccagtgtctcataccttcaccaacacttggtattgacagacatttttatcctttaccagtgtcagggtataaaattatatcttgttgacttaaattgcatttatttggtcactagtgaagtcaagcataattttatatgtttattggtcatttgggtttccttttgaattgcctagtcacatccttcctttctttttcttagggttggtttttttgttactgatttgtaggaggtctttatatcatatggatagactgtagcttagcttctaattttccttatgaagtcccttgtcacacagtttttgaattttgatatgcttaaatctgtcaatcctattcttttatgatttgtgtcttaagaaattcttccctgccctgagatcatgaagatcctcttctaaacttttgtagttcatatttagagttcacaattaattatgtttttacctatccaaaattggtatgtaaggtaatgatctaatatcctcttccatatagataaccagttgtcccaatggaaggaagttaaaataaaatataacagcaatctgtctagtactatagaacaaaaggagaagtaaagaaaatccaacctctgactaaaaggaataccaaaacaggaggaggcacagactagtccgtttacaacaaactggcatctgtgagacatcagtggaagaatgttttattcagcactgttttatgatcctttctttgcccccttcagccatgtatagaatattcttttccctgtctgactgctttttcagttaccatatttttatttctaaaatttctcttgttccttttcacctctgtctcttaccacaatgtcctgttcttttttttttttctttttcttttttgagatgggggtctcactctgtcacccaggctggagtacagtggcacgatcttggctcactgcaacctttgcttcccaggttcaagcaattctcctgcctcagcctcctgagtagctgtggctacaggcatgcgccaccatgcccggttaatttttgtatttttaatagagatggggtttcaccatgttggccaggctggtcttgaactcctgacttcaagtgatccgcctgcctcggcctcgcaaagtgctggattacaggcgtaagccaccacgcccagccctataatgttctattcttaattttttctttttctttagtctctttgaacatgttaaacatattccattagttcactcaggctactataacaaaataccgcaggctgggtggcttaaacaagagatttgtttcctcacagttctggaggctaaacatctgagatcagggtgccagcatggtcacttcctggtgagggctctcttcctggcttgctgacagccactttctccatccctgtgtcctcacaggacctttcctgggtgcatgggtcaggaagagggagagagagggcaagctctctctggtgtctcttcttataaggacatcaatcttattattagatcacggccctatcctcatgacctcatttaacctcattacctccctaaaggccccatctccaaatacagccacactagggggttagggcttcaatgtatgatttttaggaagacacataaaatccataacacacactttaaaatatttcaactttgtaccctgtaaattataaggttatgaatctcatttattgtatccacttacctcttcatagcagtttgtttccttgaatgctctgcagttttgtttcattttcctatgcgcttccatgggccttctacgagcttttccatttagtctataggttccagggacaatgtttgtagggaagtgggtgggacaatgacagtgtgatagactgtgatcatacaggaaatcagtgcaatttttttcttatagaaggtacatgctaccccaagcatcatgaactcatttgatataaatcagacattaagttttaaggtaaaagagttatagtagctgattattaatttcctacatgtttgtattattctaatattttatgtttaaaattacttttaggaattcatgaagcataatagtccacagcagaataagaattgcttgaacaattttgacctttcagaatacagacagattctcagtgatgtggctatacgaatatatcatcaatttattatcataatggaaaagaatatccaaccgataataggtaagaagagaatggatgaccaaaaaatatttatagtaacattaagactttttaaaacataaacttggtatgtgtaatgtgtgattatgtgtaacattgtttaaaaagccaaggaaatataatcatgtagatatctgccttttaattctttgcttgcttataatgattccataaataatagtacgctgttggtagttttctttatataaggatgatttatcctgaaggaaaaaacttggggaaacttctactactgctatttatgtggtacttctacttcttggcgtagccaagtatttttgaaatcctaaagccccattcgaattcttgtatactttccttaatttcctgaaatttaaatactttaggctttaatgcccaggccatgatttgtcatgctaagcagctttctttcctgtgaagctgaaaaacgtgctgcttcaaacctacaagaggagctgcagccccgctggaaacagccgtccatccctaaccctgacacacaccctggtgtcccaaacccttgattcttttgctttctctatcataagtacatccactgactcttgtagaaaaatgtcccatctcctgaaacaaaccgaagagcgtcgggaacgttccgcgtgtgtctcctggcgtgtcagcacagcctccctgtctctccgcagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtaaaacccagaaacctccgctcacgcggagaggcctgcagaaaggatgctcttgaagtccgaggccccacgcgcctgaccctccctgctgtggcgtcaaacccctgtttaggccctactgctgtagggatattcgagtcaccctaggagccccgggatgctggcgcccagggcctactcccctcacgccacaccctgccaactagatggactggcctagccgctttaacccagaaccagtagatgttcatcttaaattctggccctctagggtggtcatgcactcaaccagtagtgactaccttctctgaatagcactgccagggggagaacacaggaaacaaggaaaagtcgatatgatccctgcctttgagaagctcagaatagctaaataataatgaaaggcaactatgattaaatcacaaacaagtggtgcaggaaatgtatcagagaggagagacattgcagacggaacagttggggaagccagagagttgtgccttgagtgataaaggaaacggagaagaacgttccaagcaggagaaacggtcagaggcattgcggggagtgagtgaggacctctgctcaggctgcatgtggagtaagcggaggctggtgtggggagcagcaggaccaaggtaaagagctaggttggatccacactgggagggtctggaataccaggctaaggcatttggagttcatcctgaagacttgggaatctagttttgaggtgtgtctactatctcttaattgagacaccatggaccctgagccactatttgaattaacactgatcaagtgattggaaaacacataatataggatatttacgtttcttatagtgtgtgcagaaatttgatacctgtatctgttatgagaacctggggtagtgatgatggtaatgacgtaagggaaggtgacaaagaaagtatctatcattatgctaagtgaaataagccaggcatagaaagacaaacatcagatgttctcacttatttgtgggagctagaaattaaaacaattgaattcataaagatggagagtagaaggatggttaccagaggctgggaagagtagtggggggctgagtagaggtggaaatggttaatgggtacaaaaaaaagagagaaagaatgaataagacctactatttgatagcacaacagggtgactatagtcaataataacttaattgtgtatttttaaataacttagaggccgggcggggtggctcatgcctgtaatcccagcattttgggaggccgaggtgggtggatcacctgaggtcaggagtttgagaccagcctggccaacatggcaaaaccctgtctttactaaaaatacaaaaattagctgggcgttgtggcacatgcctgtaatcccagctactcgggaggccgaggcaggagaatcgcttgaacccgaggcagaggttgcagtgagccaagatcacaccattgcactccaacctgggcgacagagcaagactctgcctcaaaaaaataaataataaaaaagataaaataacttggagtgtaatggattgtttgtaactcaataaatgcttgaggaaatggataccctattctccttgatgtgcttatttcacattgcatgcctgtatcaaaacatttcatgggccaggcacagtggctcacacctgtaatcccaggactttgggaggtcgaggtgggcggatcatttggggtcaggagtttgagaccagcctgagcaacatggtgaaacctctgtctgtactaaaaatacaaaaaaattagccaggcctggtggtgcacacctgtaatctcagctactcatgaggctgagacaagagaatcactagaactggggaggcagacgttgcagtgagccaagatcgcgcctcagcactccagcctgggggacaaagcaaaactccgtctcaaaaaaaaaacaaaaaaaaatttcatgtaccccataaatatatatacctactatgtacccagaaaaattttttaaaaattgagtatcttaagtcaaaaaatacatgtgagaggcatcccttacacctttttagcattagtgaaactttggagttggagtcaatccccatagaccattcccacaaattctcatgacagcagggcatggttttcagatagaaaggggtattcagaaggactagtctttgcagatctttatgtcttcattgagaaatgagttatgtttatttcacaagctccaagcagatcctgtagtcctctgtagtagatttcagccctaaagtaaagccacatcagagcctttgctaaactcagttctcactccctcagtggatcccccaagactgagtagagacatgaatgaaaaggatcatgagggagacacatgactccaggtcttagaacaacttctttgaggacaggcgaacacctgccccccaggtacccagtactttttcccttccaccaggtggaagtggccatccttttctttttcttttttgagatgggggtctcactctgtcacccaggctggagtacagtggcacgatcttggctcactgcaaccttcgcctcccgggttcaaacaattcttctgccgcagcctcctgagtagctgtggctacaggcatgcgccaccatgcccggctaatttttgtatttttaatagagacggggtttcaccatgttggccaggctggtcttgaactcctacaggcatatgccatttttgtagaaacggagtctcactatgttgctcaggctggaatctatgcttccaaatggggacgtttagatcattttaatgtaatataatatttatatttaggattaccattttattaatttctgcttgttgcttctggttttcatttctccattttctttatctgcttcttttgggttatttgaaattttttagtatccctttctaaattatctatttttttttttttttttagtattatccctttgatcttttttctcagttgttgctctagggattccagtacatatacttaacttttcacagtctatttagaatcaatatcttaccacatcaagtggaatgcagaaatcttaccatcatgtaggcccctttagcctccctactttatgttgcagtggtcttatatattagatctacatacatcaaaaactgtaccatacaatattataattttagttttcaaccatcaaacatattttaaagaactcaataagagaagaatagtctattatactcaaccaggtatttaccatttctgttgtttcttcattcctaatgttccaagtctcatttttttccaagtctcattttgatataattttccttctgcctgaagaaagtattttagtattccttttagagcagttttgttggcaataaattattagttttctttcagttgaaaatgtcttcactttacctttattcctaaagggtatgtttgtaggatgtagaattctggattgacagttgttttctttcaccactttaaaaatgttttacttttttctagctactgtggtttcagataagaaatccatagtcatttgaattattccccataaataatgcataatttttcgctgattacttttaagatttttttttctttgtctttagttttccatagtttgtgatgtgtctgggtgtggatttctttggtttagcctgtttggaatttcctgagcttcttgaatctggccattcaccaaatttggtacattttcagccactgttttttcagatattttgtctgcatcatactctttgtcttctctttccagaacttcagtgaaccagctgttaaagactttttgttattgtcccacaggtccataaaattctgctcctttttcttagttcttttcttctgtgctgttcagattggataatctctgttaatcctttcaagttcactgactctcctctgtcatctctattctgctagtaagcccattcagtgagttcttttatttctattattgtatttttcaattctaaaatttccatttggtttttctttatattttctgtttcttttctgagactttatatcttttgattcattacaagagagtttggctttactttttagagcatttttatgataacttctttaaagtcttggtcagataatttgaatatctgtgtcatctcagtgttgacttctattagttgttttgtttaatgtgagttgagatctttctggttcttcatatgccaattttgaattgtatattggatatttttaaatactgtattatgagactctaggtcttcattttttagtttatgtttttattattattattattattatttagttacccaagcttgagtgcagcagcacaatcttggctcactgcaacctctgcctgggttcaagcgattctcgtgcctcagcctcccaagtagctgggattacaagcacccactaccatatctggctaatttttacatttttagtagagacggggtttcaccatgttggccaagctggtctcgaactcctgatctcaagtgatccactcgcctcagcctcccaaagtgctgggattacaggtgtgagccaccatccctggccaagactctaagtctttaaatcatatggagaatgtcaatattttcatcaggcggacaatgcacttgggtcagactgcaagttctgaccaccctctatgctttgtggttctcatgccatttccatgtgtaagggttttgtggtgctctttgggtccgtttcatatgtgtgaaaaatggtggccagcttggaacttgggtaatggtatgtttcatagttcagttcttaaattctgtatatgctgtttagggtcagattcatgcgtgggctcagggataaacccaggagttaataaagaacttaacaaactgcttttcccaactttcccaggctcctccctttctgtggcattcctattactttctgccccctttttggtgcttcagctagaaaactggagctttccttaatttgctctgcagtgtacttactgcagatgtctctatctggggccaaatggtgagggcaaagagagaaccttgaaccacagatcctccaattggaagggaagtttcccttctcttcgagttttaggttccttctggcctccttcgccaccactgctgtcgacatgggattggaacttgagcatgagagaatagagaaaaaggagagggaaaaggtagggcattgagcattaggaggccccttttcagctccttgagctagaatcagagagctcccctggagctctttgttggcattgatgcccacctctgagtttcaacctgtggcgagtagaggccagtgaatagcagaggggaaaagtgatgatctcacttttgacttggaaggacttcaaattctggtcatcttccccaatacacctgctactatttacttttccaagtcctcaaatagctgccgaatgcattccattcaggctttatagctgcattcagtgggacagacaagatggagtgtggttactccatctcactgggaactggaaacccaccacacatctttgagtgggagaattaatgtgctcaaaattcagattttagaaaggactgtggcagtatttgaatagggtgaattagaagggctgagatgggagccccattagaaacctgtaataaaaactaaaagtagggccgggcgtggtggctcacgcctgtaaatcccagcactttgggaggccgaggtgggcggatcacgaggtcaggagatcgagaccatcctggctaacacagtgaaaccctgtctctactaaaaatacaaaaaaattagccaggtttggtggcagtagctgtagtcccagctactcggcaggctgaggcaggagaatggcgtcaaccagggaggcagagcttgcagtgaaccgagatcgtgccactgcactccagcctgggcaacagagcgagactccatctcaaaacaaaaacaaaaacaaaaaactaaaagtaggccaggcgcggtggctcacacctgtaatcccagcactttgggaggctgaggtgggcagatcacaaggtcaggagttcgagaccagcctggccaatatggtgaaaccccatctctactaaaaatacaaaaattagccaggcgtggtggcaggcgcctgtagtcccacctactcgggaggctgaagcaggagaatctcttgaacccaggacatggaggttgcagtgagctgagatcgcaccactactctccagcctgggcaacagagtgagactctgtctcaaacaaacaaaaaaacaaacaaaaagcaacaacaacaacaacaaaaactaagcaaaagtaataagaactcaaactagtgggacaaaagtagcaatgcaaaaatgagggatagtgagaaccaacccaagatatatcatctcacacccactatcctatggaataacattaattcagcatcactgtccaaatgttacagccagaaagaagacccacatggggcattgctaatccttaaggtcacagctgggactgattttctttattttgagaaagtctcactcttgtcgcccaggctgaactacagtggtgcaatctcaggtcactgcaacctccgcctcccgggttcaagtgattctcctgtctcagcctcccgagtagctgggattataggcgtccgccaccatacccagctaatttttttgtatttttagtggagacagggttttgccatgttggccaggctggtcttgaactcctgacctcaagcgatcagcctgcctcggtctcccaaagtgctgggattataggcgtgagccaccatgcctggcccagagctggaactgactttagagatcactttattcaacactcaattttttttagcagtttcattggtatgtaatttatataccatacagtttacctgtttaaagtatatagttcaggccaggcacagtcactcacacctgtaatcccagcgctttgggaggctgaggcaggcagattgcttgaggccaggtgttcaagaccagcctggccaacatggtgaaaccctgtctctactaaaaatacaaaaattagccgggtgtagtggcaggcgcctgtaatcccagctactcaggaggctaaggcaggagaatcgcttgaacctgagaggtggaagttgcagtgagcctcatgagattgggccactgtactcccgcctgggtgatagagggagactccatctcaaaaataaataaatgagtaaataaagtgtatagttcaatcgtttttgatatatttacgtagttgtgcaactatcactgtaatgtaattatagaacattttcatccctccagaacgaaaccttatactcattagcagccagtctcatcccccaccccaactccctaccctgcccagcctaggaaaccattaatatgttttctttctctacagattttgcctattctggacatttaaaaataaatgaaatcataaaatgttatcttttgtggatggcttctttcacttacgtaatgtttgggaggttcatccatgtagcaaatatcagcacctcattcctttttattgctgaataataccccattgcatggataatgccacagtttgttcattcattcatcagttgatggatattttgggttgttttcacttttgggctattatgaataatgctgctgtgaacatttgtgtacagagttttgtttggacatgctttcacttctcttgagtacatgtctaggagtggaattgctgtgtcatatggtaagtctgtattcgattttgagaaaccaccaaactgtcttccacaacagctgtaccattttacgttcccactagcaatgtttgagggttctcaacactctcattgtgcccagagaggtcgattaacttcccaggctcacacagtggattggcaggactaaaacccatgcctcttaactcataaacccatgtggcaattagtgacagaaataagaataaaaactgcagtcgaccgaaagccttcactaattgaaagatttctgccaattcaggaaaaagaaaacagttttttatacttatggaagtcttctcttcagatatcactgtttctttcctttaatcaattttcaaaattgtatttcgtaagtgattgcaatcactgttctttgctcagattttccccaaagtctgtagctgttccggcccctcagcctagaccaccatgagtcttagaactctggattaggagagctgatcatcagtccaactccctcattttgcagatgagtaactgctgagctgtggtcttaaggatctcagcgaactctggtaccctctcgggacacacaggagtatctggcacccttccctaaagtattctctgttcttctgcctttccctccaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcaggtgaccaggcttgcttagtgtctccctggctcttccctgacacatcagtgcagtgggcattgcctttcttggtttagccagctgtgggcaccctgattctgtgtgtactctcgggagcatacctatcacccatggcccacccttttatctaataaatatttattaaatactaacactaggtcttaaaaacatagaaatgggctgggcgaggtggctcacagctgtaatccagcactttgagaggccaaggtgggaggattgcctgagcccaggagtttgagactagtctgggcaacataacaagacgctctaccaaaaaaaaaaaaaaaaaaaaaaaaaaaaaaaagctgggtgtgatggcacacacctttggtcccagctacttgggaggctgaggcgggaggatcgcatgagtccaggggttcgaggctgcagtgagccatgatcatgccactgcaccccagcctgggcaataaagggagaccctatctcaaaaataataataataataatcacacacacacatatacacaaatgtctatgatgcattcattccctgcccattaaactcacaaatgtgtatgtggaggggtggccatgtgggaggtggggaggctagaagggggctcctcttactgttttctgattatctgatttgcctttgctccctaaggcacttttctccccttgttttcttttcttggaaataggtaacatacagttcctgaaccaaattataggctaaaagaaccacctgtgcttcccaatggttcccaataaccagaaccattattttatgaacagagttattattttgcatggtctaacaccatgttatgtaccgtttgcagatcataaagatccttaattcatacacacctatagatgactttgagaagagagtgactccatcctttgttcgcaaagtacaggtgagattcttaaggatgtgccttttaattttacttcctaactatggtataagatgttgatacttaattaacattatagaaatccaggattaaagtacatttacccacatatacaaatgaaaggcacccagctcaaaggtaagcaggaaattttcctgtgaaattttcagaatccaccttagtccaggtgggaggggaatgaaagcaccaaaatcatgtctcccgtgctgtattctgtcaatatatcttatttcttactgatcgttgaatactgtgcaagtgggcagaggctgaatggaaacagagaccatttttcttttataatcatttgtataaccattttttcttatataatccctaaagtttgtcccctaaggaactctagggcagcagttctccaagtttggctcaaggatccctgggagtccttgagacactttcaagagggtctgcaaaactcttcctttttctaaatatgtacctgtggattttctaagtaggtatctgtggattttctcaatagttatctgtggattttcttcgtgtacttcaaccaaaataacatatcacaacagattgaatgcagaagcagatatatatgatatatcgtatatatgataatatagcatatatattaaaatatggcgtatataatatatggttatatatgataatatattaagtcagacatgaaagagatttgcaaaaatagaaaataccacttctcactaaattttctttgttttggaaacttatgtttaacatgtgtagagcttattttaatgaattaataaatcattttaattactaatatggcaaataccgatatacacatatacacaatgtatatttaattactaatatggcaaatgccaatatacccatatacacaaaagcttttggggcctcagtcatgttttagtataaagcggtcctgagaccaaaaaggttgcaaacccatgaatgaagaagaaagatgggttcaataaaaatgtaatacttgaaatctactcatgtttgaccttagaattatgccatgagaatagattagaatagaaaacagatttatggtcaactcatcccatgggaaattaacttctgaagtgaaacaggacaagttaattgttctgagagctgatctggaagccctggatagactttggaattgtgctgttgttaaaaagttctcatgtatgtcatttcatgtgatggtgcaaggagctctccactagagatagctgtgttttgccttgactttcaggtagcagtaaagcagaacatgttagtttccttactcatttttcctctgattctaatttcaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattggaatgtgatttaaggaagaaaacagacttttctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcccggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaacaacctcagattgaaaaagcaacctaaattactttcgctctctaatcagcatttcaatgtatttatttttaaattttctcaaaaagtaactaaaaaattgtgtcggaccctacttttgagaaatctacgtttcccaagttttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgattctataatacagactggtgtcttagaggtaggaataatacatgattatgaagcatcaccctgctaatacataataatgtctttttatattataagtgattgagtttagttcatttcaatacattgtacatgaaaaaatgaaaagtagaactttgtaatactttaatcaataaaattaattaccaa

SEQ ID NO: 38473 - DNA, 23289 bp, Homo sapiens
cgggcgggaagaggtaaaaaaggaactgggagcgcgccgcggcggttcctgtccttacagttgcgctgcccagggaccgatgttgcgcgaggaaaatgcgggacgcccaggtcggtgctcggcccagacttatgcccgtgttttcacagcccacactcgtgcccgaagccccttaccccgccccgggctgtggtctgtgggctgtgggacgagctgcggcgcggtaagtgcgggccgtctgcgtccgctgggccgggcccacgcttcggaaacccgttgtttgtaatggtccggggcgcccgtcagtcaaggccgggcccgggggcgcagctggcggttctcggcctgccttgcgccggggcgggagccggggaaacgcggggcgagcctgggagtactggagaacttctcgccgagagggcacaggcggtttcacagggctctcggttctgagactttcctcttgggtaatgggacctgagatggaagtattttgtagtgtcgtcgctgtagtttattccgataaaatttttaggcaatatgtattgcccttgtctcctaaaatgaatgcgtatcgctgaatacgttgcagacctccacgttccattcaaagcgcctgccttgtggcagtgatgaaaacagacaaaaacccttgccctcaaacgtgctcctgttctagcgggttcagcgcacacttgcattgtattcggttccttacttttaaggctcctgtgccaagctttcatgacttcctttgttaaggcacataaggtcactttcaatcggtgacagccctgggaaatctccagccctggtagtacccgctttccacatccttactcgtcaaccttccagcctccgcccacaatcccaaactcattttgaagcataaaggtgtcataatctgcacataaagcgaaatccaccattggccgaatacatgcatatattttagtgttgatgaatttgtgctgattcattcctgttataatgtttccttcttgggtaatttgcaaaacatatataccagcattcttttaaatggccatgattgcatccacccagcatcttttacttgactgattagaggaaaactcttgttagggcgcactgaggatttcatgacaaacaccagtatttacattctgggaggatacgttaacacatgctgttagaacataatgtccgggattgtggaatttataaaagttctctttaagtgataatataattttttaaatggtccccaccatgaagagtgtatagtcttgttgggtaggtaaaacttaactcgcatttcagttctaaaacacaaagttcagaattttattaaatattcaaaactgatgagtttatgtaggggcttaggatacttggattatagagatttaatccgccagttagtatttgcaacatttaattgagtttgtcatttaaaacctgagacatgtcactgacactaatatgcacaaatagcggtacggtaatgatgatgctgtgctttctttcaaattaggatttatgttgcagtcatcattttcttgataaggaatgatgagtgggaatcacaagtaagcagccctatataagaacctcttccggccgggcacggtggctcacgcctgtaatcccagcactttgggaggccgaggcgggcggaccacaaggtcaggagatcgagaccatcctggctaacattgtgaaaccccgtctctactaaaaagacaaaaaaaaaaattagccgggtgtggttgcaggagcctgtagtcccagctactcaggaggccgaggcaggagaatggcgtgaacccggaaggctgatcttgcagtgagccgagatcgcgccactgcactccagcctgggcgacagagcgagaccctgtctcaaaaacaaaaacaaaaacaaaaaaaaaaacctcttcctcccagtttcattgtccagactggaccccgactggtgtaaattattcatcccctctagatgccattgtgggatggttgctatttttccccccatttgatttcttctttacgtctttttaatttttaggtttgctctttaaataacaggaaagtcttttttctccatccttttattctctgtttgaaattaagacttttcaacccaataattttatacctgtgttcattcaagaacttaacaatacattcattgactccagtcttgtgtaattggtacaatggtgtaatggtgtagtgatcactttggactcagtgaatttagacccaatattacttagatgggggatttactttagatgggctaatataattgagaatgtacactatccagctgcattattgtttaaaatagtatttataactactatttcctgagttccccactgtgtgctaaacgttgtgctggcagtttaatactttttagagttctttgagcaagttgttagttatctttgttttgtgaacgaatgaactagcactaagagaagctaaggaacatatccaaggtcacatagcaaaatggggttccagattctctttctgtcttttccttactttaggttatggaggatccataaaaatctcctctgattacttcttctaatttcagtcatatacggtataaatttttcctccctaattttcggagtatcttctcaaaaattccaggattaccttgaactcatcctcaatgaattaaaatgtagacttacctttattgtttagatgaagataatggaactgtggagtagatttaaatattcgttagtgcttttaagtctcagctattgtcagaatgacacacgtaaggtccaaaaggatgacactcctgcctcgctttttattaaaaaaaaattggaatatatgaggctgactgaaaattaatctgtaaatcaaatatgcctagaccttcgtggtaggtgataaaattttcccactttattttcttttgttcagttcctggcagtacagatctagaatgcagattagtgtggtcagccaagtttatcattcatacaatgctaatcagctttcttaaaaatgttttttcctgattataaaattaatggggattaagctgtatgtaattttatatgtgttctttttcccaacaaaatgtgaatgtatttctttgtcattaaataattcttaaaaatggtttctttaaagatttcatagcttttcatttcatggtggtagtgctatgtatttaactttttttcccattttgaacattttgtttttttcaaaatataaaaactcagtggtaaactctctgccacataaatctttgtctttatttattttgttacttattgatgcataaaagatgtacatagttttggggtatatgtgataatttaatatattcacttaatttgtaaagatcaaatcacagtaccggggatattatctccttaaatatatggcttttctttgtccttatttatgattatgtccttaattctggaaagtaaaagaagtggataatatggtatgaacataccttttttttttttttgagactgagtttcgttcttgttgcctatgctggagtgcagtggcgcaatctcggctcactgcaacctctgcttcctgggttcaaacgattctcctgcctcagcctcccgagtagctgggattacaggcatgtgctaccaagctcggctaatttttttgtatttttagtagagatggggtttctccatgttggtcaggctggtctggatctcctgacctcaggtgatccacccgccttggcctaccaaagtgctgggattaccagttttgaacatctttttttcttttcttttgagacaaagtttcgttcttgttgcccaggctgtagtgcaatggcacaatctcggctcactgcaacctctgcctccttggttcaaacgattcttctgtctcagcctccctagtagctgggattacaggcatgcgccaccaggctcagctaatttttttgtatttttagtagagacgggcttctccatgttggtcaggctggtcttgaactcctgacctcaggtgatccacctgcctcagcctcccaaagtgctggaattacagctgtgagccaccgcacccagcccgaacatatcttactgtataatttaaaagacagttttccaaatttattattattttcttggacagtggagttctttaggatcaggagctgttctttgcacatgggaatttgtgctgcccttgctaacctctgcctctgagctgcttctacctgcttgtgactatggttacccaatttcctaagcaaagaagggatgaaaaccttaggaattatctgaaggactagatgccattaatataatttaccaaattattaaaggtctcaattattaatatccagtctaaactttataatatagatcttacataatatttttccatttgattaaacattttaataagcttctctttctaatctgtaggaaaaataacctattacacatcatctttttattataattaagacatgcagttgtaggaattatatctgtatcctagatcaatcctactttctactttgttgttaagtgatgaaatctgtgtaacagatgtatgttagcagttattttatttcccctaaagttcttgactttttggtaaaatatttgagaatagttgtattggaatgcttgtacagtgttaagtatctcttatcacatttgcttgtgttttacaggtgtcttggttatcttttgggtgtttagtcaatggaatttttttctttgcccagttatgataacattactgtaaattcatagtatgtcagcttcagaagttgagagtggttcttagagttattaattaggactgacacatttaatggaacagtttagttgttggggttcactgagcagtgtttttcagaattcatcccaactcttggctgaaaggagttttgccacttgcggtgttcagtagcacatacggccgggcgcggtggctcacgcctgtaatcccagcactttgggaggccgaggcgggtggatcacgaggtcaggagatcaagaccatcctggctaacacggggaaaccccgtctctactaaaaatacaaaaaaattagccgggcatggtggcaggagcctgtagtcccagctacttgggaggctgaggcaggagaatggcaggaacccggcaggctgagtttgcagtgaggcgagattgcaccaccgcactccagcctgggcgacagagcaagactccaaaaaaaacccaccaaaacaatagcatataccaggaagagcaagtttggaattaaaaaaaaattaaaaaataaactgatacataagccttagaatatcagtttgtaatattcaaaaaatgtaaaaattattttatgtgctatgttagtagggttatagcaaaaggaaaagtagtacttaaccgcagcactatgtcgaagctatcacaaagataaatatagtaggtgtaggtgatatttttaagtttttctttcatttgattttgtaaatgaaacaatttagaatgcattagatgggcttgttatttacgtgagatctgagaattctgttcattatagtagcagcaaaccactcttatagaatggccgtttatatgtggattttatacataagtgggttttatagatgaattgagggactggttttacttcctctttccacttaagttgacagaaaaaggtaaaagaatggagattagcagaatttatgttctagttctgggtctgctgttgggtatgatatgtatgccttaatcttcatgcctcagtttcatcattgtcaaaaatagatgagaatactctttctatcaaaaaattactgttttgaggtttagataacattgtagatgtagaagtacattttttattgatatctttaaaaaaattttaagtcttacaaaataggttttaatttattttcagcaaagtcttcacttctctgtttatacatctgtacctgctgggaaatataggattaatatctctgaaattcattcttgtttattttctgtccagccttgaccttttcagttcataaccaatcagtcttcttttcttactgattcatttcttttgaagtttcaaagtcaactgaaagtacactttgtcctcatttcagtttacttaatctaatgtctgtcatcacatttttacaacacctttgaaaattatactaggtccatttgccagcactgtgttatttaaattttactggaggaaataggaaccttattgaattggtgcaactaagagccatggctgggttccttccctcccctcccctccccttcccttcgctttccgatggagtctcactctgtcacccatgctggagtgcagtgggaaacccttggctcactgcaacctctgcctcctggattcaagcgattttctgcctcagcctcctgagtagctggaattacaagcacgtgccaccacgcccagctaatttttgtatgtttagtagagatggggtttcaccatgttgactcacactcctgacctcagatgatccacccgcctcggcctcccaaagtgctagggttacaggcgtgagccaccgcgtccggcctgccttcttattgtttctatttttatcacttttctgctccttttgtgccttcttttagattgttttctttatattttcctcagctagtttgaaagttagttgttacatttctattcttttggtgtttaccttcagttttttaattggagtataatttaccttcagtaaaattcatattttttggagtatagttctgagttttgataaacagataacagtcatgtaaccaccaaccaccaccatcgtcatgttatagaacaattccatcaccccaaaaattttcttttgccccttgtagtcaacctctttccacatttctggcctttggcaaccactgaactgttttctgtttgtatagtgttgcatttttccagaatgtcatataaatggaattattcctttacttaccatactgaatttgacattcatgcatattattccttgtgtccataatttatttttattattaaatagtattccattgtatggatattatcacagtttgtttatccgttcaccaaatgaaggacatgtgggtgggttttttttttgagacagagtctcagtctgtcactcaggctggagtgcagtagtgcaaacacggctcactgcagcctcaacctcctgggctcaagtgatcctcctacctctgcctcctgggtagctaggactacaggcatgtgccaccacactcagttttttaattttttgtaacagatagagagatagagatattgcccaggctggttttgaactcctggcctcaagtgaccctcccacctcagtttccccaagtgctgggattacaggtgtgtgccaccacacctggccacatacaggattttaatggatgtcaaaattatttactctcttgagtaaataccttgcagttgcattgctgggttgtatggtaagtatatgttttgatttctaagaaaatgctaaactgttttccttttgttttgttttgaaacagggtcttgctctatcgcccaagctggagagcagaggcatgatcacatctcactgcagccttgtcctcctaggctcaggtgatcctcctccctcaggcttctgagtagctgggactacaggcatgcaccacaatgtctggctaatttttgcatttttggtagagacagagttttgctgtgttgctcaggcaggtattgaactctcaggctcgagcaatctgccctcctcagcctctcaaagtgctgggattacaggcatgagccactgcaccttgcccaactgttttcctttgtagaaacctgccaaattcttttccacggtggctgtgccattttgcattctcactagcaatgagaattctagtacttggtattgtcagttattttttattttacatgtgtagtgatatcacctttgattttaattttgcatttccctgatgtctaataatattgaactgttttcctgtgtttatttgccatctgcatattttctttggtgaagtttccatatcgtttttcttttagccttctgtttgtttttttgttgagacagggtcttgctctgttacccaggctgaatgcagtggtgtgaccttggctcactgctgccttgacctcccaggctcaagtgatcctcccatctcaacctcctgagtagttgagaccacaggcacatgccaccatgcccacctaattttgtttatatttttgtagagacaagatctcagtatgttgtccaggctggtctttatttcctgggctcaagtgatcctcctgccttggtctcccaaagtgccaggcttataggtgtgagccactatgcctggactgaagtatcctttcaaatctctttcttattttgtggattaaatacttaaatgtaagacctgaaactgtgaaactactaggcaaaaacattgtggaaatgcttcaggacattgttctgggcaaagatttttttgaggtaaaaacttaaaagcacaggcaataaaagcaaaaatagatggtattatattaagctaaaaagcttctgtacagcaaaggaaataaccaacagagtaaagagacaacttattgaatcagagaaaacatttgcaaaatatccatctgacgagggattaataacaagaatatataaggagctgaaacaatggcaaaaagccaaataatctgatttttaaaatgggcaaatgatctgaatagacatttcacaaaagaagatgtacaggtggccaacaggtacatgaaaaaatattcgacatcgtgaatcagggaaatgcaaatcaaaaccacaatgagatatcgtctcaccccagttaaaatggctatcaaaaagacaaaaaaaaaaataaaataaaataaaaaagattcttgtgaggataaagagaaaggggaatggtaggacagttttattgggaatataaattagtgtagcctctgtaaaaaacagtatggaggttcctcaaaaaaatcaaaatagatctgccatatgatccagcaatttcaccacaaagtataaactaaaagaaaggaaatcaatgtattgaagagagatctgcattccagcgtttattacagtactatttacagtttccaagatacggaaaaacctgaatccatcagcagacgaatggataaagaaaatgtatatatacacggaatattattcagccataaaaaagaatgatatcctgtcatttccagcaacatggatgtaactggagaacattatgttcagtgaaataagccaagcacggacatgttgcatgttctcactcttgggatttaaaaaaagttgatctcgggaaggtagagagtagaacaatggttaccagaggctgggaagggtaggggggcaaagggtaggaagacagattggtcaatgggtgtaaaaatacagttagaggccgggcgcagtggctcatgcctgtaatcccagcatgggaggctgaggtgggcggatcacgaggtcaggagttcgagaccagcctggccaacatagtgaaaccctgtctctactaaaaatacaaaaattagccatgcgtggtggtacgtgactagtcccagctacttgggaggctgaggcaggagaatcgcttgaagtcaggaggcggaggttgccgtgagtcgagatagcgccgctgcactccagcctgggcgacagagctagaatgctgtcttaaaaaaaaaaaaaaacaattggaataagttctagtgtttgatagcactgcattgtggctatagttaacaataatttattatttcaaaatagaagagaaggtttggaatgttctctacagaaagaaatgataaatgtgtgaagtgatagatatcctaattaccctgatttgatcattacacactgtatgtatgtatcggaatatcatgtgtactccatatatatgtaggttattatgtatcaataaaaagtattttgctcattttaatatttgttttctttctttctttctttttatttatttatttatttttttgagacggagttttgctcttgttgcccaggctggagtgcaatggtacgatcttggctcaccacaacccccgcctcctgggttcaagaaattatcttgcctcagcctccagagtagctgggattacaggcgtgtcccaccatgcccaactgattttgtatttttagtagagacggggtttctccacgttggtcaggctggtctcgaactcccgacctcaggtgatccacccgcctcagcctcccaaagtgttgggaatataggcctgagctactgcgcctggacgatatttgttttcttactgaattttaaaaattctttggatattcaggatatttctcttgtcaattagatgtttcttttagactaatatgcatgtgtgtgtgtcttgtctttttatattcctaacagtgtctttcatagaacagacgttttaaatttctttcttttatgcatcatggatcatgcttttgatgtcatttttctttttttttttttaactaatattttttagagacaggttctcactttgtgtccagggtagggtgcagtggcacaaacatggctgactacagcctcaacctcctgggctcaaggaatccttccattttagcctcccaagttgctgggactacaaatgtatgccaccataccccagtttgttttaaaaattttttgtagaaatggggtcttgctatgttgcccaggttgctcctgaacttttgtcctcaggtgatgctcccaccttggcctcccaaagtgctaggattataggcatgagccaccacgtccagcctggtgtcatttttctaggaaaacttttaggaaaccaaggtcacaaagattttttctgcaaacttttcttatacatattttgtagttttagtttttacacttggctctgtgatccattttgaggtaatttttatttgttgaattacttctacaactttgtggaaaatcaattgatcatatatatgtgtgtctatttgtagactgtcctttcttcctattttccagtatgttaatccttttgtcagcatctcactgttgattattgtagttttatatgaagtgtcgatgttatatagtgtgaatcctccaactttgtttttctttttcaaaattgtcttggcaattctagttcctttgccgttccatataaattttagaatcagtttgttattttttataaaaagattgctggggatttgaatggaattgcattgaatctatagatgaatttggggagaactaaaaccttaaccaggtaaactcttctaatccatgaacacatccatatctctccatttgcttaggttgtttttaatttctttaatctgtaatttatagttttcagcatagtgtttgccttttaggtgctattataaaatacactgttttgtccgttgcttgtgcagttggcaaccttatttgaaggtttaaagacacctcatttaatatatatcattgaatcattaacattgaacttacacagccaacagtgctgtaactcatgcctgaataagcttatctaaaatacatattttctccacaagacagatcacagctttcttgtgcttaggtacactaggtagcacttgagcactgtgccagggatccattttaaacatcaaaactactggaaaaaaaaaaaagcataaaaacatggcactaagtagagcactaaaaggagacttgtttattgtatgagacctgaaccaaaaaggcacaatatcactttgacctcagctgggaatgtgcatgttgggtgactcaggtttttcactgctctgcacatgttcatgaatgaccacgagagtgcagtaaatattgattttgggattacaaataaattttagtgagtaggcaaataaggaatctgtgaatgaagatcaattatataaaagtaaaattgacttttgtgctatatattggccttatatcttgctaactcaggtgatagagcttttttgtagattctttagcattttcttcatcaatattcatgtcattggcaaataggggtacttttattattccttttttctctcttccatctttttctctttttaaaattgtagtgaaaagcacatcaaataaatttacctactggtctgattgcagtgatgtttacaactaattgatcacaaccaattatagatttctttattccttctccatttccagtgctttacttgagtagcctaaaaaaaaaaaattacactcttaacaaattttgaatacaatttatggcattgttacttatgtgcatattgttgtgcaacagttatctataactttttcatcttgcattactgaaactacccatttctccctccccacaacacttgacaaacaccattctactttccatttctgtgtgcttgattatattaggtacctcatgtaagtggaatcatgcagtatttgtccttttgtgattggcttattttacttagcataatgtcctcaaggttaatttatgttgtggcatatgataggatttacttcttttataatactgaacattccatggtatgtatatgttatgttttgtgtatccttctatcagtggacatttcgattgtttctgtatcgttaatgtgagcaatgctgcaacaaacgtggattgtgagatatctcttcaagatcctgttttcagttcatttggatatacacctagaagtgggataatgtggtagttctagttttaattttttgaggacgctctatactgttttccatagtagcttcaccattttataataatattaacagtgcacaggggtttcaattttcccacatcctctccaatacttgttattttctggttttttgatattggcacttctaacaggtatgaggatgagatctcattgtggttttgatttgtatttcttttatgattagtgatgttgagcatcttttcatatgcttattgaccattgtatatctttttattattattattattattttttaagatagggtcttgctttgtcgcccagactggagtgcagtcgcacacttacggcttgctgcagccttgacttcaagcagtcctctcacctcagcctcatgagtagctgggactacaggcgtgcgccaccatgcccggctaattttttttttttttttttgtagagatggggtttcgccatgttgttcaggctggtcttgaactcttgggctcaagtgatccacctgcctccgcctcccaaagtgctgggattacaagtgtgagccactgttatcagctcattgtatatctttggagaaatgtctattcaagctctttgcccattttcaaattggattattttttgttgttaattatcaagttgagaagttctttacatattctgggtaataacaccttatctgatatgtggtttgcaaatattttctcccattccataaattgtctttttactctgttgattgtgtcctttggtgcacagaagtttttcagtttgatgtagtcccatttgtctatttttgcttttgttacctgtacttttggtgtcatatccaagaaatcatagcccatttcaatgtcatgaagctttttccctatgtttacttctaggaattttatagtttcaggtgctacctttagacctgtaatccattttgagttaatttttgtatatggtgtgagataacgtccatctttaatcttttacatgggcatgtccagttttctcaacaccatttgctgaagagagtatcgtttttccattgtggagtcttggcaccattgtcaaagattgaccagatacttcctgggatcaagtgatcctcccacctcagcctcccaagtagctgggaccaccagaaggtgacatcacacctggctgatttttgtatgttttgtagagatggggttttgtcatgttgcccaagctggtcttgaactcctgagctcaagcgttctgcccatctcggcctcccaagtgttgtgattacagacatgaaccaccacgtctagctcccacatttttgttatcttatattttacatccagcttgttaggtcttctgatacttttctttatccttaatgttttgtattttgccatgttactgtgtataagtgtagattaaaaaaatactgattagcagtagagagttttttcaacctagaaaataatatcttggaaaaatttcaaccattatttatttatttattttgagatgaagtctcactgtatcacccaggctggagtgcagtggcgagatctcggctcaccacaacctccgcctcccagattcaagccattctcctgcctaagcctcccgagtagctgggattacaggtgcgtgcaaccatgcccagctgatttttgtatttcgagtagagatggggtttcaccattgttggccagggtggtcttgaactcctgacctcatgatccacctgccttggcctcccaaaatgctggcattacaggcatgagccactgccccggcctcaaccattactttttaaaaaacatttccttcacctcttctattttttctttctgaaattgcaattatttcactgttggaactatgttccctacttcttagttcttttttcctcattgtgtaatatcttttttttttttttttaattgagacaagagtctcactctgttgcgcaggctagagtgcaatagcacgatctcagatcactgcaacctccgcctcccgggttcaagcaattcttctgtctcagcctcccaagtagctgggactacaggcacatgccaccacgcccggctaatttttgtatttttggtagagacggggtttcaccatattggtcaggctgttcttgaactcctgacctcaggtgatccacccacctcggcctcccagagtgctgggattacaggcgtgagccactgcgcccagcaggtaatatcttaatctttctttataccgtgttctaggtaatttctaatgcataagttatctcctcatttgttgttagctggatgtttatcccatctattgattttaattttagagaccattttctgtttccaagatttgcagtagattctttttataaatgcccgtgatcatttaattatcttctattcttcttttaggatgttagtcccacttaagtatatttagtatgctcaaagagataaaaaaaaaattaagatgtttcatttaaaaaactgtcttcaggtgtaaattctatttgctctgtctgctgattggtagtaattttcctaaagtgtattataattttggcttgcaggctcacgttggattgttttttcctgtgtgtgttttaccctttttgtgtggctttagagtttactccacctgtccctctggctgacatagctctaggtcagctgtttcattaggaatttgggtttttacttagtgaatagcccagttctggaccacactacgtgtgttatatgtgttatgcaggcccagtgtctattctcagggtaactctgttcccgccacatgtaggtgttgggtggaactttttttggcccagttccagcaaggagtctgtttctggtcttctgtcccatccatggcatgctggatttctggagctttgtatctttagctacactgtttttagctaagtgcccttttcctgggggctgcacggctttagtgcccacttaaccactcttaagtttgccatctgttcctgacccacgaagatcttactcttgttattgagtgtagctaaatatttaaatttttgtctagtttcttgtatatccatctagaggtactttatgtttattaagtaataatgtgcttattttcctttgttttgtatacaaaagttagcatactatatatcctattagattagttcgttcttgttctgctgtaaagaaatacctgagactgggtaatttataaagaaaagaggtttaaattggcttatggttctgcaggctgtacaggagcaggctggggaggcctcaggaaacttaaaatcatggtgaaagtgaaggcaaagcaggtgcatcttatgtggccagagcagggggagggcagagagggagaaggtgccacacactttttttttttaatcaggcatttataaacaaagcatacattaattacataaaaatagtttttgaataacagagtaaacatcatattgtcattagcaacaacataggacatggggcgggatgcagggctctgggtggttttaaagatagaggtggattcccccccccttttttttttggcagggctctgggtggttttaaaggtagaggtaagtccaacaccccccccttttttttttttttttttttgagatagggtttcgctcttgttgcccaggctggagtgcaatggcgcaacctcagctcaccacaacctctgcctcccaagttcaggcaattctcctgcctcagcctcctgagtagctgggattacaggcatgcgccaccacacccagctaattttgtatttttagtagagatggggtttctccatgttggtcaggctggtctcgaactctcgacctcaggtgatccttccaccttggcctcccaaagtgctgggattacaggtacgagctactgtgcctggccctttttttcccttaattgaaaaaaaaaaagaaagaaattatttgttactcctgacttaaagcaagaacaaatgcctccctggaccctggtgggctgtgtaacagggcgggtcagagaggagtgaggagggctccgcacccactgggaggagggtgtcacatggaaaactggcataggggcttcttctcctcgtctgtgccacacacatttttaaacaaccagatctcaggagcacttactatcatgagagcagcactgagggggaaatccatcaccatgattcagtcacctcctaccaggtcttacctccaacactggggatttgggtggggccacagacccaaaccatatcacctatactttgcttttcttaataagatagggagtatttttttttttttctgagagacagggtcttgctctgtcgcccaggtggagtacagtggtgcagtcatagctcatggtagcttcgacctctgggctcaagcagtcctcccacctcagtctccctagtagctgggactacgggcatgcaccaccatgctcaggctaattaaaaaaaaaaatttaaagatgggatcttgctttgttgcccaggctggtcttgaactcctgggctcaagtgatcctcccaccttggcctcccagaatgctgggtttacaggcgtgagctaccatgcccagccaagataggaagtatttccatttggtaaatcagagagctggcgtggagatttggtttctttgttaaagagacctgctcatttgacctgcatagtttatcttcatcacaacaagtaaagactttttgtacttttgaatttttacattgttttttacatatagtttaaaaaatgtttatactctcattttctttaatataaagattaatcagttctataattatgaccttaacttccccatgtcctttaaattctaatcatccattaaattaaattaataatgtacccactgtttataggttcctgagaactatatgcttctatgtcttcttttatgggacatttaaaaatttttaatggtagcaagcacttacatacatttactatgtgctaggacagaagtacagaacaaaagaggagaaattgtttagaggcagtgataaggaatccatgtcactgagaaatatgaaaagatgttcaactgctagcattagaatcaataataaactgaagttttagttccttccatttctcagacatgtgctgcatttctttcagctgtttttggggatgcaatgtaaaatagttttgttatagcagtagcttaaggtgagctgtattagcattttcagggtttaaacccctaaaatctcaggtaggtatatattattttcttgagaacctacaaaaaagtctcatttcagtaatttcagagcagtgtagaacttatccaatgtaggaattggtcattcagtctaaaataatggctgggcgcgattgctcacacctgtaatcccaggactttgggaggctgaggtgggcagatcacttgaggtcaggaatttgagaccagcctggccaacatggcgaaaccctgtctctactaaaaatacaaaaagtagccaggtgtggtggcacacacctgtagtcccagctactggggatgctgaggcaggagaatcgattgaacctgggaggcagaggttgcagtgagccgagattgcgccactgcagtccaccctgggcgacagagcaagactctgtctcaaaaaagtaaaataaaatagaataaaatagaatagaataaaataaaataaaaaaaaataaaataacaataagtatagtttttgagtggctgctttttgccagttgctgtagtaggcactgtaagtctaataatagtatacatttactgagttctcgctgtgtgccaggtgctgcttttttcatattaatctaatcttcataacaagcctgaggaaaatcctgttattcttgttttacaaatcagataaggataagtaggatatcatgaagttgagtaacttgtttagagtcagaggttataagtaagagtttatgatatagtctagcaccagagatgtactcttaacatcaaatactatacctcctatcttctttaattttcacagtaagcctatgaggtaagtatatagaaaaggaaacaggcttagagagaatgtgtaactttctcatggtctcttgtttctgatccccatgaaccataccatcaaactcttgcacttaagaaaatagtcctgtctttctacaacttcatcttataactcttactgctttttgtcttatctcccagggccatttctgagcagtggaggtttcaagtaatccactaacaaccagttccaaattctgtcatcaaatcctgtgctgctgttcctcgtggtaagttttcttatggacatagtaaaactttaatatattctacttcataaatatcttcatctgtagaaggaacaaagtatacttttgtgaacacatgattgattgggctttactgttttgctactgctttatcatactgagaaaatcagaagttaaatatttatatatttgcctggccagacttttgaaaatatttagcccaacaaataagatgctttacatctatcagctcagagtctgctgttatttgttataattttatctttagaccacatattcaagtactaaatggacagacacagtggtatgttttaatagagttaaattagaactattgcacatacataaagaacattagtgaacattgtttcttaactaaattttaaatgattagaatgtgattattagatcaattataatatattatacagtagtctccctttctccgtggttttgctttctgtggtttcagttatctgcagtcaaccaaggtctgaaaatatttagcagaaaattccagaaataattcataagttttaaatttagtgctgttccgaatagtgtgatgaaatcataccctggacttggatcatccctttgtccagcatatctatgctgtttatgctacccaccctttagtcacttagtagctggttggtcatcggatttaaaaaaataatatatattaagtttgataatatttagagtttcagacatccactgggggtattggagcatattccccatagataagggaggctaatgtaactactgtttactgaatatcctttataggtctgacattatgctttacaaatataattcatgtgatcctgttaacaatcctataagatagatggtagtgttgacattttatagatgaaaaaactggttacagaagttgagaattttatattaggtcacatatcttgtaacttgacagagccagctttcaaacctaggtatagctgtctcaaaccttttgattttctcattttaccatctgattatgtgtagtgtttcaatttcgaccatgtaagatgctgaagagtgaaaaatctaaagggtgtgcctgtctgtgcattgtagagaattacagaagctgtattcaaatatactgaattatctaaatttttttgttttttgttttcaggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagctaactgatggaatcgtacaaatacagggaatggaatatcagcctattccaattcttcatagtgatcttcctccaggtacaaaaattttgatttatggaaatatatctttccgtcttggtgttctcttattgaaaccagaaaacgtgaaagtgttaggaggtgaagtagatgctcttttagaagaatatgcccaagaaaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaataaagaaaagaacttagagacagataataaaataaaacaaaccagcagttcagatagccattccttaaataataaaatattaaatagagaggtggtcaactatgtacagaaaaggaattcacaaatttctaatgaaaatgattgtaatttacagagttgttctttaagatcatcagagaatagcattaatctttctattgccatggatttgtattctccaccctttgtctatttgtctgttctaatggccagcaaaccaaaggaagttacaacagtgaaagtgaaagcatttattgtaaccttaactggaaatctctcaagttctggtggtatttggagtataactgcaaaggtgtctgatggtactgcatatctagatgtagactttgtggatgaaatacttactagcttgatagggttctcagtaccagaaatgaaacagtcaaaaaaggatcctcttcaataccaaaagttcctggaagggttgcagaaatgtcaaagagatctaatagatttgtgctgtctaatgactatttcatttaatccttccttgtctaaagcaatggtactggcattacaagatgttaatatggaacaccttgagaatctaaagaagcggttaaataaataattaaactaaaatagtattaggaacaattaaaaacaacaaggaaatatttagaatttgttcacaattttacttatgatactttgtgtaaaaaggaaaaatgaaatttcatagcttatttcagtttaattttaaagtgtttaatcatgtttgttatatgtggagcttttgaaaataagttaatctttttttttttttttttaatgtcagggtattgctctgttgcccaggctagagtgcagtggcatgatcataggttattgcatcaacctcttgagctcaagcgatcctcctgccttagcctcttgagttgctgggactataggcatgtaccaccatgcccagctaatttataattactattattgttttgtagggacagagttttgctatgttgcccagattggtctcaaactcctggcctctcactcctgccgtcatggcctccaaagtttactttttttaaaagtaactgttagatggaggaatatggtgacccactattgttgagaaatttgttttccacttgtcacgtcacataagatgattgctaaaatattgtactggtgttcggtggtgagtcatatttttgaaagttaataattataaataggtaatttccttctaatatgttggtactgtctatggccataccaccctgaacatgcctgagcttgtcataatatgttgagtacccaaaagatttgtttatattgttaatcttagggaaaaaaaattaaaatccagtagatcagaacatcaggctttcagatacaaattgatttactggtttttattttgctgattataatatttggtatatttaaggtaatctagttaactagatgctatttcatagattatattgaatgatttaaaactttattttcaaggatagtttattttaaatggcatattgaaaacatcattattaagatccagtaggtaggacatttattggattaaaatgaagcatttatctatgtctttaggtgtcattgttccctttctgaattagctgtacatataagccttcctttggttttaagtactgatttttttttaaaaaaaagagggactgtttaccattcttccactgtgctgttataaagttgtatttgaaaggtaatgttgtttttattaatcttttgtcttaaaataatttaaagtgctttgaattttaaaacattaaacaaatccttaaataac

SEQ ID NO: 38474 - DNA, 267615 bp, Homo sapiens
gacaaggatttggtgcatgaatttgtagtggctgaaggtctgacatgtttgatcaaggtgggagctgaggctgatcagaactatcagaactacatcttaaggggtaagtcatgactgggcatgcagcagctgccccagctgcaggggggatctgggttcaccttcaggaacttaactactgagagctttttaaaagacttcgatttgagagtaaggtggtaaagacaccctttggcaaaaaaacatctgccataggtaaaacaggttttaccagttcctagtaattagcaactgtgctaatttttactgactttcacctggagttattttacacgcttactaggaaaactgtaccactcactgggttctttataatctgtcttatttgtccaggaaggagacatactaaatgggcttgggtaaagcctgcatctcagcagaaagccaccccaaaccaaagggggcaatttatttcttggaaaaaaacattttctcccaatttgagttatcacctggggcttttgtcaaagtgcatatttttcaccttgtcttcctgtttctgattcgatagttttgagcgggtccgggatttgccttttaaagagcgattctgatttcatttataaagcgatgcaaatgtagagtttgaagcactgattcctgttccagtttatagttaatggtgtttttatagtcataggtttttttgtgcaccttcatataaatttcatttgatcctgtaaaaaaaaaaaaaacaaataacaaacctgtgcataggcagggcaggaatgattaggttgaaccgtatgaaattgctgctatcaacagttttgacctacaaaagaagaaattttatatcgtccaatattatctacattttccagttgaagaaaattgagactcaaagaagtcattaaataataaagtcaattcccatagtgtgccaggcagcagctgtgcccaggcactgaggcatgtcaggcgggtcagggttctgccatcccctctgtatctatgcctgtgaccccacagactgcatgttcagcgcttgtaggagaaaataaaactaccaaaaccttcctttcttttcttcttgggtgaaggaagaatgaaaatcatacatgaaaagtatgatttaatatcagatgtctgtgtttggagttgaatgagacaagcaaactgacacagtcatctcagctgttttgttttgccccgagaatgcttccttatgttctgtggcgttttccagccaatcagagccttcatccctctttcccctcttctgtagagccactgcaattaaaagcaacagagagaacgtagggctcattaaaaaaaaattaaggttgtcttttcaagtcagtgttgttttgttcattttgataaacggcaaatgtgtgtgagagttcctgagcctctcactttgctgacccatggtgtgtgcagcagtgtttgtggggctgcggagttggctctttttgtctactttcagtctttttctggtcttgtaatagatcctccattacaagttgtcaggagagatgctttattgctgaattttgctatttctattcttttttttttttgagatggagtcttgctctgtcacccaggctggagtgcagtggcgcgatctcggctcactgcaagctccgcctcccggattcacgccattctcctgcctcagcctcccgagtagctgggactacaggcacccgccaccatgcccagctaatttttttgtatttttagtagagacggggtttcaccttgttagccaggatggtctcgttctcctgacctcatgatccgccggcctcggcctccccaagtggtgggattacaggtgtgagccactgcacccggcctctattcttaataatataaacatttatatcaaagctgttgtgccatgttgcatctaatcgcagccgtctgtgtgtctaaagagatgagtgcaggcctggattctcactcttgtgtgtctgttcactttggtctaacacctagacaggaggaaggtgcagagataagggtgggagagcttcctctagtttattttccgggtataatatggatgcccatatgttgaaccacaggtaatcacctaattctgaatagtgggtccacactgacaatatattttttgttcatgtttaaagtgtacatcattttaacattaccaaaaaataagttatccccaacacacagagacacacctctagagagctaatattataaccatcttctgtttatcctcattcttctgacccttacctaggagcacatttgtgtatttctattgcatcagcgcaatagtttacctccaagcccaggcgaggggcacaactctgcccgctgtggtcagaactcacccattccctagacctcacgtggattagaactggattacatgaccccctgtagctgcacgggaggctggcagagtgagtgccttcctagactccacaggggaggcaacagagagaaaggcttgggcttgaggttatgagtcccagctgcatagagggagttcggaaagaaaactcagcacagctgagaaagccttttctggtgagccacagtgaggcccctcccaccagcggcctgcaggcttttgagggaatccttgtgcatgggcaggttaaacacaggtcctggtggtgaggggtatgaattgtacttgctggcaatgggagatgatgttgatacagggaacttcatccacatcctctaccttagtgaatatttaccatgaagcttacagccgtttattttatttatttatttattttgagacagagtctcgctctgtcacccaggctggagtacagtggtgccatctgggctcactgcaagctccgccacccaggttcacgccattatcctgcctcagcctcccaagtagctgggactacaggcgcctgccaccacacctgcctaatttttttgtatttttagtagagatggggtttcaccatgttagccaggatgatcttgatctcctgacctcgtgatcacccgcctctgcctcccaaagtggtgggattacaggcgtgagccactgcgcccggccacagccatttattttgcagtgttctgacctgaatcagaaaggtgccagaggcaattcccgaatgtttaagtctcagaacactcatgaccaggggagagcccgtcaaccacctgctgcttctgttttctagcttttctgcctgcccttctatgacatgccaagaaggtgaggccctagctgcagataggtcttccaaaatgtgaggagaccctatatttccattgccaccaccaaagccttgccttcatattttcctttctaatagtgtccctttactggcgaccagaaggctccccatgcattatctgaaagacgagcactccactcaggctactgcaagacatccttctttccacagaacagaggtgcctttgcatgcctatgtctcagaagacttggtcaccagggcactgtgcccaattgtcaccacattttgatgtaaccaaccaaagctcataccaggaaagtaacttctgagggatggaaatgacacatttcttgggacgtgacatttgcgttttcctgcagggaagctatgattttccttagttcatacatggagtcactcctttgtgactttgaacaatttctcacgtaggcttttttttaaggttctgataactgctggcagccactggacatttgcgatcaagaacaacctttgaattacctctttatttgtccacccatgttttaactgtgctgtcttcggtggggactggtgagggcagatgcagatcaagagaagaggctgggaaaagttttgcagttattttattcacagttccctgaggagaagacacagcacccatgcagggccactcaggaagcacagaggtcggccatgaggtggggggagaggcagactgtgggcaaacacctgcattgtggcttccaagggacaggcaagccagctgaggattggccccgaagctcagagtggctctggagtggcgagggcctgtgtatagtagcccaaggtgtgagagccccgtgtgggagaaggttggggtgtagacttaatgggctgctggagaagacgaactggctggtcgctagccagggcctcaaaactgggttaagctggacacagtggcacatgcctgtcatctccgctacttggaggctgaggccggaggatcacttgagcctaggaatttgaggttacagtgagctatatttgcaccactgcactccagcctgattaacagagcaagaccctgtttttaaaaaagctgtgtcaagatagcattttaaaaaatgatattgcaaaccgtaagttgggttaattgtcctagtgtcttgagaagtgtgccctcatgaagccacctgaggagctctgctctgtgtggctacatgggagtcctacagccccaggggaaacaaaagcatgtggagaatccaggactttcccagatctgcttttagaactctttatttgtctttatttgcatacacagccccctctcagcattttttttttttaaggcccaggaatccgctgctttcctttgaggatgtgtctgctgagaggtagagataggtttagttacagtgtaggcaagtgctgtccaaagctgtgagcaggctgctgggaagaagtcttaactgtacaacgtggaggaataatatttatctgacttattattcctgggtggttgtagctaatgatctaaagtttttttgggatagccagtatttaatttaagtgtactgtgaaattttgtacctcacaattattcttatagaaggaggacctagagtggtatattgctgggaacttaaactttctgcacacattactgagccttctctatgggccatgcaccatgtcaggccctggggttgtgacgatggaaccaagattcacactgtcttgaagcaggtccctgtggggtcccctgcatggcatgttttatatgctgaattgcatgtgtcttgtatgtttggaaattgcacatatgtactgtgctttggaggagaaaagagagagagagataaatagaaacagtaagaccagctaccctttctggctgtaactcaagagaaactgcctcttcgggctagctttacatggagaaatttaatttggtcatttcatctaaaccaaaataccaattaatcataaaacgcctcagtcggtatcagttattttaaaagctggataagatcttaaaacgcatttaactcaaccttttcattttagaagaaaactgcagatatattttgtttgccctcatatattgttaaatgttttaatggttgtcagcatttaaaaattgggagatttgatatttttttaaaaatgcagatttcaggcttctttggaaaaactgtcccagagttgactatagtccactataggaaaaaatcctcaaatgccattcatattaggggatcccttaatgagaatcaggatgtatggtcagatggtgtttgttggcattgatggtaccagaaatggaaatatcatagatatcatggaaagagattttatgatgttagaaggcagtggcacaaaatgatcaagtggtaattaaactaacatcctccttgtcagaaaaactgaagtttatattttggcactttataaaatgccaaaaagagcagaggttgggtttagactacagggaaggcaccaaactagccccaaggtgaggaaatgggagcaaaggggaagaatttcttgcttcctgaactaaggttaggtctttggctactgtattttccacggaacaacctagcctgactctctgcaacctcatgacactggtcctgtgtcccatgcagctggcttggaggaagctctttcctgcctcttgccagaagggttttctgctttgggtctggacttcagagattatcatggtagctgtacagctaggctttgatgtggatgacccaggagtcttggaggtgtcttcagctccaggtgggttgaggccagtgttaagaatggagtccttcctcatttgatgtctctcctcttgctgagtggtacaacaggactatttccaataaaaaatcactgcagcgtaagcagactggcagcctgtggggctgaatggaacctgcaggtgttttgtgtgccctatctaacaggtttaaagattgtgaattatgaacatttaaaaacttggagatttggcataaaaatacagctttctggcttttcttgaagtactgaaaacttaagccgacccaggccctgtgggatgtggactggggagggctggagaaagtggcccttgaagcagaaagatgcaatcaccacgtggtgtttgctttttcttcctcctgtagttgaaacctctgctttaggtgtcttggggccctggctgggtctgacctccatctggcctctctttcacgtctccttggcatgctgttagggatgtggcctccagggtgaaccagccacactgcccaggagtatggtcaggggcagggaagctgcagcctgtaactccctgggaggggaagggaggccaaatcaccctgttgctgttgatatgtcatgacacatgcttccctggagtgttctgcatgtcccgtctgtggctcctcttgccacccactgtcactgtgcatcaggcctgcaccctcttaagaaactgggccagagagtagctgagacctgcacttgtgtcctcctctttccagcctgtacgggtgcagaggaccccaaatggacttaaattggacagttcatagctctcccctggcctgccaggccacaggatactgtgtccttgtcttgcttttctgcctgactttctgcagtgctgcatttctcacaggagggagctgggtgctggccccactgttcctcctgggttagctgccgtctctctggtgtttctggatggatctgccaaggtcagtggggtgtggttggcctacccctagtctcagggctcggggactctcttgtccatgtctcattggtcatttgggtagatttggaggagggtggtttggaggctcctcgctgtgcttcttctgcaagtgctgaatgatctgagtcatcattgctgtggtctgtggcctgatggctgtcagcccccagcactgtgtgcaggagcaccatgggtcaagtgggcaaggagctcctgccaggggaagcaaggcaaggccagggccagatcctgacctttggtgggacaaagtgtcctttgtacaccctctgttctgaggtaagagagggaagctgggctactccatgggtggggcaagcagcatccacgaccctgagccctttacctcattgggcagcaagtgcgatatttgccatcagcttctaactctacctaagcactttggctctaaggttgattttggttttccctcttactctcttccaaggtattttttcctgtgattagtgaatgcttgtctctgggtaactttagtttatgaagagtaaggcttttctttcattttttttttttttttttaaagagatgtagttttagtctatcaccctggctggaatgcactgttgcaatcatagctcactgcagcctcagactcctgggtcatgtgatactcctgcctcagcctctctagtagctggaaccataggcatgtaccaccatggctggctaatattttttattttttgtaaagacgaggtcttactatgtttcccaggctggtctcaaactcctggtctcaagaggttctcctgccttggcttcccaaagtgctaggcttacaagcatgagccaccacgcccagcctctttcaagttgtaatttttcttaagtataagttaattatgaatattgttgaatatagcaagcattcagttgtaacagaaatacttcatgtagagcatctttctaaagaaagactaggtagccctggcaaacattatctccagctggagcatcattaggctgaaccatgtgaggttgctggtatttgaccactttttacctacagaaagggcaaaattgtatggtttaacttaatattagtgtcctaatttcatcttaatctgactccttcttaggttgattagatgcttcttaaagttcatcctgcattcaatctggaatcacatttttccagaaattcaggccactttgcaaaccaaaaaaagccctggcaatgtcctgcaatcatgcctccgagtgcttcagcttaaagagccattgttgtctcagtcttggccagagagatttctccagaattttagtttctactggaagtctctttctccttccttttatctgagatgagaaggaagaaagaaaaagttatttggccattcctacacagagagtgtggaattttccacgaccaaatctcacttctgtgttcatcaggaatttttccactttattcataccaaagatgtgcctcctcactctgtccttctctccttgctcagtagacttttccagaggagctgctggctaggtgtgccttgaagcacaatcgttatttccttggctctaattttatctcacacatggtcttcttttacaaggtttctatttgtgaatccagctttatgatagaagaaaatgtcaacagcaagatttaaacctagccccaagcatggattaaaactttttttgtgggtggggtggtggagctaagactttctgaggaaatatcagttggtgtgttcatagatttctgcattttggaggcttgagggctcttggtagattgggccagcctcttggcagggtaccacgccttttctaaccctgtgatttcccctgccattaatgtgcccaagacctccagccctggctactctccaatgcctcaggcctgtggagccagctgtgccctggtatctccatctccattgcaccagtatctccatctccattgcaccatgcccaaacccaaaacccatgtttttataccccagtcagttcctccacagctctgttcatcatcccaacaaagcgtaatcattcatcacattcaattcagccaccctagggtcctcctaacccctttctctcattcattctttgtaatcatcacccaccaaattagggcttctctaaaccttgactccctttcaagtccttccatctctgtctatacccagtttttgagttcagatcatcatttgttccttcctaacctgctctaccagctgcctcatgggtctctctgcttttagtcctgcctccctttggcccattttgccctctgttgcatggatggaccatgcaccatgatctgttctccttagtccttggttcagcttctttagtggctcctctcatcctcagggtgaaatcccaggccttctgtgtgggtagagcccactttggtcctgccctcgtgtgtcggtgcagtccactgcagccactccctgccatcccagggagggtgatgttctgtcctgcagaccttggcatctgcctacaaggcctcgctcacccatcttcatctggttcacacattatcttttgcttcctgctcatccttagattggagttcagatattgtaatctccaggagatcttccctggttcccgagtattttggccctctatgcataccctggtcttgactcactgataataaatatttgtgaacatacactatggaccaggaacccaaggctaattccctgcaccatattagccttcgtgcatgtcaggttccatccttgttctgtgagatccttgagagccaggcatgttttaagagctcagtgaaaatgagctgacagaaggaatagaagaatgatagactatctgcagagaaagagaagtcactacttgtgagaaagctgctgatttgtactagtaattggagagccggaatttgcttatttgaagctttagtccacctgctcttgtttctgaagcagtatagcacaaggtgatttggttttggtacttttcaaaaaatgccgatgtactaaactttctttttgataattttactagttcagtaggtggatatatatctactagggtgtatatcttgattttaaataagacatgatttatacagataaaatacatgcaaatatggattatactgtacagcctgttttgtatgtggaggaattatttacctgcctctgaaatagatggactgtggatttcttggagatgggagtagtatcatcacaacctttgcagctgcaccagcctgctcctgagtgcctcataaatattcaacaaatagttgaggaagacaattgaatgaatgcctgggagaggagtccccagagccatgccatggctgtgttgatcttgttgagtgttttatgggtgattccgggtaagcacaaagtttataccaagaaatgtgtgtgcatgatcaggagatgtgaaatgagaagacagcaattatatgacacatgttcaagtgtgatgtggagggcttttacttgatttgattttcagtatcctcactatttcaacctcattatcttgtcgtctttgctttctttaccctgcctcttctatccctagctgcttaaaactggacctttccaaaaccactcacatgggagtttggcctgacttgtttctggagccagttcccacaggcagctagtactccctagccccccaaccacactggagtcgtgtctgccatcagtgctgtctgggccccagcgttccttgaaacaactgctggggctgatgttcctagaattacagccctcttttctccttccaggtaacgttggccttgagctgggcttgagtctgcaaggcttaagtgagggaagaggttaaatgtcattggataaataaggggttgcttttagaggaggggcaaaattgttgcccttaaagtcagattaaaagcaacgagcaggagttaaaagacagtggtttttgactgaagacaaactccaagaacagagttggaaaattagtttatttctcttgccaacataaattgatcagtggtgcctttctggagcagtctgctgaggattctgaggccacatccagcatcagcaggaaagagcgccacagctgattagggaagtctgtcagtagcttcagagctgaagagttagggcaggaatactagacatgatttggttcttctggaaaatactaggcactttcagcatgtttcttgagttgatttcaaacaggtgtgtggcagtaaggtttccaacaacagaatatatcactttgcactggaaatgctgtagcagaggccagatgatctgttggggctgctaggcttggggtcaggtggtactggatgacctcttagatcccttccagctctaagattctgtgattctaagtaaaatataaaaagcagaagggatgaaagcagagctgtttaactttccctcttctgcatgctccatattaattgctgtaggattcccaggctgttaccaagcacatgttgtcttctttcagcttcaaagaaggctatctggttacatgacatagaccccagccaagtcattgaaaacaatggtgaactatctttagtcattaagaggcttgtattcggctggacatggtggcttacacctgtaatcccagcactttgggaggccgatggctggcagatcacttgaggtcaggagtttgagaccagcctggccaacatggtgaaaccccatttctactaaaaatacaaaaattagcagggtgaggtagtgcatgcctataatcccagtttctcaggaggctgaggcaggagaatcgcttgaattcaggaagcggaggttgcagtgaaccgagactgtgccactgcactctagcctgggtgacagagtgaggctctacctcaaaaaaaaaaaaaaaaagaaaagaaaagttgatgcgggtgactagcattcatgtgatctacggaattttgaaggattggcagggctagtgttagtttatattcaggaattcatatgtacatggtgaggccaggggcgtaggagacaatggtgagcttactgcttctccagagcctgaggactggaagccaggagggctcacagaaacaccagggagttggactcattgatcaaaccaaagcagggctggcaaggcagactggtacccgtgaggagagtgcgcacaggcagcccacccttgctttgctgattcactggcttccctcatatctacccacattcccaacatggtccacacagtttccatccatgtgtgcatcctgctggtccacgcctgtctttctatctgtcttttcccagctcttccagatcttaatctggaggattgaataaacatcgatctttccccaaatctagatttcgttgctttttgtcagtttgtaggccctgatttttctatggttgggggcttctaaataaagatcagctgactggttcattcagtcatcaccaagtgctacctcattgctttatgtgagtcagtcactttggggtctgagtaaagggtagcagagaacaatgcaaacgaaacaattagaaattgtgccatcaagccaagaataaagtgctaacaggagggaatttataatatagtaggggaagtgacataaatcctgtgataggcagaattctaaggtggcccagaagattctttcccccagtttagaccctgtataatcccctccccttgagtttaggccagacctgtgagtataacggatgtgtaaatattatggaaccatgattaggttacattgcaaaggtgaaagggttttgcagatgtaattaaggtcccaaatctttggattttggaatcagtcagaggggagattattctaggtaggatgggcctaaatagatgaatccctgaaaagaaagtctagaagtcaaagacttctgctgaccttgaagaagcaagttgccatgagttctacagctgcaaggaaatgaattctgccaacaaccacatgagcttggaagaggaccccaagcctcagatcagaccacaactgacaccttgattgcagcctggtgagacacccccagcagaagacccagtcgggccatgcctggatttctgcaccatggaaactgtgagatgataaatgtatgttgttttaagctgccaagcaatttgttatacagagttagaaaatgaatatagttacatacaaagaatcacaacacgaagccatctggacttgctaaatttggtacagaatactctgacctcagaggtcttttgtaggggaatcagggaagatatcatgagggcagcaaccttttactgtctttctgggcttcttaggcaactacatgccatccattcaagctgaattccccttgatcccctgcctcttcttgcatgatcttctcacacggtctgtgcagacctctcatgtgggtctcccaactgttgacaatgtccaggaccactgcaataaaggactctcttccacacacaaaagagtgactaatggagaaggcaatttataagaaaatttggtgtttcctaatatgccagcatcatgagagaacatggtagctttatcaagattgggctgagttttaggaaaagatgatcacttgggtgatcttgggatgatctcacctatgaagacaagcatgggcactgggccacccttgctcttcttcagagatgctcttatctcagtgttctttgcatctcctgtttactcattgattaatccaggagatgatttgcagatgactgcagtgggagatccaagggctcggccaaggcccctcgtcgtaaggaacttggcagtggcttagcataggagccatctaagtaaaagtggatagacacaaaaacactgtatttgttaggcatggaatgaaaatcctgaaatcattctttttttcccccctcaattttgtttgcatcagcattatgtttctaaagatggttgataaattttaagtagttcaatcctgtatcatttatttcaaagatagttattctttgcttagtcactcaagatgtttgctttttcataattcagcttttttttttcttttgagactgaatcttgctctgttgccccaactggagtgcagtggcacaatctttgctcactgcaacctccgcctcctgcgttccagcgattctcctgcctcagcctcaccaccatgtctggctaatttttatatttattttattagaaatggagtttcaccatgttggccaggctggtctcaaactcctgacctcaggtaatccacctgcctcagcctcccgaagtgctgagattacagatgtgagccaccatgcctggcccataattcagctttctaaaaaatagaatcagcttaatatatagtgtttcatgggaatttcataaaacatgaaatgtgatacttgaatcaaatactcattcttgtgtaagcaaacagcagcacaaaagtatctaggcattatcaggcttgaaaataaaggagatatgtaacgtggtgactttgtttctgaaatcatgtggattacagattccctctatatcagtcgaagtcctcacgtgaaaggtgcttggaaccaagaatagctgaaccttttgtaaattacagttgagatgttaaccttctagatgtatgaagaagaacagtcagttttcccaccttcttggacaagcagatattccctggaagctgcatctggaggctgtggaccggggaacactggccggctggctgttcttctgattcctggtggaggggccctgggaggctcatccatcaggagcccctctgactaccttctctggagctgtgcctggtcaactcgtgggcaatgctgttgtagtactgctctttaaagccgagggagagaagcacatcatcatctgaatcatctggtctaaatttgattttctgactaatcatgcaatgagaagaagcataatttctcttaagaagggatttaattaaaaagcaccctaagtgctttgtgagtgctctccaatctgccgtatcatgagagatagtagcagtgcatcctgtcatctagctgaatgggctcctcgaataacaaaactgattcttctctcttcactttttgtctttgcggttgtatgaccgggcagcaagacactgcagggagaaacggttttgtatcgtttcttctccatgtgggtgacagcaggtgtggtgggcacatagggccactgttatctgacagcttctgggtctgagaccctggggtgcaatggcttctcctgaaagttgccatgctgagcacctttgagctgcagcatgtaggctggccatggggaggttcgtgaacctggcacatggcaatggaattgacaagatataccaccagtgtggtagaataccctctattctggatctatatttgggtggatttatatttgagtgacatggaatatctatatttgagtgacatggaattgtctgaatttgccatgcacttgatctctgtgtatgttgagccctccaccatctcagctcactgcaggactttaccctttgtcctaccctttccatgactcatctcctgggcagtccttcgtaaataccctctctgcatgtgaccttccctcacagagtatccataaccatttgccccttgcccttccccctgactaggtggtgttctccctgaggaccacacacttacttgcacctggatcctctgtttcctgcacaagcaggcacctcttacagtgcctggtgcatggcaggcccttcaataaaggaatcagctggggatggttgtcctgaaggtgtagggggagaacaaacctgtagcactaggataagacagagaagtcttagaatcaaaagctagaaggaaagccccacaagataagatcttgagcatagccagaggctgtctgtgcatgtgtggatgattagatggaactttgacattcttagcttgtcccatcaaggctgccatactgtaaaacgggacctgaaatagttggcctggctctgggcatttggaatagtttgctgggagcagtgctgatcagagagccctgtgtttctcagaaataaagcctgtctttctatggctcaccttctttttcctatgtaaagggcaccatgctgagagatccgaagggcaatttcatgatgtccttgtccctcgcttcaaggtgacaacctggatacatctgagctggtgtcctgtgtctccttatggctttcccttttggcatcagataatgtagtaagttcacccctgtggccctctggatactgggcaatttcatctgcttaaggtttacacaacgccagcgccacacgcacagcaaaatgccactggctttgttaattaatcttcttatggcattaaaagaagaacatggttgttagatcatgccttgaagattttgagtgctgaacgacgttcgttgtacagctctgcccttttagaaaacgggaccactgcacaccacctcacctgttctcacacgggcttctgtgctgatagtccgtgccacatcactgtccatctcatttctcgcacactcactgccctgggggtgggttggcattagctggacagaatgtcacacaacacaggtagctgctcatgctcttgggagaggattctgaccccaagcagatatcactatcatttgctacaaagagggtttctggagggcagatggcagcattttcccttggagttgtataaatagatgtagctgttggtgatgcatgtactggttgtggatattgcctctgcagatgtagctaaacgccatcttgtttaacttgaatatgcttttgatggggcattcttgtggtggttcaggaaatatggcagcgttcagggacagatgggtgtaattgcaaattccttatcagactgatagggtttgatggtgattttgtctgatgctcttcgtttagctgctgctcgtgttatacagcaaggcagtggccaagtctctttccagtttctaggttaagatttgggaacagtctccttgagtaacttcatatttccacagaagagaggcttcattgaataagtgcatcttgctgtctgattttttctttaatatgaaaacctaaatgggcatagggttctagggatttttttttatatatatgttttacagatgtaaaaaggttaaggtgggctgggcacggtggctcacgcctgtaatcctagcactttgggaggctgaggcgggtggatcacttgaggtcaggagtttgagaccagcctggccaacatggtgaaaccctgtctctactaaaaatggtggtgagcgcctgtaatcccagctactcgggaggctgaggcaagagaatcgcttgaacccaggaggcagaggttgcagtgagctgagatcgcgccactgcactccagcctgggtgaaagagtgagactctgtctcaaaaaataaaaataaaaattaaaaaggttaaggtggtctgaaccttgaaaaggccacttaatttggagtagaatcccatcgttcagcatcgaaagtcagatctctgacaaggttccctgccgggcttggtagcgacaggctctgtgagggttccaggaacactgctcaatgttgaaaaccttgcttgagagggaccagccttccaaggtagggggtttggtcatggggggtgggaacacatgaatcaggcttatgaacatgggatacatttacattcgaggtggaagactatgtatactctcatctgttaatgacttcccttatcagtcgtgtttgtaatgaaaatcattttgaaacatatcagacttagaaaacggtataaagagtaataaagtgaatccttgtgcacccaccactcagcttaaaataagaagcatgaccagtacgtgatttggcctttcctgaccactgcttaaacaattaatagcaccttctccccacctggcttctccttgcctgatgcttctctgtagggctcaacatagtctgtcaggctatgtgtgttacttaatggtggtttcttttctctctacccccactagggcaggggcatcatctattaaattgagtgtccctgctgcctagaacaacaccttggcacagaggacttgtgtttgtgagtgattgttgagagaatgagtgagtgtaatgatgtgagatccatccatgctggtatcatggctctcgcctgtccattttcactgctgggtagtattccgttgtatggatgtactgcaattatttattagttctctggttggtccacatttaggtaatatccaggttttttgagttgcagacaatgccagcatgcacattcttgttgtatttccttgtgcatccatgtgattttctctaggatttacctaggggtagaattgctggtcaaggggttattcataatgttctcataacatactgtgtattttccagcccgggttagaactgctacttctgaacacaggagtcttgcattcatcctgggttgcttcttagtagctggggcttttgttcttagtcttgttctccctgaggcccctgcggtgagtgactgtgtgactgagatgactggagactttgggctgggaaaagacttttccttggcctatttccactggtccccaagggtcttgcctctgtgaccatggttgaattagttcagtgtccaatggctggcctggctggacacaggatgttagagccagaaggtgccttagaggcctcctactctaacctcattttgcacatagggaaattgaggtctagagggctctggtgacttgctggtggttttgtggctggacagtgatcgagctgtagatgtaacccagccagagtgctttctgcatcatgaacagaaggaagacccatctgtgaaggatgcaagcagtcactgtctccatctgtgcatcactgggcctgccacatgaccatggcccagtgcctgcaacccacccctgctccctcccgagggatgctcttctttcccctttgataaccttggctttgcagtttgtccctttgctttttctttcaactgtgccccttatttcagccctcacagtcacagccattcctgtccaaaacactctagtggttgagacccttccccgatcctgagctgcccctccatgttctgcctgctggccccatcttgcctcccttcctaaatcacagaaaagctcaactgggctcatctggagggacagaatgcctctgggatgcatttgcagtacctaagattacatggactcactgatttcaaaggagtctgtttgatacgaacaaacattgctttaatgccatatggatacagcagaagtcacaggaacagcttatagactgaataagtctgaaaaactgtctccaaagtggaactctctgggactggctcttcctccagctcctgtcccacgtcttccgctgtctacagcctgcggtcctctcggaggcaggatgcttgacaccagagcagtttgcccacaggcaggctggctcctgcctgggctattcctgtgcgtgtcacagtctccccaactctctcctgccctgcccagcccagcacctctgcattccctttatccttttgccgagtcttgtactttcttttgaaatatctttcatttccatttctttccctctgctctcctgcctgccctcagcctcactgctggcctgcttctgttctctgcacagctgcctctggagaaaatctccctgcggcgtggctttcatgcagccattggaggaaaaccctaagttcctcccaggcctcaagttgtacctcttaatgtttattctccataaccgtaatttggaacatcagcaaggctctgtgatttctagacttggagtacaccaagaaagtatggagtatctctttctcagtgagtgttcggggaacacagggcagtgattgccacaatccagtctttagtcttggtctgtgtgtttaggaaactccaggacccatacgctcctcttccctggccacttccctcaagtctcaccctccctggaagagagaaggaagaaaagggacatccatagtggcttctgtggcacctgggggacaggggaccagtggaggtgtctttgggctgtcatgcccataggaagagctgctgtggctactggtacttgtgctcagcctggcagagggagcttctggtttccttccccatcagaaatatttctgagtctcctgtctactctactcttggcaggagaatggaaaccgaagctcttccaagaaccctcatgagtcatctcagatccttcccaaccctctttgtgtgaagaatcagtagttaccacgtgttgttccacaaatcctgggttccctcggagacccaccgggtcccacccacacctggaagcagagaaatcaccctctaacctcaaccgcagaacatccagttttacctgtttgagattttgagattgcatggagagttcttttggaaaaggttccattaaaacgtttaaaggcaagaaaccattgttagaggagatgaaatagtgtctcgttgtgtcattcaaggcccttcctaacgtggtctctaccatgtccatgtttgattgacttgctgtccccagcgtgatgccccattgggtggcctgcctgcctgggcttcccacagtgggaggggctttgtaaggatccaggtgaagctgagccacttggccctctgcacaatattatgcttcctcgaggccacagacatggtgggtctactggagcttcaacacatgaaggaccttagaacttgaactgggctgtttatagaagataggcagccagatgttagtgcttggaactcaaaattctcagaggcacagtttcctcatctgcaaaccaggcatgatgaaagtatcctcctgatagtttggtgtagtgttaaatagatgagcatgtgcgacgcatttggatgcatcgcggcttgtagtgagggctgtggcagtgtctgccctactactaacacagctagaagggacagggctgggacagagaaggttgtgctggccaggtcctagaggccttcctctgctatgtcctgagcgtgtgctcttcaaggggcatgctgctgaagcagcccttctccaaaagtgcttgtcctcaaagtggatggtgagttgtggtgctgtaggtggcatggaatggactcagaggggccggctgctgttatatgcccagctgctcttgaaaaggtctgagggcctttttaatggtctcccgatgagcttcgtaaggatcaatgactttgataactgggcaggtgggtggaactgcggaatctggaggccttctgggaagacgacttatgtcttagttattggggaaaccatggcacagcctgccctgacctccaagacctgctgacacatcaggaggtaagaaaacctgatgaaagaggctccccgaggtatgtttgtaattgtttgaggacaggagtagggaaggagaaaatggaatagtggaatatgatgtctaaaatgcctttgtgtttttgagaaatatcttccccattagagttaagaatcagagtgtgccaggattgcagggcagtgtgaaggccatctggactaacttcccatccatggctccttctctcccacacaagtggacctcctgcctccaatgataagaagctcaccgcccttagagtggtgatgacccatcctgtttgtggacacttctgacccacaaaagtccttccttcccagagtccacatcatcctaacttcctcttcttggccctgaatgtgggacgtgcagccaactctaattcctattgcagtgaaagcccttcaggtgcctgaaaaaactgatcacagccctgctgctgcttctcctatgtggtttaggggagcataaaaccacagctaagtcaggggtgtggtttccttgcctgcctctgggtaatgctgtgctgttgtttctaaagagtgagaaaagaagacagtgtctcatggccagctgtggttgggacagggtgagtctgagaggatgggctgatgaggagcaagggctgttcctgcagctggtcctgagaggaactggtccccaacaaggctgactggcagaggtgggactattttcttttattttatttatttattttttattattttattattttattttattttattttattgtttgagatagggtcgcactctgtcgcccaggctggagtgcagtgttgcgatctcagctcactgcaacttccacctcccgggctcaagcaatcctcccagaaggtgggattttataagggtagctcgttaagcccagcatctgcctatgtaattgccttcagttattattgttgatcagtacattcaaaagatgtagaggactgaatctgttctgcttagcttgcctttcccctgttttacaaagcgctgctgaaccaggtggctctggaggcacactccagcaaaagagaagcttgttttcctggtgctaacttgcaaactccaggtctggcttttactcggctctataaatttgctgtgcttagaaggccattcaaaacactcaggaacatctgcctaagtttaccccaccatgggggcagaggccctactgggccagtctgggccactttgatgtctttataatgtttttcttcttcttctgtttcttgttttactaacttgtcccgtttgttccttcaaactccatgccaccccatcccaggaaatacacattttcagatttaaaaatattgctgttatcaacaaaaaaagtagcactaccaaaacagtgctccctgaagcattgggctgtgagcttatatgcaaggctccatggcttggtcagttgcttaggtgaaatatatagttttcactctctaagagtgaaaatagcatgctctagactgacagtgtcatcccagattggaagatccagaatgagtccttagactgaggttcttcaccctgtctgcccctggagctgcaagcccatgctggtatcccaagggctgggcaaagcttccatccctttccctggttcctagcgcttcccctaacagtcacttcctagtttcttatgcgagaagtaaagggtgaagctcaggtctgaagactggaaggtcatcagtagtaaaaagctgggccactgagggaagcattcagcaggaatcctttaatcaggtccagtgttaattgatttgcctgaagccagaagcactttggagaggaagacccatccaacagcagaaaatctgacttggagtatactttaaaataaatgtgttatagttaccatgtaggcacattgagtgctggcttagttgtgctttaatgaacaataattaaattacttaaaatattaaaattaatattttatgtgattgttgtaacagtatttaatactactaaatatttgtatttaataattcaataaatttttttgccagtttatttatattattaacttatgttggaggttagcaaacttttcctgtagagagccaaaaggtgaatattttaggcattttggtccaagaggcaaaactgagattattgagtaggtacttctatgataagagagaaagaaaatttgcagattttttaattgactaaattcaaactacaatagtaataattgagtacaatgtttttataactcagatttaccaatgatatgaatgaaattttggtgggagaaaataacatttcacttaattggggtccaaagttagtgttttctgtcatcaaattgattataaatgtttatctgtaaaaacccattcttagctctctggctgtgcaaaaacaagttatgaatcagatttggcttatgggctgtggtttaccaacccttgattatgttatacaaattatacaaatgatttgtttagaaaattcatccctcctccccatggatggggccaaggtaactgtctggtcttatacaaatacaatttcatctcaatttcacagtctcttagtatttagaactttgcgacactttgattttaaaccattgctctgtgtatttgagtaattttataaataagtcttggtgacttcctgtcattaacaaaaatggatttaagaagtcagcgcccgctgtgcccatttaggaatcctgtagttggctgtagacaggggtcacatcgctgtactctttctgctctgcacacagctcccctctgcaggttttctgcatctgagctctgtgctggctctgcacatgtgcacatgcccttccttgatgctgcagccacctgccagagaagctaccctgagcacagaggctccccactgaggcagagtgggcctgaacagcatctggttaggatcaaaggagggaggagagtagggaagggcttgttcccacactcctgtctgctttttttgctgcatggaggcttcccatggggtggcaggcagtggctgcatcatacccagccagtcgggacacactaattctgctagcattccttgccccaatacaaatgcccaaagaatattccttttttccccttacttcagctgaaatactataatttttcaaaaggaaacttctctagaagtgacaagaaggaaagaaaaacaaaggtagagaaaaataaacttatagaatcagtagagcttgatgcagatgtcctaacctgactgaaatctgatgtgatcttggtttcccttaagtccaagttctctcattttccttttgttttaaagccaaagctttcacttgctttgcttgtctgttgcatcaggcttagtgtggatagcttcaggtgtagcttccaggtagtcagtatggcctgtctccactccaaacaggacaccaactccctgactccctgataattgtatttttacgccagggtgagaagcctatgaagtctttgcagacatcctgtcactctgttgctgttcgccacatactccagttttccagctttcttagcattcctatttgtcaccatcatgtcagactgttattctgggattttctactaccatttttagtcactccttaatggttctccatgctgttctcagatggggagctgggactttcattcctgtctggtggtaagggcaccccccttgcccaggagccagtggacaccacatggggaacctggacttctacttccacctggtggtaatggttaccctttcttctccttgctgggtgggtgtcagagaaagccaagtaggcactgagggccttcacatctgcttgtttgaaataaggcaaagaaaattaccagaaacagagaaggacattacataatgatgaaaagttctggccacttaaaaagtaaagcaatcctaatatgcaccaaacaacagagctgcaaaatacatgaagcaaaaactgatagaactgcagagagaaataacaaatccatggttatagcataagactttaacactctaaacagttggtagaataattagaaagaaaatcagtaaggatatagtgtaagtcagtaacaccattaaccaggatctaatcaccatctacagaacacttccctcagtagcagagtcacacattcttttaaagggcccatggaatatataccaagatagaccatatactgggctgtaaaaataaacctcaacaaatttaaaataactaaactcatgcagaatgtgttcttcaaccacaagagaaacaaactataaatcaataccagaaagataagaggaaagtctccaatcatttggaaacaaacaaacaaaacacccttctaaataatccatgggtcaaacaggaagtctccagaggggaaaaaatatagaattgagtgaaaatacaacatatcaaaacttatgggatgcagcaaaagcagtgctgaggtgacattttatagaactaaatgtctatattagaaaataagtctcaaatgaagaagctcccaccacaagaaacttgaaaaaggagagcaaaacaaacctaaaataaacagaaaaagggaataatcaagataagaacagaaatcactgacattgaaaacaatgatgatagagaaaatcaaatgaagttgattgtttgaaaagattaataaaatggatagacctgtagcaagaatcacaaagaaagaaagacacaaatcattaatgtcagggaatattttgggatagggtatattcctacagattctgcagtatcaaatggttaatgcaaggactctatacatataactttgactactttaatggaatgtaccaattgtccctcagtaggttaatggttagactgcagtacatccatactatggaatacaactcagcaatgaaaaggaatgaaattattggcacatacaacttggatggatctccaaggcattatgctatttataggacattcttggagcaacagtattatagaggtgaaaaataggagttgacaggggttagtgatggcagtggtgggaggtaggaatgtgtgtgattatgaaggaatagcatgagagtgttctttgtggcgatggaatagttttttcatcttgactggggtggtagttacatgaatctgcatgtgataaaatgatatggagctatccatgcacattttaccaaagtgaaatgcttggtcttgatatagtactgtagctaagtaagatataatcactgagggaaactggtgaagagtacctgggatctcaccatactacctttgtaatttcctgtatatttatatttcaacataaaaagtaaaaaatcagtacgcatcttatgttgcttagcttctataagaccactatccatactcaacccaagaaaacaccacacaattagcataggctggattattacatttgttatgttcaacgaagtgatatcatagtctttgtgttttttatgatgatcagacccacttttgaattcattctgtattcagtactacatactatattctatagactgagttggctgaaatccaggacataataagtaggtaggggaacttgggcaagatttgctaggcagggcatgctgtgactttaactatttgaataattcacgtgtatagaagacatggagttattctgggtgaaggtgcagatgccaaaaccaaggccattgcgtagaaagtgtctagagtgagatgggggcccagtcaccgtccagagaggaaagcaggccacagttcttccattgctcagacgtgcctggagtggtgagcagagactgagtgaacacctgctgtggaggtgggcactgcagtggcaaaaatggggactcagtggcacctttcaatggcagacccaggctcttggccaagttgtgatgaaagaaattcagcagcaggtgggcgaatcagaggtgacaaaaccctgtttggggctgtttatcaccattttgagaaaattaaaaccaaagcaatgttttctgagactatttttgaacccattatgagtatgatttctagagtaggaagtacaggattggaggatgatgtgctcattaaagtccccaagaatggacagcagtgatgattcagaacaggcaagtcctggaagaggcctggttccgatgtggcaataggggagtagcttgaggaaacacactgcacatcccttgaagccttggactcaacaaagagaggccctgaagaattaagtgggctctctgctgcctctggcttcatgtcgcctgtatttaaatcatgatccctttcatcatgttgttccaacaagcatattttccagagatcaaagcagattcctcgatgacacacataagaaatgcaggcgtggggtggaggtgacatgagatattagacaggtttgtagggcctttaagaggggaaaattctgcatctcaagaatgcccaattcagccaggttccaattatggtggtaatgtcacgtgtcaaagcagtgatgtctaattatttaccttatttatatttgtcagcacacagagcagccaaatgtaattccttcaacatttctttttggaatgactctcagaactgtggtgactggaagttagtagagtaaatgcctccatgaacaaagacgttgtgtttccgtgtcagacatccttgtgtctagaaggtgggcttgcttaagctggagctagggctttcgtagacagtttggaggtgcagttggggaaaagaatgctcatggtgccaaatgccacttagcactcctaggggacttttgtttaaattaatgcatttgcagtgatatatgtgacagtgctgctatatccaggtctgcttcttcctgaccaggttctacttaactcaatggcacccagtgatttaagtgggaattgggagagggtgagatagaagagtatagggggagaagggagagttgtacaaagtgtgaaaaggaagggtgattgactggaaagtgtgattcaaggaagaaggtggaagtcccttataccaattcctgggcctgtagttaatccatctggcatctctgcttccagggcctatgttgtggggcagggcacacctaatcccattcatacttacattagtcttgacttcccctaatcctcttctccatattggtgtacccgcaacaacagtaaatgtgtttggttctgttttgtttcttttcctgttagcatagcctcaaaaggagattattaaaagaaatgttgggctgggcgtggtggctcatgcctgtaatcccagcactttaggaggccgaggcaggcgtatcacctgagatcaggagttagagaccagcctggccaacatggctaaatcccatctctactaaatatacaaaaattagccaggcctggtggcatgtgcctgtaatcccagctactctggaggctgaggaaggagaatcacttgaacccgggaggtggaggttgcagtgagccaagatcgcaccactgcactccagcctagcgacagagcgagactctgtctcaaaaaaaaaaaaaaaaaaaaaaagaaagaaaaaagaaaaaaagtgttggcagggcgtggtgcctcatgcctgtaatcccagcactttcagaggccaagatgggaggatttcttggggctaagagtttgagacaagcttgggtaacaaaatgagaccctgtctctacaaaaaataaaacaaaatgtggtcccagcttactcaggaggctgaggcaccaggatcccttgagcacaatcctgtcactgctccagcctgggcaaccgagcaagaccttatctctacaaaaaatgaaaaagaaatgatgctatacatttatttttttgctttcaattttagcaatcaaaaatctagaacaagatataaatgtatgtgtttactccttccaaataaagtggaaagtgagtagtcagtaaaatgcagaatgagcccaggacgttaggataacagggaggttgtcatgcagttgaggttctgggtccatgatttcctataaccttttaaaagttcaaccttttaaaaattggcatttaacatgcttctctatggggcagaattggaatgaacctcagaatggaactgaactaaatctccagcttatcccccttgagaattctgagaaggtaatgccctttcttctaagtactcagatcttcagataacaatgctttatgcttttaaagtactctttgctggtatactagccccagggagaggtagatttgtgccagcatctaaggctcccaggaaatattcacccttgccagtccagtcttcaccagccccacatcaaagctgttttacaaatgggaatttggatcccggtttataacaatggaattaaaaggccaacctaccatggatatagctatgtataatgtagatgactttaatgtgttccttacagctctttggagagtgagtaccatctttgtctttttatgaaggcagatgttttgggcaaattaaatggatcagagctagatcccatacaggaagcatcacccatcatgatgtccacggttaatgtgtttttcatctcatggatgtcaggggtgggggtagatgcctttatctctgttatgaactcaaatcccttcaatttatctttatttttagggatttaaaaaattaccattaatttgagtaaaattctaataaaaacagtagatggccttttaatactaatattttctacaagtcaaaacaaaaaattaaaggaaaggccactcaatttcattgagtattctgtattaggtttcttggctccagcatttaaatagcttttgcttgctaaatatatagggtattctctgaattatctttttattgtttcccaaaatcaacttgctgaaaaggaactatgttggaaaacagttactatcttaaaacacttttctgttttcaaaagtttgaaaaaaatggcatatttaaacaacaaattcttaaacttgagattcatatgatttccttttaaaggggatgaatttgcaaattgccaaagatggtttacagtgtctgacttgctgggacacctgtatttgctaagagaaatgttatttaaaaaacacctaatatatttggaagcacaaaaaaaaatgacgaagggaaagtggggtgcattagctccctgtgagggtcatttttatgtatcaactcagctggaccaatgtccctaaatatgtggtcaaacattattccaaatatttctgtgggggtgtttttggatgagattacatttaagttagtaaatgtaaggaaagcaggttgccttccattatgtgggtgaaccacatccaatcagtcagaaggaattttgcaaaagacggtgctaagactgcaacaatgggtccttcctgagcgtccagcctgacagtcttcaactccaaatgtggtatcagttctttcctggatcttcagcctgccagcctaccctgcagatcttagacttgccagcctttataattgtgtaagccagtttcttaaatctatatatagtgtgtatatatacatattatatgtatgtcaatatactttatataaatatgtaagtatatattttatgtatatatgcatacatttcctatgggttctatttctcaggaaaatcttgactaatacattcccctttcagagagatccactagcagagaaatttttggtcaagaaatttaattgcatggtgttttccttgatggcctggttggaccatacgctgtcatatatgtccccttcttttgtccagaaaagacagtgctggacagtcaggaggaacagccaagaagaaaccctaatcagtccacctacgatgaacaaaatagaacattcttgaagtttcctgatgctaaaaaaccttttaaactcagctggcctgaggtcctgcagacccaggatccctgtcacccactggggatgtgaggtagaggagcaagccccgcgtactggcctcacactgaggcccagttgagctccaaaatgggacaaagtactgttttccctaaaacttgttctctttactcttcaaatcagcatttggtactactgccagtgccagtgctggtgctgagtgtttcaaaaacagttctacttcttaaaataaaaatgtttatggaaaaaagatcatatttctaatctctttcagttatttctgcggtagaagctaggaacttcgtatctgaacacccagattaattgtccttggagtggggcagacagtagagattgaatgtagctgtagcaagttaaatctccaaacaaaacatgtaagatggttttaacatcttatataggcttctggcacaaggtatgtgttcgttaaatatgtcacatgagtgagagcttcttggagtgctccctggagaggtggctgagtgtatgtgtttctcggcagtatcatcattgaatattagagcagctgcgggttagaaacgaaggcagggcttctgggcagactgcctggcaggagagatgctctctgcagagttagtgccgggagctggtgccacctccccacccgatctccctgaacatgtgtctcatgcagggccacacttggaccactcagagtggtcaagggtgaagagcacatgctgtttgcttgttctgtgttgactttcctttttacttcttgtttgttacctgtctaattgcctctggtctgtgggtaaatgctttattagttggggccaaagcccaggcattctccgggcctactgaatcaggctgcgtctccagggagctcacagtgtgaggtgcctgggcacgtgagtcactgggctgggtggctgcagactcccgtcacggcagtcggctccctcactgcctctggacttgccaaagttttgttgaggtggagaggtcgccacaggctgaaagcattaaggagaaccaccctggcatgcggagcagtcggtgtgctttggaggaaaacatacaaaccaggtgagtgtgtgtggacaagctggggcttggctgccagatgccgccctcccctttctggtgggactgctcagggacatctcctcctcctctcttaacatcttcccaggtgtttctttgaacagagcaatgggtacttttccagcaatataaaaagctttgaacagagaaattttacagatggtattaacttttcaaaaattagacaaacaacctaacttcagaagttggtatttcttacattaaaatcctgggaaaattaaatattttgccactagtttttacatctctaaaactagggtaatactgactacctggtgttggccatgaagagtcaatgaggcaatgcttgtagattaacttcttgtagattggtagtgtaaacttcagaatttaaaatttatccatgctcaccctccctccctctccttctttatctctccccctctctccctgtctcctcacctttgatttaagtcaacaaaaattcattttgtgccccgtgtgccaggactgggcatacagtggtgaacaagacacacatggctctgcctcatggaactttccattctggccaagatgatagacaaggaacaataaaggatatatgtaataatgacagctggtgataactgctgtgaagaaaagtaaagcaggtgtgaggcttctagagggtggcatgtataaggtgggcagacactatttatacagggtggacgaggaagacctctttgaagacgtaatgtttcacccaaagaatggagccagctggaggtaaatctgcatccaaaatgtaaaaagcaatggattaaggcattcgaagcagtttctgaatcgtcaggaacactgttgataacatgtcagtgttatcagctgagggatgattatcatgaaactttttaagttctagaatttctaaatatctgtgtgtgtgttgtatgcagggaaagtgcattttcctcagcatggattatgctttatctctgtctgtgaaaacactgttgcgagaagctcagctcaatttagcagaacataagtggaaagtagacatttgaacgatactgatggttgatttccattaagtaggaattgaaatgaactgttgaattgttgctttttgatatgtggaaatgagtaaaaaccttacgtatctcttggtctttaaagaaaatctactttgatataaaaattctttttaaaaagttggcttatacccccacaactatcagaaatgcagctaacagagctagcagtttgtaaggagttaccttggaaacttctttcctagagagaaccctccacatgtaatgtacggcttgccgtttggaaaacaaccagtatgaaatccttctcgaatctgtgggtgtgccaaggcaggcttttcctcatggagaagtaagtgctggtgctttaagggaacccctttttcataggtgtatgggaagaagaaatccctgtcagcctgcattggctctggctggtgttacattccaccgcagttcatcttgagatgtttctggcaaccctctgttttcagtgctactacaaatagggactgtttaccacccctggtatgtactaactgctaaggtacttaatggcaccttggccttttttattccacatctgtgttttgactcatagttccttttttttgtcgcagttccttacatgtgtactttagagttttgatatttcatttaaaaggttgacctgggccaccttaaagtgactttatgtatgtttgcagtatttagttagtttaagctttagtgtaatcaacagaaaatggctatcttagcggcatattaatttttcaggtgttaatcttttgttttcttcagagacagtggtgttagtgagcgactctaggaagttccccttgttccgtatccagcaccaggaagggagggtgtcaggctggaatggtaattaatgagagttcaggtttgtctgtcgcaagatgaggcaaatgtttttacttgcactctgggatctcaagtgcactcagatggatgggtgttttggttcacgttctggcattcccactgcacatcatgcatttggagtgatgttaccagagctgtgaggggacacagcgtaggcagcgtgtggagtttagcaggaatttcatggtaacacagagcactcacttcacgcttctttacggtctcctatgttgactccctcaaatcatccattctttttccatttatggggtaatcagcatagaacctcgaagcaagtagtgagatctaagggcttgaaagtcaatgtgcccatgacatttggcttcagactagagcatcaattcacactgcctcacagcgctgaccccgctgagggtggagttggctccatctgccctaagctgccccctgggaaggtcctgcatcctggccctgtgtcctgccgccttcaggggcaggttggagctgggctctgtgctcctgagtggcatccttgtggggacgaaggacatatgagagtgtgggtgaggagaggccaagctcctggcagcaccaggccggcctgttcctaggtgcgcattcccaggttcgaggcactgacttgagtggaaagtttctccttcccatctctctccaaggccatggttgcacatcaccacagccgagactcacaggagagccaccaaaggcagaaaagggttttatttttcctcttttttgaaaagtaaaaccaaaaaaattcttgtttttctgtgaggtagatttgtcacaggttaaaccatctcattttatatttttagtagagaaggggtttcaccatgttggccaggctggtcttgaactccggacctcaggtgatctgcctgccttggcctcccaaagctaagattataggcatgagccaccgtgcccagctgtaaccatctcattttaaaaccaaggacaaggaacataagcatttatgttccttcagaatacaataagacaaaagggaacagaacacgggagggaggaaaccttagagaaattcgggaaggaacgtcgcagtgtctgtgggagctgctcacccgcagatcgttggaggcagcctgtgttcttcacaccccacagccaccttgtccgctgccactgtgaggcgcctgggtagccagctgcttcgtgaggttggttgttttgagctaagcctggaaagaaaacaggattaaagcagaggagtaagattgggtttgattaatgtttaacacaaaacaattttgggcctggcacagtggctcacgcttgtaatcctaacactttgggaggccaaagaagcggattacctgaggtcaggagttagagaccagcctggccaacatggtgaaaccctgtctctactaaaaatacaaaaattagttggtcgtgatggtgcatgcctgttatctcagttacttgggaggctgaggcaggagaatcgcttgaacccaggaggcggaggttgcagtgagccgagatcgtgccactgcactccagcctgggtgagagagtgagacaatgtctcaaaaacaaaaaaaaaattctgtacattcactcactcagcaaaaatcagttgataatcaacaacttgccaggcaccgtgtttagctctgggagtgcaaagatagagtcagcaatttatcaatttgttatggtgatatttcctgttagttttgtaggggacttatttttctcttttgttaggttcagccgttgattttaaaacagatgcttctgatctgtgggtgaatgtgcctttgaggtataattgacaataataatctgtacatacttaaggcataaaatcttgatatgtttggacatacgtgtacacagttgccgccatcatcacaaccaagatagtggctgcatccagtactccagaaagtctgcttcaacgacttgggattctcttttatcccaatgccacccatcccttccccaggcaaccactgatctaccttctgtcactatgcattagattgtattttctacaattgtgtatgaattggatcatacagtacatgtccttttattgtctggcttctttcactcagcatacttctttcacacgtcgcatggtcttcatagttcattccttttcattgctgggtagctttccatcatctggatataccagagtttctttatccatacatgttttggtggacatttgggtgtttccagttttagactattcaaaataaagcctttgtgaacatcagcgtacaagtgtttgtatggagatgtttttatttctctgtggtaaatacctaaaatgaaattgttgaatcataaggtaggtatctgtttagctttaaaaaatacttccaaacaacttccaaaggagttgtactatttcatatccacactagtgttgtatgagagtctagttcatctacattctttccaacacttggtgtggttagtctgtttaattttagccattctactaggtaagtagtggtacctcactggggttttaattggcatttgcctaatgactaatgatgttgaacatcttttttatgtgcttatttgctatccatccatcatctttgggtgaattgtttgttcaactctttttgccaatttttaattgggctttctgtttcttatttgatattattgttttttaatatttctctattactgagttttgagttcttaaatgttctagatataagccttttatcagatatgtgattgcaaatatttcccccagtctgtagcttattttttcattctcttagcagggtttcattctcttagtttcaaagagcacacattcttaattttgaagaaattcagtttataattttttttcttttatggaccatacatttagtgtcagatctaagaaatctttttttttttttttttttttttgagatggagtctcgctctgttacccaggctggagtgcagtggtgtgatctcggctcactgcaacctctgcctcccaggttcatgccattctcctgcctcagcctcccaaggagctgggactacaggcgccctccaccatgcctggctaatttttttttttttttttgtatttttagtagagatggggtttcatggtgttagccaggatggtctcgatctcctgacctcatgatccgcctgcctcagcctctcaaaatgctgggattacaggcatgaaccatcacgcctggccatggccagatctaagaaatctttatctaacttaaggtcacaaagatttactcccatttttttttctagaaggttttagttttaggttttaaatttataactgtgatctattttgagttaatctttacatgtagtctggatcaaagttttatgtcgttcatttttgttggcctatgtgtaaacaactgttccagcaccaactattgaaaaaatgatcttttcttctatcttttattagcgaaaacttctttagtttccttagtatctagagaaaactgccttttctcagagactgaattgtctgtacatctttgctaaaaatcactttgtgtgtgtgtttgtatatatatgtatatatcacttgtgtatatatatatatataggccagtggtagaccatatatatatatatatatatatatgggtctgtttctgaacttttcattccataccattgatctgtttgcctgtcgtattgccaataccacactgttttgattactgtagttttataataactcctaaagtaggtagtataagtcttcccattctgttcttctctttcaaagacctatgttaggtcctttgcatttccataagaattttggttttttttctgtaaatttctagggggaaaaaaagcttgcttagactttgattgggaatgtattaaatccacagatcactttggggagaattgatatcttcaaaatgttgagtcttttaatctatgacatgatatatctctatttaggtcactaatttctctcagcaatgttttataattttcagtatacagacattacatatctttcatgtaattcatcaataagtatttcatatttttatgtattttttaaaattccaatttcaaattgctcatttgtattttttagacatacaacttaattttatgtattaatctagtattgtacaaccttgttaaactgacttattagttctactagcttttctgtagattccataggatcttctcagatgatcatgtcgtctgtgaataaagccagctttaccttttcctttccaatctcaactgctctttctttctttccttttattgcactggctataatgtggaatagtgttgaatagaagtgataagagtagacatccttgtcttactccccatcctaaaagaaaagcattcagtgtttctccattaagtatgatgttatctgcaggggtttttgagatgtcctttatcaagttgaggaagtttccttttatttcttgtttgctgagaacaggaatgcatgttagattctgataaataattttcctgcatatattgaaatgatcattttttgtttgttgatatagtgaaccacattgtttattttaaaactgttaaactggggtaaactgtacctggtcacattgtattttccttttaatatattgttggatttggttggctaaatattttttattgcatctatgtccctgacagattggtgtatagttttcttttctctaatatctttgattttgttgtggcaatgctggtcttattggatgagttgggaaatatttgcccctcttcaattttctggaagagtttgtgtagaattggtattatttctttaatttaatttgattaatttatttaattaattaatttaattaattgatttaattagatcccatttgtcagttttggcttttgttgccgttgcttttggtgttttagtcatgaagtccttgcccatgcctatgtcctgaatggtattgcctaggttttcttctagggtttttatggttttaggtctaactaaagtctttaatccaccttgaatgaatttttgtataaggtgtaaggaagggatccagtttcagctttctgcatatggctagccagttttcccagcaccatttattaaatagggaatcctttccccatttcttgtttttgtcaggtttgtcaaagatcagatggttgtagatttgtggtattatttctgagggctctgttctcttccattgatctatgtctctgttttggtaccagtaccatgctgttttggttactgtagccttgtagtatagtttgaagtcaggtagcgtgatgcctccagctttgttctttttgcttaggattgacttggcaatgcaggctcttttttggttccatatgaactttaaagtagtttttcccaattctgtgaagaaagtcattggtagcttgttggggatggcattaaatctgtaaattaccttgggcagtatggccattttcacaatattgattcttcctatccatgagcatggaatgttcttccatttgtttgtgtcctcttttatttcattgagcagtggtttgtagttctctttgaagaggtccttcacagccctttaagttggattcctaggtattttattctctttgaagcaattgtgaatgggagttcactcatgatttgatgctctgtttgtctgttatgggtgcataggaatgcttgtgatttctgcacattgattttgtatcctgagactttgctgaagttgcttatgagcttaaggagattttgggctgagactatcgggttttctaaatatacaatcatgtcatctgcaaacagggacaatttgacttcctcttttcctaattgaataccctttatttctttttctttttcttttttttttttttgagacagaatcttgctctgttgcccaggctggagtgcagtggcgcgatctcggctcactgcaagctccgcctcccaggttcatgccattctcctgcctcagcctcccaagtagctgggactacaggtgcctgccaccacagctggctaattttttgtatttttagtagagatggggtttcactgtgttagccaggatggtcttgatctcctaacctcatgatccacccgcctcggcctcccaaagtgctgggattacaggcatgagccactgcgcccggccaataccctttatttctttctcctgcctgattgccctggccagaacttccaacactatgttgaataggagtgatgagagaaggcatccctgtcttgtgccagttttcaaagggaatgcttccagtttttgcccattcagtatgatattggctgtgggtttgtcataaatagctcttattattttgagatatgtcccatcaatacctagtttattgagagtttttagcatgaagggttgttgaattttgtcaaaggccttttctgcatctattgagataatcatgtggtttttgtctttggttctatttatatgatggattacatttattgatttgcatatgttgaaccagccttgcatcccagggatgaagcccacttgatcatggtggataagctttttgatgtgctgctggattcgatttgccagtattttattgaggattttagcattgatgttcatcagggatattggtctaaaattctcttttttggttgtgtctctgccaggctttggtatcaggatgatgctggcctcataaaatgagttagggaggattccctctttttctgttgattggaatagtttcagaaggaatggtaccagctcttctttgtacctgtggtagaattcggctgtgaatccatctggtcatgggcttttttttgttggtaggctattgattattgcctcaatttcagagcctgctattggtctattcagggattcaacttctcctggtttagtcttgggagggtgtatgtgtcaaggaatttatccatttgttctagactttctagtttatttgcgtagaggtgtttatagtattctctgatggtagtttgtatttctgtgggatcggcttctgcatggcaaaagaaactaccatcagagtaaacaggcaacccacagaatgggagaaaatttttacaatctacccatctgacaaagggctaatatccagaatctacaaagaacttaaacaaatttacaagaaaaaaatcaaacaaccctatcaaaaagtgggcgaaggatatgaacagacacttctcaaaagaagacatttatgcagccaagaaacatatgaaaaaatgcttatcatcactggccatcagataaatgcaaatcaaaaccacaacaagataccatctcacaccagttagaatggcgatcattaaaaagtcaggaaacagtaggtgctggagaagatatggagaaataggaacacttttacactgttggtgggactgtaaactagttcaaccattgtggaagtcagtgtggcaattcctcaaggatctagaactagaaacaccatttgacccagccatcccactactgggtatatacccaaaggactataaatcatgctgctataaagacacatgcacatgtatgtttattgtggcactattcacaatagcaaagacttggaaccaacccaaatgtccatcaatgatagactggattaagaaaatgtggcacatatacaccatggaatactatgtagcataaaaaaggataagttcacgtcctttgtagggacacggatgaagctagaaaccattattctgagcaaactatcgcaaggacaaaaaaccaaacactgcgtattctcactcatagatgggaattgaacaatgagaacacatggacacaggaaggggaacatcacacactggggcctgtcgtggggtgggggtgggggagggataacattaggagatatacctaatgttaatgacgagttaatgggtgcagcacaccaccatggcacatgtatacctatgtaacaaacctgcacgttgtgcacatgtaccctagaacttgaagtataataataataaaaaaaagaattggtattatttcatctttaaacatttattataattcaccaatgcagccatctagtcctagcgatccctttctggtaaaaatttaactgcaaattctatttctttaatagatgttggacaattcaggttatctatttgttcttgaatgaggctttgttattttgtacctctctaaggaatttaagcatttcatctaagtagtcaaatattttgtgtaaagttcagattttcttattttatatctgcagaatctgtagttgtaataatctcatttctggtatatgtaatttgtttcttctctttttattaatctggctagatatatatcaatttcatctgtcttttctaagaaccaaattgattttctttgtttccttttttaatttcactgatttctcctctgatatttattattacccgtattttgtgtaccatgggattaaccagctcttatttttctaatttcttaaagtggaagctgcgttcattgatttgagacttttgttgtagacttgcaatgctgtaaatttccttctaggtacttctctttagaagcatcccatacattttgatatattgtattttcattttattcgtttcacaatccttttaatttctcttttggtttgttctttaaccctgggttatttagaagtgtgttacttacaaaaatattttgggatacaccagagtttttttatttgtttataacttgattccttaattccattgtggtaaaaaaaaaaacaaaaaacatgctttatatgacttcaatcctttaaatataccgagagtgtttttgtgggtcagaatctggtctgtccatgagcacttgagtagaatgtatattctgttgttcttgtgtggaatagcctataaatgtcaattaggtgaagttgatggatagctttgttccagtcttttatatacttattttctgtctcctttcagtaatctatatagattactgtgagattattgttgacgtttccaaccataactgtaggttttactatttctcctttagttctatcaatttctgcttcaggtactttgaagctttgttattacaaacagagcttaaggtttacatttgtcatatcctcttgtcaaattgacccctttatcattatgaaatgacattcttcatctctggcaatattcatgtctctgaaatctattttgcctggtattaatacagtcattccaactttcttttgattagcaattaacatggtatattcttttttcatccttttaattttagctgatttttttctctttatatgaaaagatcatttctgtaggactcatgtaatcaggtcttgcttttttatccaatctaattttaaattgatctgtttagatcttttatatttattgtgactaatgatatggttaggtttaaacctgtcattttactatttgtttgctgtttgtctcatctgtactttgttacattttcctctttttctgcctttttttgattatttattttgtaggatttttaaatagtgtctttttagctgtaattccattatcttcatggttgctttagggtttatagtacagttgacccttgaacaatatgagtgaactgtgagatgtgtggtccacttatatatgaattttttttcagtaaatacagttggccctccatatcagcaggttcctcatctccaaccaaacttggatcaaaaatacaatatttgctggatatgaaacccacatggagagagggtcaacattttgttctggtggtttagcagacccaactatggaacttgagtatgcacaggtttttggcatccatgggtgatcagagaaccaatcccccaaggatactagacacaactgtttttatctttaacttatcacaggctttgttcagatgacgttatacctctttgtgtatagtataagaaacttacaataacagtgtcatgtattccctcccagtctttgtgcctgttgtcatacctcttatatttgcaagtgttaaaaaccccacagaacactgttatttttctgtttaagtagccagcgaccttttaaagagtttttttaaataaggggaaaaaacgtgtatttacccttgtagttatcttttccagtgcttccagtgctctttattcctttttggaggtttgtatttctacctggcaccattttgcatatgcccaaaggatttccttgtagtgcaggtctgctgttgatgaattattttacctttgtgtatctgaacaggtctttatttcacctttgtttttcaaatattttttcacctggtataaaattctaggatgacaggttttttctccagcgctgtaaatatgttgatccattttcctcttacttgtattgtcttcagtaggaaatttgctgccattcttatatctttttgttttgtttcatatgcatctattttctgttcttctgtatcaatggttttcatcaatttgattatgagctgaattgatatgattttcttcatgtttcttctaattgtggcttgttattcctcttggatctgttggtttacaattttgaacaaattttgagaatattcagcattatatcttcaaatatttttgtatcacctccttcatcttctctctgtcaggaaatccagtaaccaatatgtgctacgtttaccgatgctatttattttaaatttttttttaaattttaaattattttttctgtgtttttattttggtttgtttctattgctacatcttcaattttctgaatcttttcttccatgttgaatcttccattaatcgcatccagtgtaattttcgtcttggaaattgtggtttcatctaaaagttcaatttcggtgtctttactatctttcatgtactacttaactttttgaatatacagaatactttataatcattatttcagtgttcttgtctgataattcccatatgttttaattgatttttctccaaactagtttcataatttcctacttctttgcatgtgtggtaattttttattgaatttcacacactgtgacttgtacttattgcatgctgatatttttgtattctttataaatatttgtcacatttgttctaaggcccagttacttgtaaacattgaatttcacacactgtgacttgtacttattgcatgctgatatttttgtattctttataaatatttgtcacatttgttctaaggcccagttacttgtaaacagtttgatcctttaaggtattatttttaagattcgttaggtgaaaccagagaagcattgaatctagggctagctagcccccatgactaaaacaagatccttctgattgttgtgccctatgccccaagaattatgagattttcttgtctggctggtgggaatagctgtgtatgaatgctgggtacttttctttccaatccttttggaaaggttcttccctgactgaagtacattcctgcactgattaatactctgttgactacccagaaggaacccttggtagattttcaggctctttttttctaggtggctctgtcttagtctgtttggagagttctatctaccttgctttcttaggtctcccaacttggaggtttggatgagctatgccagggttccccttccctgtgtgatgctatgggaatcttctcaaggtatcatagtaagctgggccactggagggctcacctcctttgttttccctagaatatagtctgttattgcttgctgtctagtgtcttgaaaagagttatatttagtctagctttttatatgtttcaggcagaaggggaaatttgatctctattcctcttttggccagaagcggaagtcttgcaaacatttatatttaaaatatgttgatagtgtacaatgatttacaaaatatataaaactttttgacctaataatcctacttctgggaatatatcttaaatatttccaaaaaggaaacagatgttacatacacaacattctgtacagcattatttgtaatgagaaattagaaggaatctatgtttatcaaaaaggagaggggttaagatcaaggcatatctatgcagtgaaatattagtggtttattttaaatgacagtttctaagattttcaacatttaaaacactaatactaaatgtattaaaaatatgttaaaatagtccatggtgtgtcatcattggaactttataaaagtatacacattcttatgaactaaaaactcaaagagaacgggctgccttcatgtcagtggtgtcactgctgagttgcagtgcttcccgcctgcactcatacccacattcagacccctgtgctctgctcagtgctcagccctcagccctgcctcctctgacaagctattctattgtcaccagtgttttcacaggacaggaagaatcacctggctacaaccaactcggtcatcttcacctattgtagtatcttctctctcctgacgttctccttagaccactgtcaaccatcacttactcctggtctttgacagtatccttgagttggattctttgggggcttattcaggttttcagggcgggatgatgttgaaaagcccaaaagatttcaaaactgtccagcgtttgatcaccttgctattgaaagacgacccacaactgactactcagtagtgttgtttgtcctcccagagtcctctctgcggctgcttctcttggctcagcagaaagaagaatgagttaaagatgaactgagcagcgggaccggtgacatcagtcctcctccactcagaaggaagctgttaaaataggacgagctgactttgccctttcctcctttctgaataataggcttcatttgcatgtgattattgtttactaattacctaccattcacctacagcccccaccaatactacttcttccatacccctctgcactacattttagcatcttgcttgggcaggacacacaagccatttaaacagctgcacagtgattgtttttccctccttgtgtaaggtttgtgcctccctgaggatatgtctattttggttttcatcattatcatatcctgacctgagagagagtgatgaaatcagcttagatagagcccgtggccttaagtgattgctgttaaaataacttccctgtgcaagttgtataaaaatacagggccatgagaacacattgctagggcccctcccaaggtctgggaaggggcctgtttgaatgagggactctgaaacataagctttgttagccccccggtcccacagcatgaattatgttaactgccactcttgacccttacctttctctgtggcaggtatccattgggaaagacagttgcagcaagctgagagaggcatacttttggaaagtgaattctttctaggatccctgaaatcaaactccacatgcagcagacttttttacatgcttgcttgtccaaattttcaggaaccgtccttgggcacccagagtgagtgaatgagtgtgtaccccttgttgggtagatgaattagcataaaaaacagggttacaccttgcctaagttcgtcctttgacttagaaagctgttcactgctgctcctttctgtctgagggtagttagtctgggccttgcatctaacctgctggagcccattctcaagcaagcttatactaaagccagagcttccccaaaacatagttgcgagaccttggaatgaggactgttgaggatgttgataaacagtttccactggtgaaatttaagtaccagaggtcaaatcacttgtacaacattgcttgtttggcaagaggcagtagggatggcctcaaacacaagtttctttggctttagagcctgcacttgccactacttgcctggcctacctcccatgtcttcccttcaaagctcttgtggagtaacgggtctgatcattctccattcctgaccattgcagtgctctgtccatttggccaaggggattcctgccagatgggcctagcagagtgcctggtgcttaacaaatgctgcaactgtttgcatgagtgggtgtgtatgtcagtctttagaaaagctaagagagtttgggccaaaaggagggtaacacctctcatagatcgccacagtttgggttgaaagactggagagaggctgcagcacagccttgcagtagtttttcattaaaactttcttctatagctttgtgtgtgtgtgtaaagagcagctgtttttttttttttctgttttttttttttgtttctttgtttaaggaaatatttaattatagtgtataaagcagtgtttgtcaaccttctgttcagaatcatccccctaaggtgccttttcatatatttttttctgaatcacccccataccccaaccctcatgaaatttaaattccgcagacattctgtttatgtattcttcccctgtggagggctgtacacatttgtgatatctaagatgtttttgttcccaagaatcaaatttcatgtttctagctcctattaagaatttatggtctgaagtatttattccatttcagtagctgataacatgagaaatgcttatataattacagaaatgaaagcaaaatactagtcattgattgacagccagtaattactataaggatggcaaaacaattctgttctaatgaacacgtaattacagctgctggggaatagctattaaataaatggaatctaatgtgttggcccaggagacaggatgggtggcggtgaggtctggggacactcagccttgtcacatgggtcagctccatagggctgggctagtctcatacctgtttgtgcacaaggaaccacctcccaggactgttagagcacacgtccaagtcaggaggccttagttgcgtttatgattttctgctgtggctattaggctgctagttttttgagaagtactatttttgatatgatttgattttgacttttttattgtggatatatcataaaaacacgttaaccatttttgtacaattcaatgacattaaatatcttcataatgttgtgccaccatcatcactatttatttctaaaatgttttcatcaccccaaacagaaattatatacccattaggaactagctcctcaatcttccttacccccactccatcttttttctttgtacactatcaatttagagctaacagagatgactgagtgtggtcacaataggaagatttctcgttctttgaccattatgcttgtgttggtattgttgtaggccataaaatacacaaaaccaatatgattaaaaatatgttgggcaggcttgtaatacttcccaagaatttaggtttcgctaaatggtaggcaagtgactactactacactgtgtattgtattgtattgtattgtattgtattgtattgtattgtattgtattgtattgtattgtattgtattttttgagatggagtctcactctgttacccaggctggagtgcaatggcgcaatgttggctcactgcaacctccgcctcccggattcaagtgattctcctgcctcagcctcccaagtagctgggattacaggcacccaccatcactcccggctaatttttgtactgttggtagagacaggatttcaccatgttggccagtctggtcttgaactcctgacctcagatgatccacctgccttggcctcccaaagtgctgtgattacagatgtgagccactgcacccggccatgacaactacactggatcttcatttttaaaaagtcccattatagaggtctataataaaggaattaaagtcctctgagaagaaagtaagggactgtcttgtttaaaaacattatttactatgttgcatgatatgatttaaaaatgtttaaagagttgaaattttgaaaccgtgtctatcaaacatgcagctgtgcagcttagcaaatatggatgacattcagatgccatttccagccatttggagcctgctgggctgaagcggaccagtgcctcctacttcgtacctatccacagttctctgcctcattggagagcaggacgtggaatcttaggttattcctgggtttgcctttgagcttggttttggtgagaagcaggtgttgatgctgagcctgctggggagagccataactcaagcacagcctttaaagtaatagtttggtttagcattgagcagtggcttatatccctggccatacaggagactcacctgtggagccctgaccaacaccaatgccaggtctactcacatgcccaggtcaatcaggtgctggaagtgagatccaaggcgtgaggaggggcagtggtttaaggctttgctgtgatgattctcctctgtggacaggcctaggaaccctgagcctgtcagtcagggcctgggatgccggccatcatgtaatcgcaggacacagtttatgtggcctttgcatgggctcagcaacgagtcccctcaggtacgtgcttctagacacagagtcttcatggttggtgaaattttagtaaggaagttgagtaaattgagggtttttaaagttaaaattctaaaagtgttgaaatcctaaatagagagaagtacagaattaatatactagcatgtactcttaattgttttacataacatccaaaaacctatttctgatttttacagaggactgatttttgaagggttgtatattaataaggcacatttgtggaatcatgtctgaaacctcagactgcagatagaaatacctagtgaaagcttgctccctagtgccagacacttcataatacacccccgcaggggctttcgagtaatgttaccttggaactgggagttttggaggtctttgggttaaacccttgtgtctctcagatgataccattgaagtccagagaggttaattagcataacagcatcaagaacagccaaccatcagccacgtgctgtgctaatacatcagcatatttcatcctaaccatacaggatccaggttggacttgtcttccatcttatgactgcgtaagctccatagtttttggaagtaagaaatggtggagattacatgcaaaccagcttctccgtgggtttaagtcccgtgagttttcttgatgcggtactgtcttagaagcaaaaatcaggggaactattctggtatcttttcttttctcatgccctggaaactcatgtgtcttctcccagctacatgtgccccatcctttaaggtatgtttcttgtcagcctctccatgaatcctcctctaattactcaggctcatatcagctgcacccttctctgaatctgggtgtttatgagctccattccactctgcttgggcttaattactcgtctctacaccttgtgttcattgtctctgtcacctggtaagcagggatgtcagtcagggacagatgccctaagtgtatgtgtcctgcatgggccgtcactaagctaggaggagctgcttttcccgggttcattggccaagcccttgtcactgactcggtgtcaccccaggtgacaccccaggtgaacacatgagcgcgaatgagacagtccagccactgctgaccctgctgcagagtccatttctggttcattccacctgtggctgtgacctgttttggagaggctgtgtgcttccactggtatttcattggatgtaagtcttagaagatcattatagaatagatcattaaaatgactgttttactttccatagagaacctagaagtctgccaaaaatttttagaggttcaaaacttgctaatctgttatactttccttcattcctttggtgtctccttatctaaaatatgggggactgtagaacgggaaagactgggagagggtgaggagcataggtgtaactgaggctgctacagcccagcagtaatgaagcacctgtttctgtacaggtggctgatgagggctccttttaaatctttagcatgggaatcttggatataaactttgctgctgttgggaagatgaatgaataggccagaaacaaaccagtcttctgtgtgtattagatgggagaagatgcagagagcttagctacataatgtcctgctgggaagaaaggtctatcagaaagaagcacatcagtgtcagtgtttctgtttggaaggcctggggaggagggaggggagacgggccctccctcctttgagagttactaagagttaagcttgtaagtgttaggggagaatattaggtctgatttttttaacaacttttttgggggaccttttttagaaaatggtcattctaaggtagagagagggtagtaatttaagactgctttagaaaaatttgcattgcaaatgctgctaaatgtcagcaagggactcaaaactttgacaccttgttggagctctttgtgctgattaaattcttgtctccagcctagaattggcagcttattctccttaattttcatgctgtaataggtattgaaagagtatttctttgacagttgcccttggggaaaactggaccggagcttgttatttagggcagacaattaagtggaaaagaataataactagactccaaggtcttcatttagttccaagaatgtcaacaatatcaacctctttttaatacttactgcgggctctggtgaataatggaaattaggggtagacaaatccagttcagagttaagaagaatgaattttaatggtctgattaaaattaattgaaatcccttctttaagatgaattagcccttcccagaagataaggggtgagtgatactaatagttttgttttgtttttctctctggagattactttgatttaaaaactcactgcacattttcagagctcctgtgttctaattgaagaaagcagtgcctatcttggtgcttagtgatgggctcatggaagaactgattgtaccctacagtatccccatcttcattcccaatgtgcaaatcacagatcattcctcccaaaacaaaataaaacctagttaccactgatacttgcttatagcagaatgttgccctgtggtaagtttctttaatgtttcataccattcatttatttttttttctgtacttttggtagaaataaataggaattatttccagtcacattctcaaatggcaaaatatcttattgaatggcaacagaaaagtattttctttatactgcttctgtaaaagaaaatgaagtgaagagtgggaagacagacaagccaaaatactcacacatcagtgagaggaatcttgcgtttcatggtggaactctgtggcctcaaatatgcaagtggacacttggtttttgaaaccaaagccttgtctcatacataaaaagggctggtttgtggtaaaagttgtgatatatctatagttataataatgctttaaaaaactgcatttaaaatgctgagacctaaactagataactcccttaaacgggattatatctctgtgcccatttacagaacacatgcaaccttaatttcactgtcatatagaaaaaggaagaatggatgaggaattgattaaaagattacacagagcagcaatatttaagagctgtttgtgcaaaaagtcagatgattttgccaggaagagatcgtctttcaacttcatcaatggcgttttggtatctttggctggaggacaggacatgaacaagcaggcaaataactaatttggtatcggatccttgtatgtatctctaatgtatctctaagaaaacatttttaaaaattttaaacatttttaaaaaatcaagtctagctctgtttgtagaatgaatatttatttattttatatgtaaggacttctgttaaatgtaaggcatgtttaacttacagaaaattgataggtttcaagtcaaagccttcagatggtagcaaaaggttcagagacaaaggagcccagatggtctgggcaggaagctgaagggccagagggttggctggaggtgtagtggggaccctgggccctgtcccaagcaagacggaaccagaaggtgttccagcttcagctgaagtatttcatgccttggaaaagtcattggtaagaacatctattatggatttgaaaaggagtgggcatcaaaggcgggagaccagccaggacccgcagttgctattgtccaggagagatcatggtatctgaacctggggcagtagtagagaggaagagaagacctgtctcagaggaacaattaagggaattgggtgactcactgaaggtggaggatgaggaaagggaaggagtctggaatagcagattccaaagttttctgattggagacctacaggaaaaaaaaaattatacttatataaaatgaaaataagaacaatatttcccttaataagtgcagtgtactgcgttttctgttctatttcatttattgaaaaatatgcattactggtcttattagatggatttttacaactttctagtggtatttgaaaatgcaggtatacagtgagctccattgtctagcctgggtgactgggtgatgtgtcctgttaacagggtcccttaggacctactgaggtaggcaggatgaggagtatctagtgctgagggggaagggaagtcaaaatccttcagtcctgcttccagcaaagcatctgggagttagctgttgtctgtgaggcttccttttaacagttcattgcagtaaagggctaccagttttaaaaaggaagggaagaagaaaagggaagtaaagaagggaggaagagatggaggaagggaaaaagaagagaaaggattacaaaccatgggcttagcatgctgagacagaattgcaaatggaccctgggcccaggagttgctccatccaggccaccttccacatcgctgttagatttcttattgtaaaaacagagcaaggaggagttttggtttggagtaagatggagtaagtacacaggaccctgtctttcccgatgaattcaactataaaacctataaagacaactattcaattgtccttcccaataaattcaaggataaaatagagcaactatttgaagactctgaagagtaaatggtaggaggcagattggggaagaagactagaacttagaatattgaactgacagtgcttttaacatttttcttctggtattctctggtctggactcaaattagtgcaaaacccagaagtggacttgggtgtggacagagagaattcaagatctttctatttctggcttgagtaggaggagtctcacatgtttctcactctgttatcttgccccctctcccccaggtaatcccatggtgagaacagcaggggcatatgggcacctaaaactctgaggagtggggtggaaactcactcacagaagtctggtttttccttctctgtttttctgcttggccccagttgtggctagctatagtcatggaaattaagtggctgaacaagttaagtaatgctccagctctctggctgaaggactaagaagggggagcctcagctgggtgtggtggctcaagcctgtaatcccagcactttgggaggctgaggcaggtggataacttgaggtcagcagtttgagaccagcctggccaaccggacaaaatcccatctctactaaaaatacaaaaaaaaaaaaaaataaattagccaggcatggtggtgcacatctgtaattccagctactcgggaggctgaggtaccagaatcacttgaaccggggaggcagagtttgcagcgaactgagatggcaccagcctgggcgacagagcagactctgtctcaaaaaaaaaaaaaaaaaaaaaaaaaaaaaaaaaaaaaaaaaggtggtggagggagcctcagggaacctaaaagtatcaggaatataatggagaaggagaagctcaggaacgtgaaagttttatgtgaacccctgggctccacacacgtgaaagttttatgtgaacccctgggctccacacagactgcatgcatgaatctgaccctaaacagcatagcagtgactttgagaactgaacaagatagatactgcccaggccccagactgtcgactttgtagtacacatacagagctcaaccaaatggcacggcaagggctctgaaaactgaactgatattagagccacagaagacaggtcagaacttgtgactcaaactgaaccaggttaattgcctgcttaaacaaaaatgtcaacattttctgtaatatttaaacaaaacccagagtttcataacattattttaaaaatatccaggagataagccaaaattacttggcgcgcaatgaactaggaaaatcccaacttgcatgggaaaagatagatcaccacccctgggccaagttgatacagatacttgatttttcagtttttaatgcagccattatgaaaatgcttcaggaagtaagagtgaacattcctgaaatgaatagaaagatggaaagtctcattaagaaatagaatatatagagaacccaatggaaaatttagaaacgaaatttacaatgaaagatacaataaccaaagtaaaaagcttaccagatgggctcggtagcagattggaaatgatagaccttaaataagacacattagtacttatattacatatgactggtctaatcacagtaattaaaagacagacattaatgaataaatgaaacaagacccaactaaatgctgcttacaagaaacccacttataatgctataggtggtttaaaagcaaaaggatgcaggagaaaaaaacatgcaaacactaatcaaaagaaggtgaagtgactatattaattattagaagaagtaggcttcagagcaaagaaaataattagaggcaaagcagacattataatgacaaaagaatcaggtcacccagaaaactagagcttcaaaattcataaagcaaaaacagaactgaaataagaaatagaaaaaattctgttgtagttggagacttcaatacttcttttttggtaatcaatagaattgacagactgaaaatcagcaaggctatgaaggaactgaatggcaccatcaaccaaatagttctaattgacatctttagaaaacactacccaactacagagaatacatattactttcaaatatgcataaaacattcaccaatataaatcatatcatgggtcacaaaataaaccataaccaatttaaaataattgaaatactgtaatttctgactggaataaaattaaactgtaaatcagtaacggaaggagaacatgaatatgtccaaactcttagaaattaacacacttctaaataatccatgtgttgaggaattctcaatggaagttagcaaacgttttgtactaaatgaaaatacaacacatcagatttgtgggatgtggttgaagcaatgcatgagggaaatttctagcattacctgcatatattagaaaagagggaaataataatgtaagcacctaccttaagaaactagagtaagaaaagtaaaataaaaccaaataagtagaaggaagaaaataataaaagtagaaattgatgaagttgaaagcggagaaaaaaatagagaaaatcaatgaaacaaaaagctgattctgtgaaaagaaaaataaaattgaccaacaagaatgacaaatgaaaaaagagaagatatgcattgctaacattaagaatgaaaggggattaaacttcacttcaatgaattatgacagaatactatgaacaactctcagcacataaaattgatacattagatgaaatggatcaattccttaaatggatcatttccttaaaaaccacaaactaccaaaacccacccaagatgaaatgataacctgactagccccattactgtaactattaaagaaatttaatttgcagttaaccttcttaacaaaatatctccagccccaaacagttgcctggtgaattccaccaaacatttaaagataaaataaaaccaattttacaaaatctcttccagaaaacagaagaggaggaaacacttcccaattcattttatgaggtcagtattaccatggtatgaaaaccagacataaaatacactgaacaatatttattatgaacaaagatgcaaaaaatcctcaacaaatattagtaaatcaaatccagcaatatatgaaaagagtaatatgccatggtcaaaaaggatgcaagactcattgagtatttgaaattcagttagtataacctactgcattaacaatctgaagaagaaaaaacacaatcatatcagttgatgtagaagaagcatttgacaaaattcattcattcatgatttacaaaaagctcttagcagactagaaattggagaaactttctcatcttgataaaagacaatttacaaaaacatatgtctaacatcataattaatagtaaaggattattaatgctttctccctaatattaggaacaaggcaagggtgttcactctcaccacgcccattgaatattatactgaaagtcttcactagtgcaatagggatgggaagagggatatagattgggaaggaagaaataaaattgttctttttcacaaacagcattattgtctatgtacaaaattccaggaaatctacaaaaacaaaacaaaaaatcaaacactcctagaattaatgtttaacaaagttataggatataaggccaatatacaaattcaattttgtttctatatactaacaataaacaattaggaatggaaaggtttttaaaacaccgtttgtaatagctccaaagaatgtgaactacttataattttggcaaaaaataccatcccaaacaaacatatattgcatctatagttgaaaactatagaacactgataaaagcaatctgcgaagatgtataataaatagacataacaggtttataggttagaagattcagcagagtaaagatgtcagttctcctagaatttatagattaacattatttccagaaagattttgttgttgttgttgatttagacaagctgcttccagaatttgtattaaaaggcaaaagaacaagaatggctgaaccaattttgaaaaagaagaacgaataggaagaatcatactacctgattttaacatttactctaaagctatggtgatccagattgtgtggcattggcaaagggttggacagaccaatgggacagaaacagacccgtacaaacacaaccagttgatttttggcaaatttgccaaagcaatgaaatagaaaaaggacagtctctttaacaaatggcattagttggacctatgaaaaaaaaatgaacctcaatctatgcttctttgtacaacagttatctcaaattggatcatagagctacatataaagaggagaaactacatatttttagaagaacacataagagaaaatctttgtgacttctagttaggcaaggagttttcccaccacttctcatgacccacagctgggtaaggttagcctggagagcttgctccctgttttctgtttttgagagttgttcagcgtgtgcttctgttcattggaggcactgttctaactcattcctcaccacacccctgcaaaatagatagtatggtatagccgtgtcatttttgagatgaagaaactgaagcacagaaagatgaataaatataccttgagtgtaataagttccatgagtggcagaacaggaaatgctctcttcctagacctgtggtgccatctacctctgtgttctgatagacagtctcagcctccacattcttcttgaaaacacaaatcatgaattttcatggctcctgtgacccagacgtgtgttttcagggcatctgttttgttcttctgtgtgggttttattctcaggcccacgtttgaggttggtgggtttttgctgcttgtagtgcaatattaacccacatgaatctatttagcgccatctcgtgtctggagcggtttacaggccggattgctttagtagtagtgggtaggtacaaaaaagatgtagtgggaaagatttgattaccaaaatatgaaaaattagcgtgatcggacacttgaattccattagacatgaactttgtagtgatgcacctcttccagtatgatccagttaatagaatgttgcggggaacagatcaagtcagcttttaaaccttagtttgccttctcccattgtaatagtgtcctggcttcttgggcacttggccagtaccagaggccctgagctcttggggggaggccttcagtcccagcttctcagccttgtggagagtcttccccgtggatataccttccagaaggctaaagagtctaccttctctctccctgtgtggttagctgatttaaaggaaggtgccaaaatgtacctcaggattggccttttcagcagcgggactcagaatgggaaaaggacagtggagcaaactcctcttccatggagacttgccagtttgtttgggaagggaaggagggaagaaatgggaaaaaatagggcagaatgtgccgaattcttggagctcttccatgaggtaggggctgcatctttctgcaggagggtgggggtggtggtggtaagaaaggatgcactagtaaaaaaattctaaaaacaaaagcatgtaacacctcacattattcagtcttatttttgttcttttttttttttttaacatattttacttttccattacagaagtaatcgatgctcatgttagaaagctgggaaaataggaaaaatacatccaaagaatatatactcaatcacaatggttaatattttatggatttccttttcttctttgtatgcatgaagattggagtgttataactgggcacggtggcttatgcctgtaatccaggcactttgggattccaaggctggtggatcacttgagcccaggagtttgaaaccagcctggatagcagaaggagaccctatctctacagaaaaaaaaaaaaaatagcttggtgtggtggcatgtgtctgtggtcccagctactcaggaggctgagatgggaggatcatttgagcctgggtggataaggctgcagtgagccatgatggcaccactgctccaacgtgggtgacagcgtgagaccgtgtctcaactaaaagaagatttgagtgtttaataatgtgatgttgctttttacttattttatttaattatgtgatgttgctttttacttatacttgctttttacttattttatgagaaacattttacaagttaggacatagctttggtaaatgactgtgtacgctgagttctaggaccatgacaggtatttgtgttttagttattattttggtatattaaataatgcttcagtgaacacctttgcttccttttttattttgtttaaacttagagctatttccttagaataggtttcccaaatcatgatgactgggaaagggcttgaagaggacttcgaggctcttagtataaacacatacgtgctcacccaccctggctggaagtgggctctgctacttaggcagtgatggagattttggtcacatcccttcacttctcagagcctcagttttttcttcttccaaatggaggtaaaaatacccactgcatatggcttttctattaataatacctataaagtccctctggagaacttggcacacagtgagcgctaaatacatggtaactttacaaaataattatagttctagatagccttattacaggtttctaccagtttgccctaccaccagcaatgcatgaagttatttaacctctctagtgtttgatacataatcatttctttttaaaatacctttgccaatttgagtgaaaacactaccttattattattttaatttgcatttgttttattatagtgagagtgaaaaattttgcatgctattataaacaagtttgttgtctctcatataaaatgccttttttctattggcatttaatattgtcttactagtttgtattaactatttaaagaaattattctttaacatatttgttgtcatagatccacttatctagtataattttatatcaaactttcatatgctgcattcaaatgctgcatacagatttctcattaggatgagaaatgtgattataattgtaatctctttgtaataaattctgtgaatttttttattgtatctataattttacttgcaaattatgacaatatgtatttccaacaattttgtatcttatcatttttcatatcttattaaatttgcctgaaattctatagcagtgttaaataatccatgggtttaatgagcatcatttaaaaattatttctgattagtaggaatatctctagtgttttaccattaaatagactatgaatctgttatttctcaaaatatactgcttattgtgtcaaggatatgtccaaataatttttaaattttttgagttattacatatttaggagcatattttttctcagaataatgtggttttctttttcttttttctctttttttttttctttgttcagacagagttttgctctatcacccagactggagtgcagtggtgcgatcttggctcactgccacctccgcctcctgggttcaagcaattttcctgcctcagcttcctgagtatctgggattacaggtgtgcaccaccacacccatctaatttttgtgtttttagtagagacaaggttttgccatgttggtcaggctggtcttgaactcctcacctcatgtgatccacctgccttggcctcccaaagtgttgggattacaggcatgagccactgtgcccagccactaatgtagttttcttatttgatcttctgttggataggatgcattttctaatattacatatatatttgcatacttagaatttgtgtttactgttttctgttttgctctttctaatcaacgtatttcatgtagaatgtttcctacaacccacatataaactttgtgtgtgtttgtaatgcataaaaaaagaatgtaagaaaatacatcaatattttaagaatggttatctttaatttatgggaacatgaattattttcactttattcttctgtatttttctaattttctaaaataagctgttctactgttaccagcataaaaaatgttgtttagaaaaatgtcaatgccctgacaattagttatgggtgaaatatgattaggagcttagatgtgactggtggagtcctccttcctttagggcatgtaacttctgtttgttcattatctatcagtcagattattttgataataatggagttgaaaaactgagtttaatgtttacttaaaaaacatagctagtgttttctgtttggagaataatgatggtatatggtgactatatattttcctaaactaagaatttaggatttggtatgtgacgaatgtgtgatatcatgtattttcatgatacctgatgtttttacttgaaaatctttaaagggaattactcataatatttaactatgcatttattgctgacctattggaataaaattggattaacccaggatgatcccacagaatctaagacttgctgaccacagactggggcactggacaggttgcttttggaaacttcgtttgtccttgtggccccagtgggaggccacaacccagacaccatctcatgaatatctttgtcctgtctgggactacacacagatatagaaacagaaaaacatgcatttatacatcaaggcacacagaaacaacaatcactggattggtgccttaattgcatcttccgggagcctggaatagcccttgtttcttctagtgttcgacactttctctctgaaatgagatttagttaatttcagagctcaggaattctcctcagatttgattcttaacatactgtgtacttaaagtatgaaaatcttgatcagcattatgatcactgaagattatatttctatatacatctataatgtctcctttttctcttgttttctgtagctttgggccagattatgttgtatgtggatggaatgaatggagtaataaaccgcaatgaaaccattcagtggctgtacactctcattgggtcaaaggtaaggggaagttatggttgactgttttgttcacttgtcatatcacttgcctttcttttttctctgagtcagttttgcagaaagaaattttattcagcttttttcaagccgttacagtataaatgaggattactactctacaaattttaagatacacttaaattgcaaatagctcatgaaattttaatgcatttctcttttctcttctcttaagctttaatcaagtgcctttggaaccttcggtttttaatatttaatcaaatgttataccatagggccgggcgtggtggctcacaccggtaatcccagcacttggcaaggccaaagcgggtggatcacgagatcgagaccagcctggccaacatggtgaaaccctgtctctactaaaaatataaaaattagctgggcatggtggcacgcgcctgtagtcccagctgctcgggaggctgaggcaggagaatcacttgaacccgggaggcagaggttgcagtgagctgagatcatgccactgcactccagcctgggtgatggagcaagactctgtctcaaaaaaaaaaaaaagttataccatagatgtaagatctgtgaaccatctgtatttcatgttcgtgtgtacatatatatttatatgttgtacatatgtatatgcatattcctatatggataaagaatccgagattacctttcagctctaacatcaattataaaagtaatcaatgtttattacggatttgccaggcaccaaactaggtattttattttattttatttattgagacagagtcttatactctgttgccaggctggagtacagtagcatgatctcagctccctgcaacctccacctcctgagttcgagcaaatcccatgcctgtctcccaagtaggtgggattaaaggcatgacccaccaccctgggctaatttttgtatttttaatagagacaaagtttcaccatgttggccagtctggtcttgaactcctggcctcaaatgatccacctgccttggcctctcaaagtgctggggttacaggtgggagccaccacatccggcccatactaggtgttttataagcgtgatctcatttaattctcatgaggccactgtcaggtaagtaatataattcccatttggtagttgaggaaatagtgcttgattatgaaagcctagctggtttccccatgcattttggcacatcaccaccagccacgccttggctgccaggtccctgaggtctctggaggtcctgccaaggaagcagatctattccgtcacttcaggtgcgccgaaagctgggcaagcctctggcatagtcttctctggtttctgccggggtgtggaggagcatgtgttagggacctgactgcagggggatttgggagaagtagtgaaagggaccctgtcctgagcaggtgcacatgcaccaaggttaaagtgctgtacgggtggcacgttatggagatcagagtggctgtagtgggcaacatggtcagatggagtgggggatcttgagggcctggatacagaatttgaacctgaattaaacaggtcacagaatcagcatagctttgtagggtccctgaaaagcatattggattaatctgttctcacaccgctaataaagacatacctgagactgggtaatttataaaggaaagaggtttaatggactcacagttccacatggctggggaggcctcaaaatcatggcggaaggcggaggaggagcaaaggcacatcttacatggtggcaggcaagagagtgtgtgcaggggagccaccctttataaaaccatcagatctcagaagacttattcactatcatgagaaaagcatgggaaaaacccaccctcatgattcacttacctcccactgggtccctcccatgacatgtgggaattattacaattcaaggtgagatttgggtggggacagagaaccaaaccatatcacatgtggtctgcccagactgtcccccatccctgtgttcactgcccacccccactagagtgagcctttccaggctgctgttcacagtgctgtgctctgctggggagtccatcccctggccctacccctggagtcacctgcctcccaaggattctgctgtcctttgggagcactcagccctggtttgatttggggaggagtatggttctagttttaggctgtatctccttctcaggcttctcagaatcctggtgattgtgtccttgtgtggttggaagggctttttctctgtggctggcactggcatgcgaatccccatggggtcccatatccgtgggtgaccctcacatcttgccctcaggttttctttttctagtacttattgatgagagaatttttccccatttcagattagaaacagctatgctttccctcagaagattgaaaatctttaaaaaaaaatgtttggctttgttttctatggaaaatggaagtgactctgttttgaaactgatgtaggtgaccttggacactgagtgaaatgctgggctttctaggttgcatcagccagaccgagggaagatttatatctcatatcctgtttcagttttttctcctttttccttgcttgtgctgggaagcctccctaactttcatgttcatttggaacctgctccctccccaaggcactctgaatggtctcaaggacataaaagctagggagatgggaagagattttgcaagaaagattgactttttgtacatgacacagctgaattaagatatctttatggttttatgatggccatgataaaacaccaacaacttgccctatttctaaaaggaaataaaacctaacatgcttacaatagaaaaactgacagtctgttagctcatcaccagacagagaatagagtgagggcaaggttagggaaggtgggatgggtatggggaagaatcactgtgagcagggagagattacatagagaatgctgtggtctgaatgtgcctccctaaatttttgtggtgtaaacgtgatccccaatgcaacagtgtcaagaggtgtttaggtcatgaaagctctgctgtcatgaatggattaatgccattataagaaggatttgtggaaggagtgcatttgctctcttttgattctctgccatgtgagggcacaaccttcctgccctccagaagatacagcaacaggcaccatcttggatgcagagagactgggccctcacagtcagtgccttgatctgggacttcccagcctccagaactgtgagaaataaatttctgttcttcataaattacccagtctcaggtatttctctttatagcagcaaaaatagactaagagaggaaaggcacaaagaaaagaagagggagagatagaaaagagggaggagaaggaccacggaggaggaaaagaagaagagcagcagagaaaaaaaaaaacagaaataacagaaatgcatgccatggctcagagtctctgatgtggcaacagcatcatattgatattactttggaatcattctgtaaggaaaataaacaatcaggaaagaataaacacacaggaaaatctttattgcatttctaaataacatggaaaaattataaaattaaaaagtttcaaaaatacatttgtaggaattgtgctttcccagcctccccatcctacacggtgcactcggtgtgtgcttcctcagtggtggttcaggactctgggctgcctcttcagggcctctgtctaaggtggcacactcgcctcctccctagccatttgggccgtcagcactggatctgtgtggatttctgtcttcatcttttattttcccaaaggcaggtctagaatagtctctggctcctgtgttctgcactgtgctggtcataatgaggacaagagagtggagccaagagtcagcctgtgccttggagttcactgtgttgttggaaaggagaattctggggaacagtgatgccacagcccatcccactaactgtgatgtcacatgaaggtctcctgcccccctgcagggtgtgctctgttctaggcgagttgctgaaagttaacaaaggcagtagctgccaagtttatttccagtctacatagttctaatgagatcacctcttatttacaaaaccaatagagtgtctgctgatactcttccctcacccccatctgaataatgagaaattgaaaagaacaacagatacatcaacccaagacccttagattttgagaaggaggcctcagtctcctccttaaacatacagtttggtcaatacagctgcaatgggttttccccaattcaaattaagaaatcagcaaagccaggggccctagcatttccttttgacaaagagtcagatttatcttaacctggaaaggttaccttgacatccagttgcctttgccttatacagtcacagagttgataaaggaagtactggagcagaaacatcttgtcactgtgttttcataattcatcatttttcttccatgaaaggcaacaagatgtgattttgcagcctgccagaggctcattatgcaatgcatatttgcagatatttgagactcatagccaggggagaaaataatgcattcgtagccaaataatgactttttaaaagaaagaaaaaagtgttttcaataaagtgtttctttctatttacaagagccaatctttaaactctccagtcagaggtaagaggcagatgccaggcccatgacttatcacaggatgtggatttttttctcttcatacatctggaattctaattaattggagtaagatgattcagtctatacagcatggccctttgtcacccagcacagagagtctgtctctttatctctatggatcctcttttggcccaaggggaaggcctcagggccctgagcctggcaaactctcacctccttgctgcctcttaggggtgcctcagggcgctggcatggaagcttccctgtctgcattgctctccaggttagcttgccttgctctgtctaagttcccatcagccccattggatctcatccttccatctgtgccccatattgctgatcacaggtctccagacttcctttctacttgtgtgagggtgtgcaggcctccctactcctatgtaggcctatctggaggagccctggccaaggccctccttgcacgcacgtacacacacatacatacatgctcgtgctcatgcgctctctctttctctgtcatatacattagagaacctatgagcccacccgccagccaccccacccccaacactggggacattgctgaaagtttgtttaggactgcaaaatgaagaaaaaataagtaacgtggtgtgtagaatggagtggtggaggaggggaaattgacagggatgggaaagctgggtgggaagggttagctcagtatcacagctgtgaggtgagagtagcagtggaaacagaataatgaaaaaatagagacattttgaggactagccttctaggaggagatttctggatataggaaaataaaaggaatcaaaggttgggggtcacagtttgactctgcagctagaaatatggcagtgccaatggcagtagaagagttggacattggggtttgttggcaagaaaactttggacacactggtttggagatgaaggaaatattcccaaagagagctaagtgccatggagcctggtgctccatgtgccccaggagacactggctgatgggcaaggagaggagattcggtgagccctctggtcttggagccactggcatgtcactgttgtgtgatctgctcagatgacccaaatatgggggtgagagctgaagacctttgtaagttacgtaatgtaaataatagaatcctagccttgaagagatggcaatgtcatgttaaaggtgttcctgacatcatcagtcccattcctcatacttctagatgcagagggatcatcaaatcatttgcctaggttgcccaggaatactgttgcatgctggaattggtggaaagccttcctttttcggacatgcattacctgtcattaaccaaatgcttgtgcattgttttgttgaacaagacactctgacttgctgtggaagcaaagtatttacaggcagttaccatgtgaaccctgtccaagctaaacttgatggctgctacagatagtacttggggatataattttcagctcctcatcatactggttaccaactcttctgttcatgtagtacaaagaatagtaatatggtagctgggatgcgatgtcattcttccacaaatcccacctctgatatattacatcttttagcagcagccttggctgttgcctccgtttgaaccggtaatccactaagccttccggatttttgtcacacatttttatctgccagtttcttccattctgcgtgtctgcgattgattgattcacgtttaaattcagggccttgcatttttcccccattgattgtgggccagagttccagcctcaagataattaagaattctgttctgcttctttctcttattaactgttagtgctaattttatttaacaaaaaatgaataagcagatcttccatgccattgatgaaaatgtctagtgggacagagacaaggaatgcataaaccagtgcagcctgcaggttgacactgatcagtcaaggcattttagggtcattgtacaattagtgggaagccgttgaactctgaccatccagctgtgtttcttcattggggtcacaaggccttcctggaatcacgatatgctgcatctgacagtcagtgccagagctttggggtcacacacgcctgcaccatccttggggtgggttgctttttcatctacaaaatgggagtgataatagtgaagaagacgtaaaacactaagcaacaggagatgcccagtatggtttcctgcccctgccctaggagtacagggttttattcttttcccttctcctcccccaccttgttgaccttccctgtggcttaaggcttttgtctcaaagaggagaagcctctggctggggtttcccctccttttcacagtgctggctgctcccttcctcctttagggttgttgctgttctgcctgctgtgtggctgtgcaccgctaggcctgcactactgggaaagtttcttaggtcccagccctgcccccagcttctttgtgagtgccatggagagcagcctactggtggctgccaaatccctttgtgtctgcagttccaaggggtttatgctctcatggtagcccacagttgacatttgacaatttgctaaaactattatctgaggttttattgtttaattattattattattattattactattattattattttgagacggagtctcactctgtcacccaggctggagtatagtgacacagtctcggctcactgcagcctcaacagcccaggctcaagcaatcctcctacctcagcctcctgagtagctgggaccacagggaacacaccaccacacccagctaattttctgtgttttgaatggagatggggtttcaccatgttgcccagtctggtctcaaactcctgagcttaggtgattctcccaccttggcctcccaaagtgctaagaatacaggcgtgagccagcatgcccagcctgagtttttcctgctgctttgtataaatggcttcattttcctcccctaccctgcctcagatgatagtccattgctggcctctcaccctttctgggtggatagaacactctccctccctagatttcaggctacttggttttcctgcaaccccaggtatatgatgggctcaagaaaagttatggcgtgaaagattgtttgtctctctcttattattaggttgggagtgacactcgacatctttccagctggaagccagaagtccaattgttaatattataaaaacactgtaaatatactgcaatagcatgagatgtactcagccagcaaattctatatggtccaggcaaagggagttgctagaacattatagttagttccttgaattgcactattgtcttaaatccatccttgatattggatgttgtgtttataattcccacattaattgaattgaaatatatttcattaatagaaattcaattaagactaatttttttataattcagttaatgattacagattaaagaaaaaatatggcaactgggcatggtggcctgtagtcccagctatcgggaggctgagacaggaagatccctggatcccagttcatgatcagcttgaataacacatagaccccttctcaaaaaactaaaatagctaaagtttactggtataatatggaaatcttgatagtaaaaaataactttttaaaacatttactgaatttttttgtgattacaaaaataacatactctctttgtataaaactttagaaatacaaaaaaagtaaaataaaaattacctagaaacactaccacataaagatcatcattttttggtaccttttcttctgattttttaaatttttcttacaaaattaactctgagtatattataagcatttcctttgttactacaaaatttttaaactacaatatttaatgcctacataatatacagtcatatgaatgtactattattcattcgacttttctcatcttgttaatcgaattgtttccaatgctgtgctgtgtttaaagagctttgtttctaatggcataaaaatatgtttagtgaatgaggttgtgtttgaatttttgcatgtttatcaacattatattcgatgagatttctaaaattccatgggttttaatggcatagtcatgtaatatttgtgttggagtcattgtgggtataaagtgccagcttcttcattagggctgttgctcttctaccggccacttggctgtgcatacccagaacactcattctcactgatttgatatgttagagtcccccatgtgagaataatctcagtaggaaaaaaaagggaaaaagcaagttttactagttattgttttaggaagacctcagagtgagagagaagtgattcaggccaggcctcaaagagggcagcaggctgagggggccccactgtccagacaggtctccagacacagggctaaacagcagtttcttccattcactctgagatgatcatcttcagggagctgattgtggttcctcaattcttaagaggcttgctgataaaccagaattttaacttacaaagacattatttttgtgaacgcaagaagcagaaactaagggtgcacctttgactcttctgcccctgtagcccagggcaaccagatgagttttagcagttggaggaagagtagaagtgggtggctctaatctggaagaacatttagggaaatgcagaaacaccaaagtaggcagcatgctgttccttccagagagatgttctgcccttttctaggagagttggatgagcaagagtaccagaagcagcacaggcttctgggagcctgcagggttctgccactctctactctagcccccatctgccagcccttctccccctactccaaagagatgtgagctgcctgccacactcttctaacagcacatttgccaaacctgggttttagctgttcattttcatgtttccagggctggttatttacttaagagagttctttcacctttattgttactcagaagataatatttgtcacattttcccaaggcttaagtttttgcaccagagtgaaagatgggaacctccatagtatagtggaaagaatcagattgacctgggtttttctttaacttcttccagaaatgggctatgcgacaagttacatagcctccttagaatgtgaagttttgtatttgaaaatgggaatgctgccaactggaaaagtacccaatcttgttgatttccctcaaccacgaatttcattctgcatatactatcaagatgctccttcgggcaatatcttagtgcagggattttggtattccttagtaaacaataaaagatgtgcatgttacttttttttttttttgagacagagtctcactctgtcgcccaggctggagtgcagtggcacgatctcggctcactgcaacctcctgccgcctcctggcttcaagtgattctcctgcctcagccacctgagtagctgggattacaggcatgcgccaccatgcccagctaatttttgtgtttttagtagagacagattccaccatgttggtcaggctgaactcctgacctcgtgatcctcccacctcggccccgcaaagtgctgggattacagacatgagccaccgtgcctggccgcgtgttacattttgtcaattattcataattaccttgaatatctgaagagaaagttagccaagtggatgttttctgactcttgcccacttttattaatggttctttaaagaagctcttactgacaaagccagtccccaaaaaaggggggtctttccctgattggtgctgtgaagccaatacacaaaaccaaaagtgagcaccaagcagtacaggctttattcgatggccatggaattgagaagtggaagcgtggttcacaaatcagctcctcagttcgagagagtggggaagtcacagatacagggcatcttcaatgaaggggttggggcattaaaagcaagggaaggaatagtcatgtcttttctggagatggtggggggaacttctcaaagtagaatgccacttttctttttgtccttttatggtttcttctcattgttgtcatggtgattatcaactgtcagggtgctggtggaagtgtccttttgcatgagagttagatgataatgaagttagaaactcttcagaggccaagtgagcggccaccctggatcccagcagtcggagccagtttagtcaggagggggagcttctgacctcaggcatcgtatttcccaaaggtaagcagagttaaggtaggatagaaattcacttggtcatgtaggcgatttccggggtaacacaaccttcatctaagccccagaattttatctcaatagagaaaatgccagccaggcgcggtggctcacgcctgtaatcctagcactttgggaggttgaggagggtggatcatctgaggtcgggagtttgagaccagcctgaccaatatggagaaaccccatgtctactaaaaatacaaaattagctgggcttggtggtgcatgcctgtaatcctagctactcaggaggctgaggcaggagaattgcttgaaccctcgaggtggaggttgctgtgagctgagatcgcgccattgcactccagcctggtgctggaaaaaaaaatagaagaagaaaatgccaatttgtagcactatttattgttatttttaattattttgagttgtctgctatattttacattctgtaagatttcctgttcgctagcaaaatcctaagggctacccagccttacacttggttactataccttctgcaaattgcattgtgtcataagcaggttggccatcaggccctgaggctggaccacatgggttcggtgctcatgacttcctgttctggtggatgtgccaaccatagtctccacactctcccttgaaggacacctgcaaaacaagacccagagttctgtacttagttaatatgtttgggcctatactttatttctggtaatatacacctcatgttacagataacctgttagaggtcgggaaggttgagatttggagtctgggatgtctgttggattgtttgataaccagttacgaaggctttagggcacactctgagctgcttgctcagaaattctgagcttaagtatatggcattgagatacaatgtttaaataaagagtttgtatcctaagtcacttgagatctttttttctttatagtaatacttgtatattctaaagtgctgatgagcttgtaaacaatgtggtaaaactttatagatcaagttatcttaccactttcgaattcagttttaataaccagcatccatttatataacatatatttatgatgttttagtggaaaatgaaacaaataaaatgaagcatggttttccaaccccctttgtaatttcaatcttgaggtttggaaattgttttcttttttggctgttgaatttttagaagagaaattaggaatttgaagattttttggaattcttttatttttccttaacgagcagcatatttgacctgctaagtatagttcttgtatttctgtaagtgcaataaaagatgaaaggacttccagtttgtttttacgtgtaaaagtattaagagactgtctttttattaccttcccacatatttggtgattacattttatctgaaatctagatacacaggttctgtacaggcaactccacactcttcctgtgggttgacctagaaaataaaacaacagcaagaacaaggctctttgttgacaccatcctgctacccttccctccagcccagcctccctgtcgcagagctgacattgagccctgtgttatttatggaatatggaggttcaatccctggactgaggcttgacttgacaaatgttacttccttgggtcaagaggaatctctggtcctctgaaggcttttagcctttattttgagagtgcaaaatgatagctgcaatagaaagtaaagctcagctcagtaacccccaaaatgtgctaaatcattatgaaatgtgtaacaattcacagccatctgtatattcctgcttttgcaccccccgtatgcaaggggattatttcagatttctgttatatactgtgatttagctgcatgctttagaacaacataaacatagtctttattataacagacaactaaaaatggaatactagtatttcctagattgtaattaaagaaaatgtaggtaacagaaagcccaaaggctggatctagagctccagtgtgtttctccagcccaaagaaagtgaggttgtttgtgtgaacaggaccccaaaagccatcacatggttcttttgctccatggaagctggaaagggctggctggatccagttctgagccttgctctcatctacaatgccggagctgtcctctaagaaagctctctgtttgcatctgtcctcagcaacccggcactcaagacgctgttgaaagtagaagcagagaatcttggattcgcagggaccttacatggggtcagccagtccaccctctgcaggctctgaactccttctgcaaaggccttagtaagtggccgtgcagagcctccagagacagcgaatctactccctctccaccagcttggttgtcttgagaccactgatgctgatgctgcctgcttgttgccctgtactcctgtgtgactgctttgtgactgctgtgtcttccatggccttggatgctccataagaatgagaatcaattccaattgatttctctcggtgctggacaaatgggcaggtgcttgagcctgtaagttgtagtgaaacccttcgttaccacgtgaaggcatgccaggcaaagctggaaatcagaaagttcagattggagtgatgctttgctgacatgtctgggccacactgtggtgtgtgctctggcatccttgcagcttgttccactcgcctcgtttgtgacactctctcttgctgccacactgggcctgcctctccttctccgtcattatcctccccgatttgcctcttctcagcagacgtgggctgtgaatcttaatatccactccatttattataaaatgtgtctaacataagcgcaaggggcaccaagggtggatttttaagagctatgggatgagcagtgtctttggacttggagagggtgtgtggcctccactgtggctgttccaagcttccaagggttttgactgcattccagatacatgagggcatcagagtaagtgatttctggattaatgaggttggctcatagaattcttttgatggaatgtaccttttttactttcaagttgatgcagtaatgctagtaaggtacttctgaggaggatcctgcaggacatattttgacgatgagttagtatgtccttgaaattagtaccatgcatttctacaaaattagtgttctagtgctcttttttcctaaagtgatttaactaatatgcttattattaatttacatagtaaagcttccaaaggtacatccacataaacttaaactcagtagaagccaaattcatagaaacctaaaattatgcatcagaagatgtttggggatttttttaaaaaaacaaattacagtgccaaaaaagctccaaacagagcctgtatcacagaggagagaaagacaggaataggcatgttgagaccaatagaaaaaggaggctttgctagaaaacagtggtttcttaattagagagccacatgtaggagaatggcttagggattctgggtgcctgagaccgtatcggtcaaggccccttcaccacagagatactcagagggagcctctgtgaggtgggctaaggggccttgctgagaccagctaatggggggagtgggttgggcagcagccaggttctttcctggggaggcatttagaggcttaaaccacataataatagtccacccactgaggaagttgccaagcctgaacttgctaggtctttttatttacttgaagaaatttcttcagccctaaacgtacaaagcacaactcgtgatgccataccttctccttcaacctccaaccgtgtagttgagaaaaatacactggaatgtagtctattcctacagaatagaagcagagaagcaatcgtgggcctcaagttatgagggcagatactctccgaagagttcccagcactctaaagtactcagctccctgtgtggggaggaggttacctccagaatggcagcccagggcatgacttgccctcatcgcaatggttggggcggaggcggggcttggctttgctgggggctactacgaggtgagaaagggaggctgggggctgggagggctcactccacacagcatagagggatggattcagaggacgggctggcctacccttcacacatatgctgactgaacagctcatgggtcagataaagcctcttcgctgctgtgaagcttacattcttagaggcaacagaggcatatagtaggtgaacaagcgtctgtagcaatttcaggtcatgataaaggacgtggatagaaaaggccgagtgtagtggctcatgcctgaaatcctagcactttgggaggccgaggtgagaggtttgctggatcccaggagtttaagaccagtctgggcaacatagagagacactatctctacaaaaaaaaatttaaagaaaattaaccagatgtggtggcatgtacctatagtccagttactcgagaggctgaggtgggaggatgacttcagcccaggagtttgaggctgcagtgagctgtgcttacaccaccacactccagcctgggtgacagaatgagaccctgtctcaaatgaaacaaggtggctgggcacgatggctcatgcctgtaatcccagcactttgagaggccgaggcaggcagatcacctgaagtcaggagttcaggactagcctggccaacatggcaaaacaccttttctacttaaaatacaaaaatcagccaggcatggtggtgcgcacctgtagtcccagctattcaggaggctgaggcaggagaatcacttgaacctgggaggtggaggttgcagtgagctgagattgcaccacttgcctccagcctgggcaacagaacaagactccatctcaaaaaaaataaataaatcagggtgatgtgttagtgaccaaggggctcctttaagtaaaagagtcaggaaggcattttctataatgagaatttctctgatctgaaggatgaggtcagtcctgtgatgactggttccaggtggctttcaggcagaaggaataaccagtgagaagacgctgaatcatggatgaactctgctgtgtgaaaaacgctcacacaactgtagagcttagcatgtgaagtgcactgggccggagagggggtgtcaagaaaggagatcagagggcttggcggaggccagcacagaaagcctgctgggacaggcagcaccctgagcatgatggggagtgattgaggcttgagagaaggagggtgcagtgttcactctggctgcggtttggagaatggacttcagaaggaccaggccagagcacttaggctcttccagcactggtgggtggatttgctgtggagatggggtgagggaagtgcaggcaaacccttcccagtgcttagggtggtggggctttgtcctaaggtgggggctttggagggagcaggctgggagtggtaggtggaagggggtaagcatgaatgaaaattgagagttctgttttggccacagtgaatctgttagcatctgagtggagatgtcaggagattatatgatgcctgctcaggagtttggtcaggcctggagtgcaatatttagcatctgatcttagatggactttcaaaccagggcactggatgaactcacctagagagtgtggaaagagagaggaggagagtaaagaggagtgaactcagaggtcttcccacactgagagactgagcacccaaaaagaaccaatgaaaaaggagccactcaggagactttggttgcccagaggcagaggaagttgtttttggagagagcagttagttgtcacatggtgctgagagttgagcaaaaatgggcagagaagtaaccactggatttgataccatggaggccactggacaagtaatcccagtggtggtgatggaagtcctatcatattggggtgatgagtcagtgggaagttaggaggtggagccaggggctgtagcacctctttgaagaagtttcctcatataggggagctgagcacctgggcactggctggagagagatgtggaattgaggaaaagacaaatggtgtgcttggtaggtatgacagcagaggagagggaagcaagggggtaaaggggttgcatgaatgtggatgaatgacttggggtgagtggtgtttttaagctattccctgtggactgcacaacacagtcccctctttgggatcccccaaatttacctataaattctacccatgtcccctaacactgtgatgtgggcagatgtgtctgagaggcacagaatcttccttgggctgcagaacacaggaagtagctggagctgatttgctacaaccagtgatacaggctcaaggggtgggcgagaggtcatggattgattgacctggtcactgactgatttattcagtcaacaaacaccttccagctccctctgtgccaagtgccattccaggccctgcagccacagtgcaaataagccccctcaaagcgcattttgcccatagcgggatggggccactgacaagccagcagcttggggtggaatgtacagcccgaggcaaccttgctgtttctcggctgcacagtttgaatccatttgcaggaggtgtatgagttcctttaggaggaggcttttggaaggaagtggagtcaagggcaaaattgtgggcaagtccctgcagcagcacctaaggggccccggaggctgacccagagaccccaaggctgccgcagccccagggctggtaaagctggggttagaaatctgtggcagcttcagttgggaggtttggggttttctgtaggtgaataacctgtgacctccccgagggtgcatactgagggagggcttctgcctgtgtgagggaaggcctctgggcttcatgtggctcctggcaaatgctgagccctggatccagggagtaggggttctatggctccaggcggccttctctgcttggctttaagaatggggtacttggttccggttcccttccacctaagctggctgttgtgactttggatgacttgtttaacctgctgtttctgcttcttcacgagaaaaataagaatggtgcttatgtctacctcacagtgttatagctggggtaaaacgaagacgtaatcgattcagcacatactcgtgtttgagagttgccaggtgtgagttctggagccatgcgtcctgggttcatgtcctggtgctgttttttactgcgtgactgcaggcagggaactttgtacctcagtttcctcatctgcacaatggggatggtactaacacctgccttctgaggtgtctaatgagggattgtgaggatctgtgaaggaatctgtgtaattgctgagagcgtctcatctaggaagtgctgggtgcccgctgcggttaggaagatgctctctggtgcacagggccttgttggcagtgatgtgatggttttatctcttctgccagttccgcctggtggtgaagacagccctgaagctgctgctcgtctttgtagagtactcggagtccaacgcacctctcctaattcaggctgtcactgctgttgacacgaaaagaggtgagtagtccctgcccccttatgtcatgaaggtgaaggtgtctaatgtagggaggcttctgtgttgtacatgcttgagacagatataagaattaatagaattcccgagatgtggacttcccactgcaagaaacgttttttaggatagtaagcacacaaagcttagggccggaatggggtttgataatgaaagaaaagtgctcatgagcttacctgggagaggtcagatcctgagcttgtctttgcctctacccagctcctgccactgaaacacagaagtctagctcctcctcctgttcttcctgtcttgttcagggtttccctggctccttcctcccctcccctctacgcttcattgcttatgacccccagatgtttctagaaccttctcccttcctctcctccatcccctgccctgccttactcaggccctcactaggtttaacctatgctcctggccaccctcccaaacagttcggtcacatccaaaacctgccagtggcttcccagtgcttatagcataaagtcagtcccctggctaaggggacccttcacccttcaactcctgcccagctgccacccccttctcccacctcggctgtacccccacccccttaccttgggcatgtgcttttaaagcccatgtatgcacctcttctctgctgtggtggtgttgcccatccctgtctctccaagtcggggttgcctgctcaaggatggggtctctgtctcccagagtgatgtcccagcactccagctggcccagagccagcaggcatgctgcaaacacgtggcgaagaacgagcttctgctctggtttactgtgtaacgtgctgtggaccccgtgatattgggaagcctggaattaaaatgcttcccaattaaaatgatttttctccttttgtcttttgttgtttgttttcttccccagtaggactcaggtattattatcatcatccccacaaagactcaagaacaaaaacttgacaatactttttctttttatgattataactgtaatactactgttacaatcataaaaacttgggaaaagtttaaagaagacaataaaaattcacctctagtttcaacaaagataatcactgttaacctgttggtatatttccttatagttgtgtgtgtgtgtgcgtgcacactatgcataaaccagccaggatgtgtcgggaagaaacgaggggcctaaattgcacttttgattcaaaccatttgtgtctgtgatttttttttgtttttgttttttgtcttttgtttttgagacggagtcttgctccgtcgcccaggctggagtgcagtggcgcgatctcggctcactgcaagctccacctcgtgggttcacgccattctcctgcctcagcctcccgagtggctgggactacaggtgcccaccaccatgcccagctaattttttttttttttttttttttttttttttttttagtatttttagtagagacagggtatcaccgtgttagccagcacggtctcagtctcctgaccttgtgatccacctgcctcggcctcccaaagtgctgggattacaggcgtgagccagcgtgcccagccagttgtgtctgtgatttagcattactcagacccacctttgaatgctgaatccaaatgtgaaagaaagtagcttgagttattttagaagtttaaatgaaagttaatgaaaagcatccaggacctttaactggggctcctatacccttgaacatgcagatagatgtcggcactaggcatggctgatggcaggcaaggaggcaactcgaggtctctttgttgggggtgtgttagggaggcaaactctagtacatggacgggggctgtgagtctggaaggtgtttcccaggctgaggcaagtttcttctgccacaaaatgttgccctctgctgctaggtagaaagacccttatggccaagagtagatcatggggccggcccagaatccttgataaggaatgccaatttcacagaaaccaggtctagcatttccaaggccagtcaattaggtataaggtcagcagtgtgtgttttggcagctggtaggcagcagcttctctccttcatccttggaggatttgtgtttcatctcctaactctggcggttgcttgaggacaactaacaaactcttcatcttactgtcctaagcttcaggtaaccccagggcccttgctatgggtgtgggttataggggccaacgtctcatgacctgggttctcctttggctttgctgagcttccagctcggagttcccttccttgaacttcatatcccataaagggaatgttgtgatggatgagggcatgatcctgaaatgaacccaggcctttgtgtatcatatccaagactccatccatagccccagccagagattctcgtctgtcagaccaagtctctccatcaagataaaacaatggccatcttttcctgattagtaaaaataataataataataataaaaacagctaatgaattgtcttcttagctttattgtttttgtttttgttttgttttgttttgtttttgagatggagtctcactctgttgcccaggctagagtgcagtgtcacgatctcagctcactgcaagctctgcctctcgggttcacgccattctcctgcctcagcctcccgagtagttgggactacaggtgcccaccaccatgcccggctaattttttgtatttttagtagagatgggctttcaccgttttagccaggatagtctcaatctcctgacctcgtgatccacccgccttggcctcccagagtgctgggattacaggcgtgagccactgtgcctggacagctttatagtttttgtctatacaatttcttaaacctttggcaactgctgttgtctgtctgctgctgagcactagcagctgaaaaaaaaaaaaaaaggaatggcactaatgaaaaaactcagaaatagcttatcatgtgtggctcaatagcatgtttctttatggacatgtgtggtcttggctgtgattttataatgcatacatataacgtcatcctattctactgctagtagaattgttcctgaatcctatgatggaattaaacatataaatatgccatggtattctgcagagagcaacattacttccaggtgtgtttccatctagtgggtttagaagcagctctccggttccctctcaactgggtgagagagcagacaggtgccagaggtgatttagggtaaactgagcatatccatttgtgcacaagtttataaatcataaattttacttctcaaagtggctttagactcattcctcagcagggatgagtggacatatgagcagttgtctttttgaatagtttctttcggataatgaaaactgtcagatttaaggaatcagcaataaaaccaacaaataaactcccagtcctcaaaaatcattactacctaaagcaaatgaagttgtccagaacaaattcctttggttgcattataaatataaacatcatgcatgctgcacgtgggctaaccagaaggcttcattctgcagtgtgggcaatttggtctggggccaagagtgggccagttagcagggataaaagccaaaggggttaaagtccagcgtaaggagtgatcagtgtttatgaagaaggaaatttgtttttaaattttttttttttttagacggagtcttgctgtgtcgcccaggctggagtgcagtggcgcaatcttggctcactgcaagctccacctctgcgttacgccattcttctgcctcagcctcccgagtagttgcactacaggcacccgccacctcacctggctaattttttgtatttttagtagagactgggtttcactgtgttagccaggatggtctccatctcctgacctcatgatccacccgcctcggcctcccaaagtgctgggattacaggcgtgagccaccgcgcctggccaaagaaggaaaatttaaaatgttccatttgacccaggctattgcacttttgctcagggcctgagataaaaaggtggattcaggttcatctgtggggcatggtatggtattaatatcagaccactggatcatcttctctttgcttgcaccttgaagtcactttctctttctggtggccagggcctggcaggaagagagaaaggctcatgggagcccttagagagccttgctttgtcattttgccatattggagactccctttccttaaggtcttccctgtggtggttgacaggaaattgattgacacccctctgctgtctgggtatggggtccttccttttgagtgaacaggtttgcctctcccacagagggtgaggcaagtgaccagagaggataactcatgttgaaatttgtcctaaatctcaggtcccactaatctggctcagcagagcttttgaagtagttcaatttttcatttgataattcttaaacataagaattcctgctatcacgcatgattagcaggaaaaaaattcagccatcctttcaagcgatcccatctctactttctgcttaagagtatatctatctgtgaagatcgtgtaaagtgtagtggaagctacaggttgacagaactcaaactctctttccactgttatttatagcagaagcatccacattgagtgtgtttatgtagtatgtgaaaagacatggaacatgctgtgaggagcttctgttttcgtgttagaccaacccatgtctgaggcactgagctaaataccttattttccttcagatttaatgtggagatttaggaaagtaagaggggagaagtattgagcaattgattctgtgtgtatttatttatctgggttaagagaggactggccggggagtcagtgcaggtggtccacctgggggtaaactgggtatctccaccaaccaccaccattacaattacagctactgatatttgagtatctatcatgtaacagacacaactgtaaacattcttcacataggacccatttattcagcacatatttgagtatcaattgtgtgcttgcagtcatcaggaaaaaaggctctcacagaacctgtactccagtgtttggggtgggggtggggggcagtggagttggagagagacagatgacaatgattaagtattgtcttctaatgtactccagcagcgctaaggaaaaaagacaaagtgctttatctcaatgacaattctcagtaatcctgtaaggtaggtacagtcatcccagaggccttaggagctccagatgagcttcctgagcccctccatcccactcctttgggatccagtttctttctctgttatgtgaagggctagcattatatggtttatgattccagtacaggaaccctctcctctgcaacacacacacacacacacacacacacacacacacacatatgcacacatacacacacacattgtggggagttaacaaaggcaatgaggagagtgagtggaccccataattctgacaggagctcctaggaaatgtgcaagtgctggtgttgaacacaggcctagcctgaggcctgccaaggctatttttgttgaaccaaatgtttcttcccttttaccttcattgtaaatatttccgattttctgccccaaaacaataaaaagaatgaacatccatcctaagagtgtacaaatatatgcacatttccagacttaaaatccttagatggtaataagagactcagataacacagctaaaaacacgtttttcagttaaattaagccagtgtttgagtgttcttattataaaggattagatgcacacatgtgcatgtgtctgtttaaggggagtaccaatgtagtctggctacctttccctctctctctgggctgcctgccattgttccttggcctttgctccctgaggacctgtttcgcatctttggctccagagtaagcaaccaaaagtagttctgggtccattagcaccactagaaagtcttagtttcgatactttctcccctgcacattcttcctttgagccatgcatgggtaactcactacaacatgtgttctatgccaaggttttatacaaaatgtgaatgttagaagctgcccctgttacaaacacaaatggcggcatccagatatcttaaactggacagtgagacccaaggcctgctgatcagattgattgactgtcttgagagctgagatggttactttgcagtggttggaagaacaactacaccgtggtgtggacttcaaagtagtttgatgatcaatatcagcaaggagataattcagtagtcagcaggtgaaaggagaaagaacatgtctttgtgctcagttagcaagggtcatagaagattgcccagttctgactggctgggcaacttagccaaagcaaaaggctttctattcacttaggaaagccaggagatctccatattgagctacatttgtgccttttacgtcttgtagtaagtaggtacctattctttgtttaatcctcttaaacaaatccccttaaatcctgtcttctctgcttttcttactgtgtgcatctgcttcctggttcttttaaaattgcttcagcttaacccacttcctgccttctcagagatctccattcactattcagcagacattttactgagcatgtactatatgccaggcactgtcctaagggcatggagatcaacaagacagatactatcatggtccttgggaaacttttgttctcaaggccaaaatcagctctgacatagcccatccaaggaccagcatttggaaactactgtatttaggttatttccaagtttacttttctcaagtaaaaataagcaatatccctttgagatctttatagagaaagcacgaaagagcttcatgtcgcaaaccaccaagccaagagcaaggcaattcttatttcacttcacttcaaatattcatcttgggcctagaaaaccatgtcaaggtgttatgtgcctctttttggtcttgcccttggcttagtggtcctgaatgtgaatgcggagtatctcctgtccctcctagatcctggaaataaccacccataagccttcgcctgcagagcccaggcagcagtcatctcttgtgccaagtcccctgcagtcatccctgctgcaagagacctcacttgcacagtgacaggcttagctgcatgcttggacacttctcagccattgctctgtactggtgtctgttcttgggcttatgcctagctgctccattagattataaacctattgagggcagctgcccagtagaccttgtacctagctgatacttaatagtatttgtgccttgatggagtagatgtaatatacttccgttcttgagatatttgctagacaggcatgtcacttatttctttgagtcactgctagagggatgttaagatcttccacatccccttttcttctgtgctgatggatattcttagagtacttaccaagagttttctaatctgtaggcctacagagttgcaatgattggatttttaaaaattacatatttaatatgaagaaattttcaagcaagtaagcatccagacactgaagcgtacacaatgctcttgccaaaaggacaaagatgatgtgagatagggttccctactaagaaatatcctcaattagaagcatgctcaaatccatcctaaggataatgtcacactttgaaatttggtgactgaaagacgctgccatcactggatacgtccttggataataaactgtgatgtgagttagataaagaatgttgatgaattgctgtttctaatgatttttgctttactcataggggtcaaaccttggtcaaatatcatggaaatcctggaggaaaaagatggagttgatacggagctactggtttatgcaatgactttggtgaacaaggttggttgactatgttatgggttgaattgcgtcacctaaaaagatatgttaaagccctgacccctggtatctgtgcttgtgggcttatttggaaatagtgtcgtagcagatataatctggttgtgagggtgggctctgatgcagcatgactgtgttcttataagaggaaaagagacacagagggaagacgatgtgaacatgcaaagaagacagccacaagaggacaggcagaggtcagaataatgcatctacaagccagggaacgccacagattgttggctgccaattgaggatgaggcaaagacagacttcctgtagagccttcagggaaagcatggccctgctgacaccttaatatcagacttctagtctttcaaactgagacagaataagtttctgttattttaagccacctagtttgtggtactttcttatagtagccatagggaactaatacattgtgaaaatctaaaattttccctctgaataagagccacaccatgtgtacacccatcacagtggctggaaccacagctgcagtgtgcagtacgggagaaaatcctttatgcgacacgtggagtggatgcgtgcaggtgtgtgtgcttgtgaaggcctgtgggtgcctgcgtgtgttcatgctttggtcttttctagtaaatccaggaaagtgacagtgagaattttatgactgcttttcctatcaagttggccccttaaaataataataataataatatattattattattatttgaggcagagtctcactctgttgcccaggctggagtgcagtggcacgatctcggctcactgcagcctccacctcccaggttcaagagatcctcctgccttagcccctctagtagctgggattacaggcacgtgccaccatgcctggctaatttttgtatttttagtagagtcggggtttagccatattggccaggctggtcttgaactcttgcccgcatgtggtccacccgttttggcctcccaaagtgctgggattacaggcgtgagccactgtgcctggccaaaattattttttaaaatcatttttccttgagggaatataaattatgaagttttactctaagaaaattgttcacatgtcaggaagacacgaggtgcacgtgttccactgcatattgaagttggactcttgggctgagataaggaatcctgggggtaggtcccacttgtctcacgtgatggtgaccacacctcttgctgtcattcctcctgttgcgtccctccctgatcaccaccttgtagggcagtcttggtccttggtgctcttcctcagaggtgctgctctgaaacaagggggcccatgctgacccagaacaggcccagtctcaggtctggagtttctccatttggatcgacatgccttagagcacaggcacctcgccagccaccccatgggccttccttgtactctccttacacgctcatgctgggtgtgagcctgcaggaccatctgcagtgatggttagggcttcagaaagatccagagtccattcctgaaatacagctggagaaacattttccctgatgaagtggggataagtttgtagaaagcagtataattatgaagagcaccttctcctactagagagtaaaatgtgcagactctgaggattacaacaatgtagtgtggccccttcctcagcagacagatgattggtgcagaggagctctgaaacagacctcagtgtatagaacaactcactgtacagttagttaacattggtggggacgggttaggtactgattggagaggtgttgttaaatggaagtaaacaaaaacatactttaaccatacaccacagtaagccccaaggagcttaaagcatttaatggaacatagcaaactgtaggaagaaaaaaaagagagagagagatgaagactaattagtctgtggttggtaacgtttattttaaaaataaaaccagtgaaacaggttccagaggaagagatttaactattttactgcataaaattttaaaagatcttatttacaaaatgaaaatcacaaattataactaaatgcaaatgacaaactaggaaattgtttacaaaaagaaaggtagaaaatgatgttatcctaaatatattatgaattcagtagaaaaatgaaagacattaaaccaactaagaacaaaagaaatacatatgaaaacaacaagacatgtttcccaggtcacattggcaatgattgccttttaatgaagtatcatttcttgatgaacacccaggaaactcctataaccctggtgggaaatgggcacaacttttctgaaacataatcctaagaattctgcttttattttcaaatctttttgtgagctcattttaccatttgatttgaagcaattttctgttggtttctaaggattaaagtcatctatttcctgtcctttttagtcactgccattgttttggaaaacaccgaattcagcaaaaatggaattttcacactgccacagtgttccccattgtaacattacctattttattgataaggccattcccagctattcttatgatcatagcagtacccacacaatgtggtactttgttgctaatcactggcagagacccagtgcctgtcaccctctgtttggcattctgtggcatttgatgtccaggaatccctcacttactctttctcttctggcagttctttctcatcctttgttagttctggccaaggagacatccagaaagatccttgaggtcattcattcaaatgtaatcctttccttaactcatttatgcctagtgttccgttattggaacgctaagcttgtgtgagttatttatatcctgcttctcaaggtcatcaccaaggtataatttttcacacacaaaaaaaaaaatttgcaacctccggcataaatgcgttaaacaagtcatgccgggtttgttttgttttgttgtattgtagtaatgcatgttgcccaatgagtaaactcctctgagataccaaacaaaataacaaattaaaatgttaatctgggtctggaaaacattcagactgtgaaatctgggaaattatattgcaagttgggtggtttctaagtattgatatcaacaaaataaaggcccctaataacatggaatttttaaaaatggacatttccatgacaaacaaaacaatgacactaagtcctatcctggtaactgttctaaaactgattgccttgtaaaataggagaaagcacactggggtgggaggtacaatgagtaacaagaggggttaccgtgaggctggcttagggtgttcagggaaagcaggaccccaggaagccatggggagaggagttgttcagtggggctaggggataactaacctggatggtacatgctgagtagttgcctttgtttttacatttacttttattgttttaaaattattgtcttagtccattttgtgttgctgtaactgaataccacagactgggtaatttataaagaaatcgatttctcacagttttggaggctgggaggttcaatatcaaagtatcaaggtactggcatcttgtgaggacctttttgccatgccatccatggtagagggcaagggggttgtaggggaagagaggagaagggggtgaaacttacgctctgttgggaacctattccttcagtaagtaacccactcctgagataatggcattcatccgatttacctcctttcaacactgttgctttggggattatgtttctaacgcatgaactttggggggcatattaaaaccatagcattctgccccctgtccccaaaattcatgtcctcctcatgtgcaagatatatccattccatcccattagccccaaagtcttaatgaattccagtacagactcaaagtcccaaatccagagtctcatctgaatcaggtataggtaagactcaaggcacgattcatcctggggcaaatttccctttagctgtgagtctgaaatcaaacaagttacctacttccaaaatacgttggaactggcatagatgttcacattccaaaaggcagaaataggcaagaaggaagggataactagttccaagtccaaagcccaagagaggaaaaaacaatattaaatcttaagacaccagaataatctattttgactccatgtcccacatcctgggcacactggggttggggttgagcccacaaggcctcaggcaaccccatccctatggctttgctgggctcagcccacgcttcagctctcctgggttggagcttatgcctacagctttcgcgggctggattgcacactggtagctctacagttctggggtcttgggggctgcctcactcccgtggctccactaggcattgccctagtagggactttctacagtggcttcaccctgtgacaaatctcttcctgggaccctaggctgtccataaccttcttttagatctaggttgaggtcaccatggctccacggctcttgtattttccacacctgcagaattagtaccatgtattttatggcttgtaccttccagagcagcaaggcctgcttgagtcacagctggggtggccaaaaaatcctgcaccagaattctgggagcaggatcctgagtggccctgagcagtgaatgctgaggtaccgctggtgcctgtccagaaaccttgccctcaaggtcctagcttgcttagaaggtctttgaaatgcctttggagtttttctcccatcgtcttggtgaataacgctggctcccttctatccatactataatccttttagcaaatggtcacttggtcatgcctttggtttgctttccaaaagatgcttttttactctttacatggccaagctgtgactttttcaaatttttctactctactttccttttaataaactccatctttatatcacttctatcctcttgcatcttcctataagcagttaagagtaactatacaactccttcaatatttttcttagaattttttttcaccaggtatcctagttcattgctcttaaattctgactttcattagagccctaggacattgacatatttcagccaagttcttgccactttaaaacaaagatggtttttattctggtttctaataccttgattctcgtttccatctgagacctcttcagaattggctttaccatttgtatttctaccaaccacttcagcaatctctaagaaggctctgacttttcgtacaactattctcttcttctgagctcccaccagagtcaaccagataatgctctagtcaatctaggctttttctagcttgcttctccaaatttttccagcctctacctgttacccaattccaaagctgctttcacgttttcagttatttgttatagcaacagcccacttctctgtatcaattttatgtctttgttttgtgttgctataacagaataccacaggctgggtaatttataaaggaaataaatttattactcacagttcttgaggctgggagtccaatatcaagatgctggcatctggccaggcccttcttttctgtgctatcccgtagtgggatacacagggtgagggaggttgtagggaagataagatggttgaactcatccatttaccaggaaactactcctacaataattaacccagtcctgagataacagaactaatccattcattacctaatcactgcttaaaggttctcccttccgacactgctgcattggggtttaagtttccaacacatgaactttgggtggggggcacattcaaaccataacaatgcaccttctagaatatagctatatgagttttaacatgtacatggagatggatcaccttcacaattagaatacagactaagaatagcatagtattcccccatgttatccttttatactgacactctgagctcctatatataatcctgagaaaccactgatttattctctgatcactgtaattttgtcttttcaagaatgtcagatggaatcatacagtaagtaaccctttgaggctggcttctgtcagtataatgccttttgagattaatcttttattgcatatattaatatatgcaatatattaattaacccctttccactgctgtgtagtattccttgtagagatgcatatgtgcttacccattcacctgttgaaggagatttgtgtgtttatagcttttggcttccacagatagagctgctatgaacattcatgtactggctttgccacaatggttttatcctacaagaaagacttggtgcaatcaatgaaaacccagggagggggaagaatgtcctttaggacggaatttccccctctgagagagatttgtaaagatttacttgtcacaggccttgtcaagacaaagtctaagaaaaaaacaggaggagggataccaagtgtcaggcagctatgctcggcacctttagtgtctgagggtgaaggcatcaggaaacatttacctcgcagactttcctggggaagctgccatttttgtcagaggtggacaacttagcagcagaggctgcagggtggaactgggaggggaggcccagggacaggtggaagtgtggtagaatttgatgagcctattagagaatcagccaaaaaaaaaaaaaagatgaattttttaaaagatgtatagcaccctcttgcacagctggaaaaagaagctgcatttgtgagtggcagaaggccatcatttcccccgcagcctgcataaaaggtgatagtacgcaggcttggctcaagcccatattttcactgcggaaatgacaaatgacctgctgataccctcagttcagggcctattactgagcaaggggcaagagtttcccgagtctttttagttcttttttttttttttttttttgagacagagtcttgctctgtcgcccaggctggagtgcagtgacatgatcttggctcactgcaatctccgtctcccgggttcaagtgattcttgtgcctcagcctcccaagtagctgggattacaagcatgtgccaccacatcctgctaaatttgtgtatttttagtagagactgggtttcgccatgttggccaggctggtcttcagctcctagcctcaagtgatccacctgcctcaaccccccaaaagtgttggagttacaggtatgagccactgtgcctggcccctgcttacttctatagttctcatttttaaattatttaccagtgattccctcaccctttatggttggacttgctaaagcaatggggattaggtttagcagtttaacctcctggaaacttctgagtgaaagaacctcagttgactcccagaaaggtgaaaggggaagaagaaggtgggggaacgaggtgaagagactaccagcggcctctctctgtgcctggggctggcccccacgctgctgtgtaggaagttttaattctgatgctagatgtcccttcacctgcattcctcaggctgtgcattttgcagagtcagctggcagttagggcatctctaattgttcaccctgcctgggcctggtattgtcatttccctctcatcttttaataagttctagagttttcactaaaagcaaaggatgataggattctttgaatgatgtgcaatttttcaatcaatgttggaagcagaaggcagccctgatgaccgttattgcctgtcagtgcgatgtggttagcctggttcctgtagacactggtgtgtgctgtcatacgtggcgtggcggcccaagtgtgaacacctatttatgatggcttcagattcacagcttcctgccttgtgtccttatcggggccttgaataattaggctatcacattacaattagttttcattagtttctgatctcaatagcagtgactggtgtcctctttgctcagcttaaaaaggaaaacgccattattcgagttatgaatagaggccttctttccaacactgatagccccaagatagaagtgttagagaagctggtgctatgaaatgatctttacagaagtgttggtcttattccttcctaggcaagttatcatgtttagaataattttggaatgtgtgtcttgttcttagaaatgcaaagatagtgaagtaagtagggactaaaggctgagactggaatggcagctctgagcccaggcttttatcccagtgtcttcagtcgcttcctgttgcctcaggcgtttatccttctctccctcctgtataagataaagggcttgcagtaaatctcaggctccttccatctgtgagccagggccttgtctcagataccctccttctcttaagagaggtagaattcaaagagaagtcagctttttctttcttggttctctttttgtctcttaattgctgccttgaaatttctcaagtttttctaaatttcatagaccacggggaggccctattgaatttaaatacagtttaataaaattaaattgttacaactccagttgttggtgtatggatcttaacaggagtttctaattacaaagtaggttagttttctattgccacgtaacaaattactgcaaacttagcagcttcagacaacatccatgtatcatctcacagcttccgtggggcagggagtccaggcatggccttagtaggtcctctgcccagggtctcacaaggctgcagccgaggtgtcgcccaggactgaagtctcatctgagacttggggtcctcttccaggcctatgtagttggcagaattcatttccttgcttctgtgaaagttgtggttgctcctgcctcgaggccagtgggataatctctttccagtccagctcagagaagagctaagccttcttttaaagggcctacctgattatcacctaggagagtcaccccttcgattaactcaaaatcaactgcttttggaccttcattacatctgcaaaatcccctcacctttgccacctaatgtaacctaatcatgggagtgcccccctctcatgggagtgcccagcccacactcaagccaaggagattatgtagcacttgtacaccagaggggagaatattggggttcattctgcctgccacactgaagaggcttttgctcaaataaatttgtcatctgtctggattgattagtggccatgattataacaatatgcctggattaggcattggaaaatgccctgagagcctcaaggcagtcttctgtggtgtctctgtagctggttcttctcttcttccagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtaccagaccatgccttttgtaaggtatcgtacagctttggcaattgtcaaaggctgagatggcgcctactttagaccacgcgtaaagcgtatgagcaccaccagcttattagaaactcagcatcgtaggcttcaccccagacctactgaatcagaaactctgagggcccagcagaccatgttatgacaagccttccaggagagtctgatgcatattcaagctcaagaacccttgatataggggaaattggttagctattttcctttaaagaacatgccgtttgtcagcggcaccttcactcaaggagacggggagagaaagagatagagacagaaatcacatttcttatacctgagtggggtggaacttcaggcagggccagatacatgatttgtagcaaccaatgcaaaacgaaaatgaaggaccatttatggaacactcaagcaaaagtgctgttaaagatactgaaacaactcttcactttcttctgtggtttctcccaccttgttatggtgattttctaatttggtatgtaattgtcgtaaggaaagaaaaattaaaaattaaaatttaaaattattaccatgaattttaccattcatctttatattatgaagtgtcagtttagaatgcaaatataagagcctttaacttgtaggcagaatcagccaaattacctaaatcatattttgtagctcccatatgcacgtgtattttgttcttaccaaaacagcagaaacagtacgaaaccgactgcactgtttttacatcacttcttggggtgtgtgcattctaccaacactctgcctttaacttactaaagagtaagaaagggctgaaagaaaaaggatctaggagctgccctatcttttcctttctttatgttgtcatttcagcataagttgttgtctaacatgggaaggtaacagggtaagaaaggatatgagaggctccatgggttgtcttctgtctgcactcaaatccatcttgaagggaaacatggcccccagggctgtcagtgcccctgcctgcccagttgtaggtgtaacatacttaccttgtactcacttccagtcccgcagaactcctgcctatcaccagtctaccagaatctgtgcacatgagcagcaaggaatggcagacatgcatgttgtacctctctcctctgctggtgcaacagcacaggtcactcacccgtgacgccggttctgctttgggctacatatcagggcttcggaccttgttgacttgagttcagactgttccctgtgggttaattttaggtcaaatgccctcacggtattgaaagtacttaactatgagagtgttgaaatgacactctttcttgctgatcctcatcatcccagtgtcctgccatggccagttaggggcagatctgaagatgtgttttctcttgggtggtatgacctcaaccaggaaagtgaattcctctaggcccaaacttaaagaatacaatgacccaggcaatccctgaggacattccaccagtggcattctgtgtgtatgtcattgcaagagcctttggggcctgtataaccttccacctctggttggttggttgttggttgttttttgagacagtctctctctctgttgcccaggctagagtgtggtggcgcgatctcggctcactgcaacctctgcctcctgggttcaaatgattctccagcctcagctttcccagtagctgggattacaagtgtccaccatcatgaccagctaatttttatattttagtagagacagggtttcaccatatgggcccgattagtcttgaactactgacctcaagcaatccacttgcctcagcctcccaaagtgctgggattacaagtgtgagccactgtgcctgaccctggttgttttttcgttttgttttgccctccacccatccttcacattccacaaaattcaccattttaaagtgtacaatttaatggtttttagcatattcacaaggttgtacaatcatcaccactatcatatttcagattgcttttgtcactcccaaaagaaacccccacacccattagcagacactctacattcttccctgtcccccatggccccaaaccggtaatctactttctctctctatggatttacctgttttggacatttcagacaaatggatccatacaaaatgtggtctttgtggctagctttcacttagcgtgttttcaaggttcacctacgtttgcagaatcactactttgttcatagttgtgctgacagtattctattatatggatacaccatattttgtttatccatttatcagttagtgaatacttgagttatttctaccttttggctattatgaataatgctgttgtgaacatttgtgttgaattgaagtttgtgtacatacgttttcagttctcttgggtttatacctagaagtgaaattgctggtcatatggtaactatctttaactgattgaggaattgctggattggtttctaaaatggctgtcccattttatattcctaccagcactgtataaggattccagttactccacacctttgtcaacgcttattattgtccaccatttttattatagccagctagtaggtgtgaagtggtatcttactgtagttttgacttgcatttccctgttgactaatgatgtttagcctctttctaagtgcatattggctgtctgtatagtttctgtggagaaatatttattccgatcctttgctcattttttaattgattttttttttttttttttttttttttgagatggagctttttctcttgttgcccagactggagtgcaatgatgcaatctcggctcaccgcaacctccacctcccaggttcaagcgattcccctgcctcagccccctgagtagctgggactacaggcatgtgccaccacgcccagctaattttgtgtttttggtagagatggggtttctccatgttggtcaggctggtctcaaactcccgacctcaggtgatccacctgccttggcctcccaaagtgttgggattaagggcatgagccaccgcgcccagccttgatttttttattgttgagttttaggaattatttctatattctggatactagacccttatcagatatataatttgaaaatattttctctcattctatgggttgtatttttccacttctgatataactgatcagtcttattaatagtaatacatttaaaaaatatttcctatttccacttataaagataatatatactcattgatgaaaatttggaaaataacaaaaagcatttttggtatatgaaaaagcataagagaaaaaaaaatcacccatgattttattactaaccatttttaacattttggtctatttttctggtcttttttgtatatgtgggtgtgtgttcatgatgagggacatagtagtctacatatagtgttgcatgttgaatcttattagcaaacatgttggaaacattttcccttgtcattacatgtttaagaatttaatgttttagtacaatattctatctgtgtgtataccataatatatataactagtccctattttttcagatttagattattttcaaagttttcacaattacaaatgctgttatgaggaagatattcattcataaatttttctgcaccgctagatctctagggaagatattttccatttccttatggtcttcactggatagaaatggagagagtgatgtataactcactattttctataagttactgtcataataagtgacaagttgaggaatagaacagaattatctttatatgatcttgggagagaagaaactgggcccaacatatttgctggcagcacttgaagctgccaacagccaccagctggccagctctttgtgcgctgctctgggcatcttctcttccagccctgcctcactccctcagttttttattgttactgacctgtggccctgggaggccagtaggtgacaaaggagtatgttctcatggctcctaagatacaagatggagaataaagtaagcatactaaagatggaagaggaagagagctcaagagagttggtttaaataaaggtagaagatggactttttccagcacagatatttccttcccttagccccctcaccaccacgatcggaactccttccatctcttagattctgttcagccaggggctcagatgaccacagatttggattccatagggtcactgtatattcagaggccagcatgatgcggatgaattgcccatcagtgaacaaactgggagagagtagtgaagaatagccttgataccaactccaggaatctaaaaactatcctctgcttcagggcacattttctctccagcctacctgcctcttaagccacctcctcaacttctttcccttcatgccagactttgaagaaattatactgtgttcaccatctttcttttgtcgaattacatgtgcctaatatttgagcatcaagtgtatatcattcacaaatgaagcatatttgtgtcatttaaagagcaataaaacaaataccatgtaccagctttaagaactaaaacattacaactcagaagtgtcctgacagccgcttcattgtcatcctactactcctatccccagtattctcttgctttctttaaaaataatttaacctgaaaaccacttattctgtgagctaacataatcatattactaaatcagaattggctaatcagagatctttcccagttatctggctgtactaataatttcaagaatatagcctatcgaggtgcagatggatcagagagaggtctgggacatcccttgtgactccccaggtccttttttcatgattcagatgtgtgctttctgacccggaacaacagacaaagtctgtaagtgaggttcacaaggtcatctcacccagcaaggagcatttagttaggaaacatctctacttcatgccccagagagtcatggctcacaaatccataattctgagtttatttactataagtagtccatagccagggacatcctgctaagggtattccagaaataagaactctcagcaaatatctttaatttatttgttagatagtctagttaattcgcatatttatggtaggtgaggcaggtcctcacatgcttgtgtcctttccccagaaacatctttcttgtaagatgagtgaaaggatcatcagccagatgctttagctccttcttctcagtctgcccctaaacaatgtattattgaattttgtctgttttcaagctttttataaatggaatcgtatcttttgactctttgtagaatatgcccttttgctcagcagttttgagacctgttccatgttgatatatggataacagcttgttcattttcactgctgacgaatgtatcacaatttatttatctgctctgctctgaacagatgttaggtggtttaaatttttgttgccttgacaaacaatgctactacgagagttcttgtacttccctgtgtgtgtgtgtgtgtgtgtgtgtgtgtgtgtgtgcaatagttaagatgtttaggtatcagttttattcatgctgcatcaaaatatttagaagtttttcttccttctctaagccctggaaatgtttaagtgtcatttcatattctggtctttgatggcttattagaattctgttggaaaattacatgggcctgtgatgttaaatatatatgtgtgtggggtgaggacagtgagggaagatttttggtaactatatttttttctatggaaactggtctgtttaaacttcctattgttacaggatcaattttgctaaattacatttcctaggaaattagccatttcatctgtattttaaaattccttagcaaaggaatttttattagtctgttatgaatattttaaatttcttctcttttagtaatcttccttttgttatttcttactttgtgtttgtgacttctccttttccctccagattaactaatggtttgtctattttgttgattttttttcaagcaataattctgacttttatatgaattgcactgcttttctgttttgtaactcaatgttttgctattatctttataaatcccttttactttctttcagtttaccttgttatttttctggatttttgagttgagtaattgatttcttttcatcttttaaccatcattgcattcttgtaatacaatccatttggtaatgatgttttttggtggttttttttttttttttttttttgagatggagtttcactcttgcccaggctggagtgcaaggtgcgatcttggctcaccacaacctccgcctcccgggttcaagtgattctcctgcctcagcctcccgactagctgggattacaggtgtgcgccaccatgcctggctaattttgtatttttagtagagacagggtttctccatgttggttgggctggtctggaactcccaacctcaggtgatccaccctcctcggcctcccaaagtactaggattacaggcgtgagccaccgcacctggccaatgatgtgttctttttaaaaaggtgctgttggaattctggttggtactaatttattgaaaatgtttgcattagtattcataagtaagattggtgtgtagcagctagctcctccccaccccatccctgccacctccccttcctcttcctttgttgtaagctgtgtttgtcagttggagcatcactgttatagtagcatcataaaagaattcctgaccactcctgcacattgcgccttgttgctttgtgtccagatgtctctggggtatctctctgattgttcccccttagtgtcctccctggatcctctgtttctgacccctccctttcagtggtgtccttatcagacctcctctctgtctgtgttgtctgtctatattcaccctagtgaagtcagcagccttgggggctcatcgctatcttgactccatgctttcttctgggacccaaggctgcttgcctctctaccttccttttcctctgcctgcttgccatcttgtatttcattcatgtacttggagaccactatatgtgacatattctgctagggctgtaaatacagagataaaatatctgtacctgcccccaaagaacctccattctttagtctaaggcaagcaggtagctgattcccctagcagaggatggtgcagaggacttaggacatgccaaggaagctctgactgtatctgacatgaccacctgaaagccacacatgaaatgcaaccagcccccaaatgaaccctttatttttcttccacaacaaaaacaaaaattctgaacggactcttcatgtctccacctctgcaaacagtggagtctcccaagttacaaggctagagctatactggactcttttctctttcctgtgtccccttatttaggaatttgattgctgaaaacagcacttcttctccattcctgtgatcatttccttagctctggccctcatcgtttcttgcctgaagtattgcactatcttcctattcatttgcttgtctattactttgttcattccacaaaacttcattgagcacctgctatgtgccaggcactattctagccctggtgacccagcacatcaggcaagaccactgccctgagagggcacatactctaatgaggtgcagacagcaatcaagaacgtgcgtaagcagaggatctgagatcgcaaacatgtctatgaagaaaagagacggtatgaggtgggggccagaaagaggggcagcagcaaggaaggaaggcctgatgaaagacagtgaatgagggagagcattggaggaggtcaggcatggcaggtgtcaggggttgaaaggaggctgggtggctacaggggtagggcctggagagcagcatgttcagagcctgggggacattgagatcccatgagggccttctccccattccaaactcccactggctgaaagcaaggtgatcctcctgaaagtcaaatctcattatgctgttctcctgtttaagaaaacgaatgaatgagcttttcatgaccagtaagatgaaaccaaaattccttccattggtacaagggccctccatactccgaggccttcgtgcctctgtggcctcatctccaccattcccaagatgtgtctgaagtttcaaccacactcaacttctcctgtttttgaacatgaaaggcaggttctttggggaactttcctttatccattctattttctttgcctggagtgttttttcttcctattctcaagttatcaaactcctactcctgctgctgcagtcacttcagatgtcatctctttccctaaggctccttggcaagatggaaggggctccttctgtttgtccccctactgccattcatagctgatgagagggtgctgccttgtgtccacacctctgatttaacactcctcagaatgtgcgacctgtttccctttgagctactctaagccatatgtctcatgcctctgtctagccccaagggccagcagcacagctgcccaaagtagaagttcagtaggtgcttgaatgaaggtctccttcaaataccacacatttcatgatagtgtctaccaggtgctgagttgaatgaaggaaggatgctattcagttggaaagcagtcaccttaaggggcagatgccctgtgtaataactcaagctgtgacaactgaatcctttagatagctggcagagttgggatttttctttctttctgaaagttaatgcatctcaaaaatatattcattgccaaaagacaaccaacttcaatatatgcaagggcagcaacgaagcctacaagcagaaccaattttttttttcacaaaagactgaatgttctcaagcaattgcagagagcttggttagccttctagaattcttcctaatagagaaggacatctggtggccattatgtcttggacttgctggaaacaggcccaatttcctgtaatttaactccatttcagaagggtgatttgatccatgtttaattaaattcatttgaatttttatggcttcatattatttttttcacatacataaattgacagaaaagaaaatattttgtcagattacgtgttctaactttagattctgaaaatgtgtccttgtaaggggtcaggcatcttaaggctgaagactgtagaggatgagaaataactattactgttaagagtaattaataggtccaatctctgaagattcttccttgtcataggtgataggaagtatgtatcagttatctttttctgcataacaaaacaccccagaacttagtggtgtaaaacaacaatccctgttcctgatgttttgggttaggaatttgagccttattcagctgggaagttttcactcagctgcagttatctagtggtttgagtgagctgagtggtctaagacggccttagtttatctacttggcctggcatttggtactggctgttggctgggccatgtgtcttcaacagcctagcccacatgtcttcccatgatagcagtgtttcaaaaaggcaagtcccagtgtgtaaacacttttcaggcttctgtgtgcatcatgtttgttgatgttccattggccaaagcaagccacattgttgagctttcatgggtgatgagcacatcacagtctatattcttctctctattttgtgtgtgtttgagaatttccacagtacaaagttaaagaaaaaaactgttcaagcattaaaaatgaaaccaccatatgatccagcagtcccacttctggatattcatcaaaaagaattgaaatcaggattttggagaaatattggtactcccatgtttgtcgcagcactagtcacaatagccaaggtgtggaaccaaccaaaatgtccaatgatggacgaatcaataaagaacatatggtatatacaggcaatggaatattttcagtcttaagacggaaatcttgacatttcctacaacttggatgaacttgtaggacattttgctaagtgaaatggcccagtcacagaaggacaaatactgcatattttcacttatatgaggtatctaaaatagactcacagaagcagagagtaggatggccattaccaggggctaaggagagggggtgaaggagagttgcctatcagcaagcataaagttttagtaatgcaagatgaataagttatagatatgtgctataccacatcgtccctctagttaacaataatgtatcgtacacttagaatctgataaaagaatagatctcatgttgaatatttttactacaataaataaaaagaaaaaaattcttaagaatgttcagatcattcagtggcctcaaagactggtagaagtggttacagatgtcaccttaagttgcccctaactgctttcttggttacatggggatgtgtaagccgtcagggctggattctggaccctacttgctccttgcccaagtttttagtttacaaatagcgttctacatttaattaaaagagttagaaggtatttgatgagaggtctagcaaatgagtcactccattacttgggacagtgttagaggtcttgcaggactggctctatctcacttagtgctcccacggaggatactcattgcgctgtatttgattaggtctgactcttaccacatgtcctaaataagccttgggtgaaaagccgtactctccaggtgttttctagctcccagtgttcctgagtctaagctgtagtgctcactagagccgaaagcatttggaaatgccaccgtagcctagcatgtgcaaacaaagcctctcttcctgtcatcactggacactgatgactctagaattcttattataaaaacaaaaccatgagtgaacagcagcctccaatttcttgttatgttgtccctgactgccaagcatgaggctacccttgggtctaccaagattctgtggcccatttgctccctccatgcactcttcttgttttaagtagcttgatgttttgttaattatctgaacttcagaaagccctaactgcatgccatgttatggtgttgccttgataatttttccagatttttcttggccttcaaactttctggttatctctaccttccttgacaaagggcagttaaagtggatttcacttcatgcacactgtgtgcctctctgaaaggacttgtgagtagaacgtcacttgatccttggatctctgaggttagacaaggaattagaaatatcttaactctactttagcccctaatcttatcattccaaatgtgtgcttaataagaagcagaatcaacacatcaggtcagaataagttcaaatggtctagaatttttatttatagaaatgaaaaaaacattggctagaaacacttaaaaatgctgtcctttgttaggtatgtggttgttctcaaacttttccccacagaatgtcatttaaagttttaaagttgagatgacatatgtgcttaactaaatgcttaatttctttttagttcttgcagttacaatgcagaaggatactcctaggaaatagaattcccaatgagattttgtaaagatagagcttttatcaattcttgcctcaaacctcccaaaattatgtttggtgaattctaggggagtaaaacagtcaaaagtctgttaaattatcgtcacctatgggagtttgttataagatgtatctggcatgtagatggaagagattttgtgaaagcttgagctggtggaaacagggtagggcagataagggtggatacactcctggtaaacggtttgtgtatctcaggtgctgatatgtccctgtgaactgagatgacagtggctaacctggccttgcctcagccgagctcacatgagggcagctgattttgcaatagctaggttttctgcacataggtgatgttaaagccatatactgtggttagctatctgagtctttatattctccattctctcacatggaaggactgggttgtgaaatgtgactaagaacacccacaaggctggagaacttgcatgtttggggacttggaactgtgttattccatggttgcgaagtcagaagttctgtgtgattaaggaatttatgggcatcttaggtcacttcctgtgagagaatggataggggaaggcagtcatattcattgagtaccacagagaaggccctaccctagatgctttacacaagttacctttacataagtgattctcatcacaaacctgcaagggcaattctattaccttcatttggtgagccagagagggtacaagtaatttatgacagggcacacctggttcattagtggcacagccagcatgcacaccaaggtctagttgacaccaaaacttgtattctttctgctgtccagttttagagaatgtaggcgtaggcataacaattagaggccagagatagagtccctggctacgaagagtcatcatggataaggagcagagctgggtgctagaagagaggtggaggagagttactcagaaggacagttagttttaatgggaggtgagaaagccatgaagtaagatccaggacagagtgagattaagagatggaaaagctggtcttctgcagagggcgccacctagacacagggctaaaaatatcccttggagaaaggcaaagggtaagaaagagtatgggaccagttggctcacatttccccatgtaagccggagtggcaaagtgcaagccagttatttttctgcacaaatatgcgtcactcttaggaaactttaaaacaaatcttaattctaggagttgtctttttgtgttgtgtatctttgtgacttgtgtttgcaagcttctggtaaaactacaggctccactccaaatcctgaaccaggctgctgtgatagcctgatagtgcagcagctgtcagccaagattttgaaattaaacagtacctgctgtggcactagtcctcttagaaagatttatgggtgaggccagttcccattcacctggatcttgtggctctggccacttctgagcaccctctttgggaaagcgagctcaagactgatagggaaccggccaccactaggcttcaggagagattcaggctcatggagcagaaaagagacacgggtgggcaaggagatggtgaaggcccgggaaatggaaatgctggggtacagagttagttaggtcctatccgattacaaaaatatttctcagactcactggtcatattggctgcccgcttcgtgtctgtttgatgggaagaacctacagtggcaggcatcttccagtgcccaggctgtgtttggcttggacacatgtggttgtgaagacctggcagggaagctgaggcgtgcagtttgcgaagacagagttaaaaatccctattagggcaatcctgaaatgcagtcacacctgaggtctgtgaaaggatgccaagcctgaccttgcactgggcgtgctctgcttttccaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaagtaagcattaacttggcagtggagaggggtgcaaggatgccatccaaaagagagcccacaggtgcctgccactctcccctccctgctggccactttgtcccccacccagcattgctccctacctcttcttgaccattaaaccaccagccaaacatctcggtggatttcccacacagggtggcccctggcgacttttacagacttcatcttactaatcccaggaactgtttttcagctacctgtttttaaaaaatattatttactatctcagttaatatctgttcagaaaagctgtgttttatcaaatggaaaagacttcaaaacacaaaactttggcctagaaataaccactgtaggaatgtggggttggaagagtctcgcgatactcctgacaatacagggatatctctgggttggtttaagttaaacagaaaaaacccatatgagtttccaaatagctgtctctatatatttcagtacacactaattccatcatttagtctgaaacatttttattgagtgtctgttagaggccaggactacttgaagccatgaagatacataaatagaaaggtatgatctctgtccctttgagcctcacgtttgggctgggaggaagaccgagaatggtagatagaaaaaaatggaatgattggcaatcctatgagatattatatgtatttaaagtataaagtttgacaaaatctgccaaacccagagtggttctatagtatagaggtacaacaaaaggctggccatgcctgctccagagtctgggtccagttgtatcttcccaaatggatgctctgaggtcactgggatgagggactttaggctccagtctctgccacccaaatccacaggggctgactaacacattcccatcctgctgctgatagtctggaagcaggaagtgctcatatcacttggctggatcatcctccctcatcatagagatcctcctgggagtcaaatttaggtcaccaggctacattatgaggaagaaaatcactcagaataagttggatgaccttaagaaagagtgatcaagatatatccctcctctccatctctaagggaataccccaccagcaccaagaggtgccccaaacaatctgatacccatggaatcatttgagcaggacccaggccatgccttcagatacctgttatcccaggaggaggagggactggtttgagatagatgtgcaaccatggtctatgttgacacccctcttctacctcataaccccagatgccctctctctacaggcttttatgtttctgagagtctgtgtacagctctattttagtgaaaagaagacctaaacttctaaacatattaaggaaagagaacctttaccatgagcattgcattttgtgatctagaatcttaaagaaactcagccaattctcaaagaaaaagccctcgaagctctcttccagctggcttgagaagttaacatgaagagaattgaggaaattgtacacaatcctctgaaaaaggcctgtatataaagccaccgaagatgctgagggtaggagttaggtggaccttgtcagtagtacttggtgttctcctgcttcatcatgtttgttccttgtctgtttcttgctgttacacttttcgaggattcctgtgttgtgagttcaggtgacaatgctttgcaataggctggtaaggatgatgatacggaagtggaccatcctgggcacggttcacagtcttgaagtgctgggctcggtaggatctgaaacaggaggccagagatgccactctgaatgctgtttgcttcattctttttggaatttcactttactggaattattacttcaacattaatttagtagcatttgagcaaaatatactttgcagcttgtaaagataggtgatgttttatctatctagattgatgattatgaagtgacttcatttacgaagcctgttggagggattttgcctgtggccccaaagtgacggcatgattttgatgaggtgggagtgcgatagtgggaatgcagtggtgaaatgctgattgggaaatgatttcttcctgcatagcttagtcacctgctcaacatctgtgcctcaaacagtacctcagagtcaagtggctcattgtgttctgtcccctgcagaccttgaaagacacagaagctgcctcatgtacatatatgcacattgctcttcatccctgcaaacgccctggccgcacctaacgctagcttatagcaacatgccttcagatgccacatatgaaggatttggggctagattttataactcagtcacccaagtgatgccaacttttgtaaagaagggagaaatatgttttagaaaggggttcatattgttctaaaaaaatatagggcagtctccactcagatggtccttttgcatcatttgaatttaactctcacgatcatcctctgtaagattcagacaggacaggttttattaacctcattgtacaagtgagaaaacagatggggctaagtgcctattccaaatcacaggactaagggctatgaccaagggctgggcccttggctcttaatatccaaagtatacagactccttcccagtcaaccacatcccagccaaccactcctaaacatattcttcaagcgagatgattagagagacaatttgatttacattccttgtaggtatttttttgtttgaggtaaatacaaaaattcaaagacttggagagaaatgcttagtctccctgtagacttaagccagctatgtgctttaattctaataaagactaataagagcttgaactcagatttgtttgctttggtttcttaggaaatacaactctacactgagcatttgcccagtaaggtacaagtttattggtcattggtcaactaaaagcatctttatgggaccatgtgtgtcataatgagtttcatctttgcacttaaagtttacaaatttcattggaaggggaaaaaatcttagtgctagaaagttcttaaaatttagcccaaagcaggagccctttctgtcaagttcccaagagatggggtacacttccaggcatgggtgctctttctcctgaggtaccccatctgcccttgaactattctgtttatcctggttcttcctctgttgacaaaaacagggctgcttcctgctctgtgtgtcagtccttctgataccaaacactgcatgggacttaacacgtgaactttcagtttcatcctgctgatttccacacaacattccaaactatagaagtaattttgaacttcatttagtcactaatgttaacagttgtgccatgcagctttcagtcatgtgtatattttaatatacgtggaagagtgacctggcagatagtggatgttgacaactggttagggagtggagggtccagactagtgccacgtgcctcagcagcagggtctgcaaactttctctgtcaagggccaagtaacatgttaaacttggagtaccagacggtctctattgcaactactcaactgaattctgcctttgtagcacgtcaacagccatcagccactggtactggcatgagcatggctgcattccagtgacattttatttatagacactgagatttgaattttacatgtcatgaaatattattcttttgattttttttcaaccattaaaaatgtgaaaaccactcttagctcacaggccgtataaaaacaggtggtaggccagatgtagcccacaggctgtagtttgccaacccctgtcccaagggtctgggtttcttgagggaggttgggggaaattggcaaaggagagtatgtggcatatgagagaagaatccactgtgttatgtgtgagggctatggggaacagtattcttagatttggtgttagagcaaggaagtcaaaggaatattccatgaagagatagagactataggggactttgctgatggctgatcatgagttcccagggcacagaggaagattgaggggtcggagaagggcaagagataagccagattgagggacacatggagagggaggggactatgtgatgagtccagggaagattggactgtgcaggccgggattggtcccagtggtcccttcgggcagtggttcttgaccggggtgattttgccacctaggagacatctggacacatttttggttgttataactgggacggggtggtgctgctggcatctagtgggtggagtccaggaatgctgttctacttagtgcaggatagccccctgccaaacaaataattatctgttttaaaatgtcagtagtgttgaatctgagaaattctgccttaggggaaggcagatcgttggttatgtaatccacatgatgctgagatagagagtgttttggctattggaaagggtagttttcttagaagcatttggaactctgtgcacctaccttaaatattcatgtgcatgggtcaaaattgactctttttcagagaatataatcagctaaaacacagatctatagaatatatttctagtttaaaaaaatccattggcattttacaaacaaatgtcatggaaacagattccttaaatgagatatgaattgtctttcacagctgactggttactctgggctactacatggtttacagtagagtcttttttttgattttaagtccgtttagcaaagtttcacgcttcaaattctcaggaaatatgcttgaacacttttaggggaccaagccttgacttaatctcatgctactctcagtaactgaaatgccaacaaatccaattctaatcggcttcatacacatccatcactccaaaaaattgacataatggaatgtgacaccagcataaaacaagttggcaagagagaacaatgattatataagagaggtgtgacagtctacatccaggcttcacgaacctgttcagaggaagaggaacctggcacagtctcaccagaaatgttcaagtggagctgaggaatctgcattgagaagcagcagtgggcaactctcctcttggctgccgatactttcaactgatggtcaagaaggaaaaaagttacatataagaattgctaatttttttccatgtaagttacactagggttacagaaaaattgactaatgtatgtttcacagaagtcctcattctaataaatgcaaagtgataaggatatataaatgggtcttgtgggagtcaggagttgtagccaagccttgagcttgtagtcaggagaacagtagtctgacctacagacatacttgacccttgagcagcagagagaagatgtggcctagcctcagctggttccaggagcaaaagagaccatgcttaggtgggctccaggccaggagtactgatgcggcagtggagagcccacttgagctgcagggagaagtctggcaggggtttgttgtggggcagggtgcagagaccagcactggaagctcagcctgcacctggcagagaacagactaccgctcctaaggagtgggaagcactcagtctccacaaatcctcaccagaggggtgtttagaatcactgtggtcttgggcataggatgtggaggtattgaagcatgggagggcaagttcagaacccagctctcccaaaatagctatgtgccaatttatatatggccattggctcatagtaggcactgaataaatagcaactctttatgtttttaaataaaaatgataggatttaaagatgtggtgccaactgtgtgatgtaaaatgaagagagttgtaccatatagtgcaaagatgaatataacagtaacagccacaacaacagctagcctttacggaacacttaatcatctgccaggcagtatgctaagcactgcaagtgtacaaactccatttttgctattatgtcacgatataggtactgtaattaatgctgtgtgacaggaggggaagctgaggcacagggagttgaagcaccttgcccaaggtcccacagctaatatatggtggagctggttctacagtttaggtggtctagctccagagtccatgtcctcaccattctcctaaataacccttatttctgttattctgtggaaataaatacatgctgagtacttggcaattagtaagccattagtaaatggacactgctgtatttattattggatctatatttttcatatcaatacattaaaaattattgcttaatggtacattaaaaaattattgctaatgttccaatatatagatataccataataccatgatgctgtcatacattttgctatggcttggttccagtttttttctcataccaaacttgctgtaatgaacatacacactggtgcacatacacgtttgtgagcattagcactcttagattcttagaagtagaatttgagacaatggacatttacattttaaatattgatattgccatattgctctccacaaaggctgtatggttttactctccgtcagcatatgactcaccattttcccacatcatcactgaatgttaggagattttcataatttttgtagtattgaaaagtgaaaaatgcctcagcattgtaatttgcatttttttattactactgaggctgtacaactttaattgcttcattagctattaacatttccttttcttagtgttgcctgtaaatattctttgctcatttgtctcctgaatggtttgcctattttaattgacctacaactagtctttatttttaatatgaaaaccttcagattcaaagtagaatataagtattctttacacattttagatattaatattttgaccattttttctgtctttcaaatgtcttttaactgaatttctgacacctctcatcacatgcactaaatatatttgttatggtgtccaattcgtgagtcccgtcccgtgtggcttttaggcatcatgcttgctcagcaatgtgtgtcctctttttaactgcagcctctgcgttgtcctgggaaaatgctatgctcttcttccttccatgtctaggaggtaagcaatggaagaggtagggatggagccagtgttagcagtggcgaatctatacgggtctgcatcaactcaattcttgcctccttgaaggaaagaatttgtctgaggggcaaaagacagaccaagacaagtttttgagcaggagtgagagtttattaaaaaattttagagcaggaaagaaggaaagtaaaatacacttggaagagggccaagcagatgccttaagagatccagatgcactctttggcctttgacttggggttttatacattgatgtggttccagggtttgtgtcttttctaccctgattcttcccttaggtgggctgtccgcatgcgcagtgccctgctggcacttgggaggggctgcgtgtgcactgtgtttactgaagttgtgtgcatgctcacttgaggcagtttccccttatcttccagtgttcctagaggaaggtcatataccagttaaactctgccattttgcctcttagtgcgtgtgcttgagcccaatcacccaacttctcagatcttattgggaagctgctgatcactagctttatgtgttttttctctcttaggagaccgcctttcactggcaccagctatgaccaattattattttaaaaagacagtttaacaactgccaggccatcacttgatggtcacctgacattcctggagttgggggatactctccttccctagtcatatctgcctaactacctattctaacaccagcatttatggaggattaactttgtactggctattggactaaacaattttacatgtattgtaaattccatgaagaaggtaggagtatcgtccccattttacaggtgaggaaaccgaaacacagagaggttaaggagcttgtccccagattacagaggctctgctgggttgggacccaggcagtcagagtccatagcctgcactcagaacctaacatacctgaaagtactctctgaatctatagaatgtgttcagtaatgagaatgttatatcttttgaggatgaattagatttgttgagaaagcaaaaaatcactcagagcaaatgttttactggaacttggtaatcttagtgagctgtattgttttttagtcactgtttgattttgatcctgaaatcatacttactgatttgcttgtttttctcataaatgggcactgaagacattttatagaggggacttctgaaaatgttcagagcaatagctgcaacactggaacaaggctttccagttagtcataagtaaccactaccttggcgatggagtaagggaaggtatagagaacagaaactcatagttaaaaggaagccacagttaactatcaattatcgtgaggctgtggaggagcagagacctaagccatcctcagtttttgatggctcataactgatgcataccaattagtggcccagcaggtggtaggatgcgggtagccaagccttggggctgtgcctttggagtgggagctggagggaggcaattggaggggtgttgttttctattttcctgcaggagtgaagaagagttttggcatctttccaccagccacaggaagcagtgggcaaatcggggagcctacttatggaactgtgctggggggtgagctcatcttcccatgttttgacaggaaggaggtgtgtttacatgcctaagttttaggacagcacagcttcccatgccttgtccacaaaacttcattgccaggattagagaattcatcctgagtctgcagtagaatagcagaatagtagagcagccctatctctttcttggaagcagttggcaatgagcaatctatttgcaagcaaaagacatactgtgagatggggtgttatatgacgttaatctacaaaatctgcaactcaggtgacctgctcagccctggctcctggaggaaggctggccgtgtgcagtgaaggagcagcaggtgaggtgggggagggcataggcgtggttgtgtgtaaactcaggatgatggtacctgtactccttaatacggtggtgggagagttaacacaaatatgtgctttgcccagtgctgttattatcatcaatccatgccctgaagcattcacggatattactctgttaaggtaattgttaaatgaatatggacgtgaattggagaaaatattttgtgcacccgcataaacatgctagaggatttcacaacaaccagattaacaaccattggtactatgagtggcaagtagctacttgggaagatttatctgatggtaagtgacttgttataaatgggattcactgacaagtgtggtgacctcctgacaaaagtatgattggaatacagccagtgattcagcagtgtccaagagattcatgctgagtgttgaatagcaaagggtggcctggagagaagaggtctgggaaggctgggagagtgggcttggaaatgggaggaactgtattgaataaaggcagaggcactgggacatgaggaagaagttactttgcaatgctcctggtatctggggcgggattggcttctcaaatattcgttgtgaccagattgcaaatttgttgtgggtttgaacttccctgaattgaatctgaggatctttctaggttctgaagaaattggcaaaattttatccttaaggccaagtggagctactgatgaatttcaaatgattaagtgaaaatcagtgtagtgtttctgcaggagcattctgggcacagcatggggaactcactgggggagagcaggctgcacaaagagattggtgcagggctttcgctggtccaggaaggagtggagggggcctgactgaagcaggggaagagagaagggaaagtacagggaggtgctgagaatgcaggaggctgtggtttgtaggacaatgactggattgcatggtgacaaagacaaaggggcctgaggtgattctctggcaatcagtaacctggggccagtcagtaagctcctggatgtatctatgggtcaggcagatggaaattcccatagtcagttggataggcacttctggaactccaatacctgtaggtgatggttgaagctctagtttagaggccctaacccaggaaaaataaactgcatgggcagagaactggctggggaaaaccagcaagagaatgtacagaactttcatctcatgaaatgaagaaactgagaacatcacccacatttcaagtcaatgaaccttgacatcagttatcatcaagtgtgactgtttctcaggctagagtggacttaggtggtatgagggctctggaagaaacaagctgtttactatgggaatggaagcgaacatacctcagatggaaaggttcaagttcctagttgaatcttttacttgctttgggaattttctttcagggccaagtttccctttgacctgtccaaaccccacatctcctgtaagatgcaccttctcctctgtgttctgaatgttcacagcactttctaaggctcgatttttgctggcagtccacgcaggcatgggtgtgggtcatccagctagagaataagcatttctctctatagccctctgcaactcccaggatccctttggagatggagcaggggctatctaaggagtactaagctgggttgatcaaatgcagccatggaaagagaaatgagattattttttcttgataagagcctgtggaggcagcctggtggtaactcttcattgatgaaggttgaacaaatagggaagtgaaactctgaagatgtacattgaagaggccaaagaaagcctgggcacatttgggatgattctgtgtagcctaaatgcctttgatcgtcccgagagagcatacttcccaaagacatgatagctcagtgaggaatccagagactattatatcacacttcaggagtactcaattaccatatccacatggccccagataaataatttcattcctgaggtttttttttttttttccagccatgtggttctggttttataaacatgagattaaaaactgactagagatgagccctcataaggaggtggctggtcagggcctgtggggtgcaggtatttgtctcccaggggtccttggatagagcagggatggtgggggtgggcatgtcacgactgcatgcatgtgggcaggccttctggtatgaaacacatactgaattaccagacttcagaagctattttttcttttctatatattttttcattcataacaagctttgcaaaactgccttccaaatggagggtcaaataattttgatcatgagatcaggaaaaaacaactatgaagtaccttggactctacctttgtttttgtttgcatttatggacttgggtccacatccatgatagctcatgtctataagtaaatgagcaagccaccagatctctagaagagaagcccccaatactaggtgtgttatttcagagtagccttacattaaaagacttcttagtcaatagtgacatcttatgacctttgatattacagttactgattttgttgagacaggaatactgtcttctgggactaaaggaacaaaatcatattcatttgttcatctaactcctatttcatttttgtttttgtttgttttggggtttttctgagacagagtcttgctctgtcacccaggctggagtgcagtgacacaatctcagctcactgcaacctccgcctcctgagttcatgtgagcacatccagctaatttttgtatttttagtagagatgggattttaccaagttggccaggctggtcttgaactcttgacctcacgtgacccgcctgcctcagcctcccaaagtgctgggattacaggtgtgaggcaccgtactaggccccaactcctatttccttgtgcctcccatgttcttggatctgagaatacagtggtgaacatgaaccttacaaaacatacagtttcataagacagagtgcaaatattatagcaagtaaatatgagtagctttagaagagggcttttgaagcgagccagcagggccatgtggtagatagagggttacagggatatgagaatatatccttgaggagaccctccagaagtgcacaaggatgtggacagggagaggccttactgcatccctgtggtacagcatggcaaacaattggggactagctagatcagtaaaacgtctacttttggatgatttatgttgtggatgccaccagcaggtagaagaaatgcacaataccaataccagaagtgctaacgtagttgtcaaatcatttgctatgtaaaaagattgtagaataatatgttttttttaaaatctagatgtttattcaccaaatgtataacagtggttatttctggtcaaaggagacttaactgttatcagtagtagtataagcatacttcctttctcaaagggagtatgaattcctgtaagtaaatattcattaaaaatagcaaaaactctttagaaaagagaaaagtgtgatggggctggtccagaaaacctcctcaggcatttaggttgagtcccaaaggatgagaagagtaagagaagagctccccaggccaagggcatgccatgtgcaatggcaaagggagaaaggggcttggtatatctgggtatctaataggcatcttgggaggtgaggctgtagcgtgtggccagaaacaggtggcatagggtggagatgaggttgcacagtgagcagaccaggtcctgcagggcctgggaaaccacagcacagagtccggttattagtcagcatgtgaggctcagttgtgcacatttgaaaagctgcctatctgcctgcctgcttggtggggatcggattggaggcaagggagagtggcagcagggacataggtcgtggctattgatgccaagctactgggaaacattgataacttagaccagggtagtctcaaccctgccaagcatctaaaataacccatgttcaggttctaccccagaacaattgaatgcagtttctgaaaggagggcctgagcattcaccttttaaaataatatgccttaaggatgcgaatctctaggctggaggttgccagtggtgtggagaggcaggaagcgttgaggcatgcattagagacagtgtcagtcacccccattgctggacctcccaagaccaccctcaacagccttgagcttgtcctggtttaggagggtggtctcttcccataagtgaaaaacacacatgagattagtcattgtacaacttctggaagtgacaaaacatgtctcatgtccacacaactggattttttagttataacagccagaactggagtcttccattccagtgtattttccttcattttaagggtgaaataagacctggatccaccaaggtcttgggacagattgaagaaagaccctgagcagggctgttttttgcctctgaaggctgccttcctgaaatctcatgaggggactatgcttagttcctgctgtttccacagttcttaggaaaatgcagcctatcttcatcctaatttctctgtcaacttctgctctgtcaacttctgagggacatttaaagcaacgaatattggccggcgtggtggctcacgcctgtaatcccagcactttgggaggccgaggtgggtggatcatgaggtcaggagatcgagaccatcctggctaacaggtgaaaccccgtctctgctaaaaatacaaaaaaggcagggtgtggtggctcacctctgtaatcccagcaatttgggaggccaaggcgggcggatcacgaggtcaggagatcaagaccatggtgaaaccccgtctctactaaaaaatacaaaaaaaattagccgggcgtggtggcgggtgcctgtagtcccacctactcgggaggctgaggcaggagaatggcgtgaacccgggaggcagagcttgcagtgagcggagatcgtgccactgcactccagcctgggcgacagagcgagactccatctcaaaaaaaaaaaaaagctgggcgtggtggtgggcgcctgtagtcccagctactcgggaggctgaggcaggagaatggtgtgaacctgggaggcggagcttgcagtgagccgagatcgtgccagcaacgaatatctgtggcttagaataaagtgttttttttttttttaaacacaaagtcaaggtatacacaaaaactggtgagaagcctcatagtctgtagttatcactagatccatttgttttacacctgaataaatctgtaaccccagttactaattgtgctttttttctgttgatgtttgtactctgcagacttgaattccattatgttaaattactccatgtttcagcagaaataatatgcttgaccctttaatatttatttgattctaaaacaaaatagcaaaataatggcttatgtattaaggtactagcccatagtccagcttcttgggtatattagggatccatgagctatactttatactcctcctaaactttgcatgctacagggacaataaatactttcctgtctaactttgggttctcaccatggaaacatcagagcaacagctgggctctgttagatgtcttttcattctcttggctggtaaaatcttttgcagaaactttaaaaaacttgatggctaacaaaactctacttttaagtgaaatcactgattcaagttggccagatatttgtcttaactgattacgattgctaattggaagttttcaaatgttaccttgggcccttggtgacctagaaacagccttaaagttaacagaaagtgtgagtcactgtgaggccaagatcaaactgcaatttaaggattcagtaacacagaaggctgcagaccaagactggagggccatgttctttaccataaatgtaacaaaatatttctatgaatatcttatatgtcctatgcattttatggaactaaatgggacagtttaaatgtctgcattttatctaaaccttaagacggctttttgactagttgccacaaatgggtcataaggcactgctcctccaggctttcaggacagcaggcaagtctggggtgactgggctctgggctggtcttctgggagctgtacgcagccttgtccaatacgaggcattatttttctctgtgctgtgtgaaagaaggattgccaagcacggttcaggaaccgtgcttcgaaggaaccgtgcagtgatgaaaacagtttagattctgctttaagtttcatggggtagcctggcatgttataaaggagtctggcctggatgttaggagatcagagttcttactggcaacctgtttggtcttgccctctccagaccccatccttcttctctgcaacatggggagatctctgaggtcatctccaagtaattgtcaatcttgcccttggatcatgcatagcaagagcctctgtgccgaacgctgtgctaggtcctcagggccatggaactgcagcaggcagcaaatacttattggatgtcccttggagccagggctctgggcagggtctcctggagaaacagagcaggaaaagtaactctagtcaggaaaaatggctcttgcaaggactccaagaatgaaatgcccttgatgttgggtggaagcttgatatatcagtagactgtgtaaggctagggtgaggaggttcacgaagggaaagtggaagacgaagttggagaggtgataagagattagaggtcagctaggcaaactagacttgatcctaggtcagtagacatgttgcacaagggaatgtcatgtacaaaattccatcttgtcccttactcaggtcctctttggctttaaacagccaagttttgcttcaacagcatggcagagtctttttgggtagcttgggccccatgggttgaatacttcctgctacagtgagttgtttagtgtctcttccctcactggtctgtaatccaaggatggggactttgtttagccactgcaccccagcatctttgcacataagtgctcaataaaatttgttaagcagggcacggtggctcatgtctataatgccagcactttgggaggccgagatgggtggatcacttgaagtcaggagttcgagaccagcctggccaacatggtgaaaccctatctctactaaaattataaaaattagctgggtgtggtggtgcatgcctgttatcccagctactgaggctgaggcaggagaatcgcttgaacccgggggttggaggttgcagtgagccaagattgcgccactgcactccagactgagcaacagagcgaaactcggtctcaaaaaaaaaaaaaaattgttaaatagagggagataaagcccttgccccataattacactgcttttttagtaaacgaatgcaggaacagaaaaccaaatactgcctcttctcacttatacgtgggagctaaatgatgagaacacatggacacatagaggggaacaacagatactaggacctacctgagggcaaaggatgggaggaacgagaggaagagaaaaaaataactattagatattaggcttagtacctgggtgaagaaatatgtacaacaaacccttgtgatgttgtttacctatataacagacatgtatatgtgtccctgaacctaaaataaaagtttaaaaaaattgtttcgttacatattttaaaaatcctaattgtaggccaggcgcagtggttcatgcctgtaatcccagcactttgggaggctgaggcaggtggatcacgaggtcaggagatcgagaccatcctggctaacacggtgaaaccccgtctctactaaaaatacaaaaaattagccgggcgtggtggcgggtgcctgtagttccagctaggaggcggagcttacggtgagccgagagagcgccgctgcactccagcctgggcaaaagagcgagactccgtctcaaaaaaaaaaaaaaaaaaaaaaaaaaattaaaaaaatcctaattgtacagagttgggttaattataatcctttgttcatgacacattgtcatcactggtctttgcatgattatcttctagtttattttataaaatatttacgaatataatagaacatcaaggagactatgacctaacctaaaaagcaaggtgttacttctaacttccatctctgtgcttcccaatctcccatccctaggcctgggtaaccaatacttaaatatgtgtttatcactgtcttacggggttttattgtgggggtttttttcagtattttttttttacttttttttctgtacttcaatggacgtattttttaaagtattacacacatatgacacattagtttatataattctgattttctgcactttgttgtaaaatgtatgttcttcttggacttgttttggtcactcagcgttatgtttctggtggtcgtccatattgtcacgtgaagctggcaatatggattttcactgcctggaatttaccacaatctttatctattttttcccttcagagggcatttgggtcatttccagcttttgacaattacagatagtgctgctgagaacattattggactctcatcctagtacactggtgcttcagtatccctagggaaggtttctcaacctcagcactgttgacgttttgaactgaataattctttgtcgtgggggctattctgtgcattgtgggatgttttacagcatgcttgtgtcagcccactagatgccaatagcattccctgccctccacccctgttgtgacaactaaaaatgtctccagatgctgacaaatgtcccctggggttgggggcagaataaccctggtgcagaatcgctgccctagggtatagcaatacaacttttaggtcatgatattaatgtttaattttacaagatagtgttaattattttgccagttaaacctatatatcctcgtatcaacaatatatgaattagttgacttgcattcttttcatcacttggtatcattagacttctaattttaccaagtagatagaaaatggtatctcactgtggccttaattcatagtgccctgattgataatcagaataaaatatctcttcataccagtttgttggctgtgttcatgtattttgttcattttatagttgtgtttttgaagtttaaaatatattttcatatattcttgatttgagtttgtctgttagatatattgcaaatgtctgctcccagtgtattgctcaactttttctcattctgattgctttggtcttagaacatactttaacattattttgaatgtttgtatcgtgtttctgaaagagctcagcaacattcattttccttttggtgtttggaagcccgagaaacatgacccattagcctgagacccaaatccgaggcattacattggctttgttggaaactacgccccaaagaactggtcaggctgcaggcctctgggttgcttttccaacttgaaaacggtgacctcaaatctgggactgtttgcggtgaaaaggaagatacctaatggatttggaacaggcctgggccctggagtaactccttatcaatcacaagcaaaagacctgtggaggtattggaaagccaaaggccaaacacccagaattccttagcacaatataaacacaattaagttacgctttataagaaaatctagtttgagaaaaagcaaagttgtcagaattaattattcagtcttaaatattattagcataaaaatcatttcatttgactgattttatcatagactggaactaaataaaatcaagcctcgaaagtcctgtgccctaggagaggatatttccttctccacccctttgcattataggcaaggccagtgatctggtcatagggcatcctggacgtaggccctccaagtgggtcattgtgctgtctgcccttggttctgccctgccacttatgatagcaaagctacaacacatacatcatatgaagatttattgtgggatctgaggatgttgagcccaaagagaagacagcttgggatgtaggttcagatagctgtctttaaatatctgtgagacagccatttggaaaagagttggatcaaaaagacaaagtgcttttacatattaatgcattcctcctaggggataggtactgttagtgccccatgtagggatgagtaaagtggggtccaaggtcacagggctcaaaagtggtgactctgaagaccagacccaggcagtctggctccagaacctctccagctctacctgggagagtaaatggaatcaaggaattttggagggaggggctcagtgttttgttttaaagaggagaggcccatcggttggcaaggtggagggcattttgtgtggaccagaagtaataacacctgcaaactcctgatcaagctgagggaaggtggcctcatgatggagcttgtaggtatagtttggcagctgtgggagcacatggaggaaaagaagactgaggctggtagggggtggtgtgtatgagggtatactatgccaagctcagaaggatggctgagtccgggcatggtggctttgggaggctgaggtgggtggatcacttgaggttaggagttcaagaccagcctggcaaacatggtaaaaactcatctctactaaaaatacaaaaatattcatccatggtggcatatgcctgtagtcccagctattcggaaggctgaggcacgagaatcacttgaactcaggaatcagaggctgcagtgaaccaagatggtgagattgtgccactgcacctcagcctgggtgacagagtgagactctgtctcaaaaaaaaaggaaggatggcttagatgtgcttgtttgtggcttctgccatgacaggagggatgctatctcactgctctccttgtttctgctagaggcaccccgagtccagatccatctctcccttcttagttacataattctcaatccctctacctacctctttataaggccagtataaccttgatttcaaaatctgacaagcacattatagaaaggggaattacagatcaatctctttccaaaataggtaaaaaattcttaataaattaagaaatagaatctagctgtatataaaaagataatacattacaacaaaatgtattatctttattaagtttattcatggtatgcaaggttggcttaacattttttttaaaaaagcagtcttcatagctctttaacagaaaaaaggaaaaatcatatgattatcttaaatgcaggaaaggcatttgacagaactttaatacttgtttataataaagatttttagcaaactaggattagaaggaaattttttaatgaaggctatctaccaaaaaaatctatgacaaaccttatacttttccctgagatttggaacaagaaaaggaagcatcactgtctccatttcttcataatgttggaggtcctagcaagtggactagggcaaggaaaaggaaaggcagatgaattggaaagaagtaggtaaagccatcattatttagtgatgaaacgattgtctacagaggaagtctaaaagaagctctagaaacagtataataaatttagaaaaattgctggatacaagcaaaatttacaaaaagtttatttctatatactatcaacaaatagaaaataaaattgagttcaataatatgtacagtagcatccaaatttatacctaaaaataaagatatctaagacctctgtgaaaatttaaacactattaagagaaattaagatagcagtaagattaggtctaaataaaggctatatatatcacaaccatagattaaaaaacatagcaaagatgtcagttcttcaaatttgcatataaattcaacataatccctatcaatagtacagcaaaaaacaagttgacttgtgagaaaaagtccagaaatctacaaatatatatcttaatgtatattaacctgatttgtgaacaagatactgaagtggagagaaggccctttactaaatggttctgggccaattgcgtatcgatgtagggaaaaaaatgtatctgacccctatcttacatgataacaaaaatcaattagagatggactctacaaatgtaaatctgaaagttagtgaaatgaagcttttagaaggacacagagactatctttaagacctggtgtaaacaacaacaacaaaaattaacacacaaaggcattagccatcaaaggtaaacaggacattattaagaacttctgcttattaaaagatgacatgaagtgaatgaaagacaatagagaagggaaagatgtttacagaacatataaatgacaaagggcaaatgatattaaaaacacttcttcggccgggtgcggtggctcatgcctgtaattccagcactttgggaggccaaggcgggtggatcacctgaggtcgggagtttgagaccagcctggccaacatgatgaaaccccgtctctactaaataataatacaaaaaattagctgggcatggtggtgggtgcctgtaatcccagctacttgggaggctgaggcaggagaatcgcttgacccgggaggcagaggttgcagtgagccaagatcgtgccactgcactccagcctgggcaacaagagcaaaactttgtcttcaaaaacacacttcttcaaatacaaaaaaaaattcatttttttaatgggcaaaaaactacttggacacttcaaagaagagcatatccaaatggacattaaaagtgtgacagtgtgcccaacttcattagtcatcagagaaagcaaactaaaagcacagtgagacatcactacacacagatcaatggctaaaatgaaatagacaaaattatcagatcttggcaagaatgtaaaacaatcagaatgctcatctactacttatggggatggtaattcatcccatcatttttttaaatggcagttattaataaagatgaacccaagcatatcttatgacccaaaaatttcatcccaagatatagtacacagtaatatatacatatgttcaccagaagacatgtactacactgtttatgacagcactattcaaaatagccccaaattgaagggtacccaagggtcatcagaagtagaatgggtaaactactggaatacagcaataagaaggaatgatcttcaagtatacgtaactatgtcaatgaatcccacagctgtaatgttgaacaaaagctaggcagattatgattccttttagatggagaataaaaccaggcaaagctaacttacactatttgatgtggggtgggagagggaagcaattggaaaggagcattaagggggtgctggttagataggtgtgtttattttgtgaaaattcagtggtttgtgtacttttctgtatgtattttatatgttggttaaaaaggaaaaaacagctgaaggacagtgggatgacagagttaaagatcctggtagatgatgcctggagtgagacatggtggatccgtaaggactgaaagcaagaagatgctgggggcattgagaaagtagaggatgcacatgcattaggaggtgaagaatttgggtgagaggaaaggaatgagagatttgggtgaatgggggcttgtggtcaggggtgggaaggttggatgtaagatttccaaggtgggctagttatgtacgatggtgaggtctagagtgggaggggctaaaggtggaggtcactggagttcagcaaggcaagggattgagaagcccagcagggcattgaacaggtgttccatgtggaccatgaccacataagtcggttgttgacaggacttagagaccagagaaagagaatgtcccagtttttaaagtttttagtctgtacttagctgcaaggacaaaacccaattgaaaccaccctaagcaacaacgagaatttattattttccattagtgaaaggctagggtagagctccagaattgctggatacaggcattaaaatggtcggggggactgctttcctctccttttctcccagtttcaactatgtttttcttggactcagggtgtccttatagtgagtcatccctgatggtaccaggagaaaccccaggtgtgatatgaattggccccacttggactatgtgctacccttgaagtgggagtggaactgcacccctgaaacacactcattgaaaatcaggggtggccattcattgagaataaggggtggcataccaaaaccataggtccaccgtggaagttagtccatgccaaattggcctgacccttggtgatttctaatcaagagggatgcagtaaagatgtgaggactctggttgctgcagcagctggtcatcaccaaaaacctttactggatgattctgtgtggaggagaaaaaccacagaggaggtctgcccatggccagaagcttctgtgaattgcatgtagggggtgcagggtagtggcatctagccagcttgacaaagaaatttggccttttctgctttcttacatctccacccgacgtttaaagtcccacatttcagaactgtctcttgtctcctaacagactgagtgtgcttttcttcatttcagccagctgggtggttttttttttttaattattattatttcgttgttgttgttgttgttgtttttgcttcatcttcctgtttgtctgtaatgctcatctcacttttccatgttgtctgtgtgcatttctcttttcctggctttgtctcagggaggaggaggaggaagaggagcagccaatcacggagcccagttccgaagaagagagagaggatgatgcttcctgtcagggcaaggacaggtacctaggactggagcctcccaagctcacactaaaagtgggagactccttcctaatgatagttcactgccttctagtggccacctcccttcctcattgactcccacttgcaaactcttacttaccctgttcacagagccacagaaccactggttttgtagaaatacctgagcatgttttcattagagaactgcactttttattgaaatcctaccttcctaaccacactttatggaaaaaatcactggttttctcctcacctttccctccctcattgaatgctttagctcaaccagattgatggtgactaaaaaggctcatctcccctaagaagattcttgccctttcagcattgcagtaagaagaattccatatgttcctttcttcctgattttaccagcacaatattagctaaaatgtgtggataactactatattaatgattcaggtttgttttatatccaaacaggaaaattttcaccccatgcatcatagcaaaatttcccagtatttattttcacaccaagacaactaacatataactctatagccctttggggagtttgctgtcatctactcacctcctctgcatggtgctttctttctatcctcaggcaacgctgacagacatgggcaccttgcagatattttaaaattctgtagatattttccccaaatcatgtctgtataaaacagtaaaaattgctcatgggtagtttcattttccagtattcagaaataattctaaaattgaatggttttcttcacttaattgattgccactgcaaatggacatttttacttttttttttttcctacaaataagcaaaatcaaatggatcttggatgaatccaagtaaaatctttgccaactttagatttaatggagtctttgctactgatgcctcatctgccaggctagcagtgcacacagaagttctcagatgggctcatttgacacacagactcctgccatgcccgggggtcatagaatcttctctgaactgacaaactaatgattgcttgcccctatttggaaatgactgagaagaagccagcaggatgtggagagaaaaggaatgagctgatgatagagaattagccacacatttcaggaaagatcagcatgaaacagagaccctgccgtgcttagagctagtgattgattacttagaggtgctctgggaagggaggatgtttggtcgccatcccaccttcagttgaaaatgagctgtaggaaattctgtaggctatcactgaaacagggatatgcctccctatctgctgaaaggtgcatgttctgcccacctgcacaaacccttaaaccctcaggtatgcacatgcttctgcaccttcagaccagatggaagaatctggctggaaaaggcggccttcaaaggcatccctgttaatggtgtgctgtctctacctaggatttttattatacaggtagatgattgtttatcttatgcctggaagagtctctgactccacaaagtgatgccagagggcatcctttaccagagaccattaggcttttcagttttaggaaataaacatgtgtatgttaaataacagagcttgatcttggtagtacctaggtattcattaaccttcatctggatgttatttgttctctggcgtaaacttctgagaccgtaaaggatttccccttccttctgttgggttggtgtctctgctgccctgcttcctgctgacttctgcttagtgtgtgctccccgcctgaggcactgccctcagctcgctacagcatgtccatcttcccatcaatccagggaaactgttgggtgcctgcccttatgtacaagcagagctctgaatttgaggcgggaaagaagacagctcacattccatgttcacacgaacatggctgggagtcaatttctctgagagaggactggaaaaatgcaaagtttaacatagattcccaggttataaatgtatgtgttaaaatatccaagggtctaaacccagccccctgaagatggaaagctctttttatagttttataatatttaatggacaaattaaaaattatatataatgccaggcatggtggctcacgcctgtaatcccagcactttgggaatccaaggcaggtggatcacttaaggtcaggagttcgagtccagcttgaccaacatggtgaaacctcatctctactaaaaatacaaaattagccaggtgtggtatcgcatgcctgtaatcccagctacttgggaggctgaggcagaagggttgcttgaacctgggaggcaaaggttgccgtgagccaagatcactgggggcaacaagagcaaaactctgttcaaaaaactctgctcaaaaaaaaaaaatgtatatatttaaggtttacaaagtgatgatttgatatatgtatacattgcataatgatgaccacaatcaatgaacatgtctatcacctcccatagttactgtgtgtggagggactgaggtcaggattttatacctggaggcagaatcaggcctgtctgaaggcgtctgaatgtcacaggtgtagtgggaggccctggagaaagtatgaaacgggcaaaatttgtcttttttgtcctggcccctctttttagctctttgccttcctcgctggcattttttctccttttctcttagccatacctgctgtcacaaaaggttctggaagcagtcactaaagtgtatggctttgtgggatacctcttcctcaaggttgggctttttagcaggaggacagatctgctatttgaccaagacagagatgaagttccagtcgtggaaattcagatgccaacaccagcagcagggagaaacatgggaggtgccgggtgcagaagagtctttggggctccagtaaattcccaaagtctcttacacctagaggccaggtttggcctgagagccacctccttgccctctataagtcttacctcctggtttgacaaactcagcatgtcaggattgcttgggcaaaccaaagctgctggtgacaggcttttatgcttcagttcaagaaacacagcttgactttgaagtgagtgataatagtacagaagtggctttttgcctgtctctctttttcctaacctttgctccttctctcccaaatctttttttcttcttcctcctcctccctgctggcccaacagcaaggtcggcgctgcctcagggcagagccccactggaagggatgctgctcccaagagctctgccctccctgctgtctcgaatgccagctcgcagggaaagccgcttctggttggcactgcaggcgggaccacctggcacagtgggtcctctgggtctgaggccaccccatctgccctcctgtcaccccctgcctcagctgctcggccctcctccgccacaccaggctccctgaaggtgtcaccgaccatagacaagctgccctacgtgccccacagccccttccacctcttctcctatgactttgaggactcctccctgtccaccaaggagaaggaagcagagtcccagaaggaaaacaggtagatttgctcacctggaggcttgtttgagattaactcggggaggagaacacagtgtgttaactgcaccccttggcttggcttctgccatgtttttttgtggatttcagcccaagcagggagcagttgtggcataaacttaagttgctgacccctgactaaataatgaccagtgtttacataagatgcagagaaaattgtcatctgtttgaattaaggggatcatttgttaaaatatgattactagtaatgggtttttaaatgtaaggtttacatgtgtataatgtgtccaaatttatacatcttgtaccaagccaggtggcatgaagtctttttgacgctgaagaatgtatcaaagtcctttgctatctttccgtgccacattgtgagcgggcttttcttcctttgacagttcctctgattctttctctttgagcacatattctgcctctgagccttaccacttccgatctttctcttctaataggtgggtgtctttattttctttcccttttctgtagctttctgttttatattctaatgtatgcatttttcttttcaaagaatgctaatatcttcctacaacgtgacacacaattacagtttgaaccacttcataggtattaattacgtattttactatgaacacttaaatcttataaaaaatggagatgagggcagagggaggtgtgcaaatcagaactcccccaagaatgttcaacaggtgtccacctgtattaatgcctttccctgttgcctgcgttatgagctctctgctggagtggggaactgggaatagagttggcatattttgaacaatcagtcgtccaaaaatcaatagttgatcattctaatgaccatttcatcttagattaattataatagctgacatttattgagcattgtttttgagccacatcctgtattttccatgaaattagtactttattactttacccttgagaggtaggttctattacaagcatttactacactgaggaaactgaggcacagaaaggctaagtaccttgaccagagtcactcagctagtatgttgcgaggcggtttcaaccccaggcagcctgttccagagtcgcttcctaacccgtacgtggtgctgctgtctgtcatttaggcagtcagtcactttctctccttactgcactcaccacaccctgccaaggcaagtccttgtcagcaagatgttttgccagagcctgtgtttcggggaccccagtctgggtgccctactcaacaggaagctgcaccatgttttaaatgaaggcttataggacctgaaccttgaaggaagctccttcataccatgaaaatgaccagtctttatgggtatcagacctttcacctaataaataggagggctaatctagatctatgatcgttaacaatttttgcttactatatctgaaggaattttgaagtttccctccaagttttgagaagcctgtctacagttttttttactataagtttaaattgttgatataatttgtctattgtatatatgctttatatttttttcaaaaccttggggctttagatttaactgatttaattctggaaaacacctatgtatacctacttggcaaagccagtccttagtcaaatgagacttaacttctgtcagaagaagcctgatttcatgtttcagttcaaataagcgagctcatacgcatccctgacaacagtctcatttttggggctgattctcaggtgggcacgtagacagagatgaggcatgagaccttgcttctagtttttccctggataaataaagctccgtcttctccctccagcatacttcttaaggaattccctcaggagtgatattttcctttgcttggtaccatggagatcttatagcacaaagcagtgccccacactgattccacctgctcaagagttttttttctttctaaaaatggaaggtgattttggaaggagaagctggaaaggactgggagaccctaggagcagcatgggaagatccatttttaaaaagagcagatatggaacttcaggatctgaaaattaatttcctctgatttccagaatggctttgtatacctccaggagttgtgaactgagcttctttttttttccttcttttttttttttttttttgtaccccaatcatactatcccagtgaaccaaatttgaattccttgaaactacaagttctctgcaggtctcttccaggtctacagttccaggattgttgttatctttcacacagtttttgcggaatgaatccaacatgactcttacaccttccaagaacaatatctatgtgcaagttaggagctgaacatttgactggaacaaaaatatgttggtgatctcatctttcccagagagtgtgttagcccacggtggtgatgctggtctttctggtgatggtctcggccctagttggggctttcctgggccccagacccttcccgtttggtctgcaagcttcaccgctatttatagtcgtgggggtgggagcaatagaaacacataagctgtccagttgaagatacacgtaagttgtgggggaaaaaaaaagctgcttgcttgtgaatgaaggttgactttgatttaactgagcaaagtttgtaaacttttaaaatcacttctccagcaggaacttggatactgtacaagtattgttcctattgatttttctgatgttcactttttgtggttttcatgggtctgtgtgaccacagatggactactcagtggttgactgcgattgaatgggttataataaagaccgaccagttagtcattaaaaagaaccctcaccctccacacacacacacacacacacacacacaaaaatgctgaatagtgagttgtatgatctagttagtttggctgaaattgagaagcaaaattagactatgaggcatttgaattaattgcttagacattaggaaaaccaaaggagggaaaaacacattctgcttgttttatttccatagcgtcatttaaacacaattttagcaaagtgatcctgttaaaacattctgcaggatgtccacttgtggtgggaagggaattgttttagctgctggagtaggatgacaagctgagcatccaggcagctgctgacacaggcatggagcctgtgtggatcaggctgcatcagggtctcgtcacggagagtgctaggtgtcgtgcggggcagcctccttcccctccctcattgcagtgcttgctgcctggtttctttccctctttgctcattggctttctctcccttctctatttctgcctttgtaggttcctttcatcctttgcttttgtgcttcctatgtggcctgtggtttgggaaccctgttgaaaaattaaaccaacactcacttggagaagcaattaacctgtttgacatgtagagtgttgggtttttaaagagaaaatgagtactcagaaaccaagtcccacaaagatgatgtgttcacagaggataatggaatagagtggtatgctctgagcctctctctgtctggcactgagaatatgccagccatgtgacactaaataaataaggacagcaacagccaaactgaccagaattagcagcacaggatagatgcgggtcgtatcaatattttattttccattataataatgaaatttcttattgaaaactgaaatttcatctctctattcttttttaaaaaatagcccatttttatagtttttcctacacttagtttttgacttttgagtatatttttgcacagttgtgatcaaactgtgtatattatatcctgatgttttcatttagcctatattatcatttttcgtgttgtcacttataaaattggtaatcatttttaagggttgcataatagtccattgacaaataatatatcatactttcgtagccatttccacatttctacctggttaagtagtttttagttttctaccatgatctaaataatgttccactatttgcaggagctttctggaaagaaaaagaaaaaagataaataatgctccaataagtatcttcctgtatgacattttcagtatataaataactataaggttatttccttatgttatcttcccaaaagttgacttactctgtcgaaggatacactcattttgaaatcagtttgctttccagaagggattccaatttctgttgatgggcgtttggactggattctccatgtgcaagaagctctttgtgtccttatagtgactgttggggtcccacacattctaatacagtgtccctaaccagttcggtggacggggtgggtcctgctctgtggctgggtagatttgcgaggcaaagctctctgagcctcattatttgtaagtaatcctgagtgtctgagcccatgcaagggcatcaaataatgatttgttttctgggagtgctctgagtgatgatacctaaatatggtctgctaaaggacgtctagtctgaaaaacagaaatctagaattttacagatcttgaaatttaacttgtcagacatgtctggaaaatcatcaaatctcatgtaaacctcatggctgtaattttggttcaggggaaatgttggatgaaaacatgaatacatgcacctctaaggagcaggccagtccagaaagcctggggacagtttctcctcaatcactgaacatgtgatgggattacatttaatcagtgaaattgatatggaaatactaaagtggaattttaaataagatgtttctttagccaaccatatggtatttcttacagacctgtgatggaattaacactaattgtgccaccatgtgaggcaagaaaaatcttcatggttcaagtgaaattgatttggatttttaatttatgttagcaaataattttaacgtacattttaaaaaacaggaaatgttagggttttatttaaaccctttgtcataaatcttgctgcctaatggttttagactttgggaaactcctcttatgagaaattatcagaaaaaaacagggaacaaacctctttaggtagaattaccactaacagtggtagcatttccagacctgtttctcttgcaaaaattaaaatggtttgctaagtcttatttactgacttgtacttatttctctatccttttccccccaacttaaacctctgcacttcttagatacagcaattttggcaataactcttatcactcctcaagaccctcatctggatccagtgtgcccaccacccccacatcatccgtctcacccccacaggaggccaggttggaaaggtgagttcgacaagcacgctgatagcttcacagtcctcaagtgaggggaatcaatttggttaagtgtggttaaaggaaaaatataaataaaagacataacatgaagtattttcctttacagaacattgtccgaagccaggaatattttctctttctttcacactatttactaagcaaatattttattagaggtgatattttaatattagcgtctcatccccctacacactttccatagaaagtataaaaatgtcttctaaaatatttgtgtgaatgttttgattcattccttaaaaactgttctagattttacgtaagctctgcaatttgttatatacacatcagttttcaccattgaatgattaaatctgtgtaaatcagaaagtagtgggcccattaaggtgctgtataattaatccaggacctaccagaagagaaaagaattgtatgggtacatggaaggaatttaacttggcaagagtattagaccaccagaaattaactgattatgactcccagaagcaaatgattgcccaaggatgtgtttacaagggaaaggtaagacctgtaattttagaacagttagaaagttaccctcacatggcaagagtgctgagttagagaagactggttaggattccagctcactcacttggaagttatttaaccctgagggtaaatgccaattacaccaacccataccttagagggtgattttgatgagcaaacaaaagtccactcgggagtgctgtgtgaagcccaccatgtgtatctggtggaagctgttagtgtaggagatgatagcatgtaacttccagcagctcctcattcatcaggaatctagacatgagcgacatcagagatcacttacctcaaatcccaaatttaaagcaacctgcgttccacatttagatcctcttctatgtgtattctgaagtatgttttgccgagtgctgctggtgattggaggtttggttgggttgagagcaggcaagaccttaagccctgggaggaagggaggtccagtggggtttgcctagtcacatgtcactgttaacttctaagatggcatgtagatcctacggtgtcaagctctcagattccacagtccagtgtggtcctgggctgagcacacttgggctaagttaggtcttgataataaggtaaccatttgattaccccgaagacaccattacctgtctgtagttctgtcctttaccctagggcacctcctgttgggattagctgaagttacctgtagtcctgaaaaggtcaccatacagatgacccttgtcaaatgggatgtaagatttggggccaaagtgagtaatattggagtcagactgatacgacgttgcacatcttgcacctgccaagctgccagctcctcagggactagaaccaggctctgttcattggtgtgttccctacagtgcctggggcctggcaatagtagagccacagtaaacactgatggaaggatggggtgacttagctgctcactgcttgggaacactttggaggtctgtgaagttataaagttatacagacaggggtccatgtggcccacaagattaccaaagccctgggcttggatgttcttcccaggttctgaaagggaagccccaacctctgcccgcttttctgccactggaatcccaggtccaggtttgggctagaagatccaggatcctgaaggactcctgtctgtgtctccttctctgcctggactggctgaagtgcccctggggataaggagggtgggcagttaaaccaggaatggtagaattggatcccagagcctgggcgcggtggctcacacctgtaatcccaacactttgggaggccgaggtgggcagatcacgaggtcaggagtttgagaccagcccaaccaacatggtgaacccccgtctctactaaaaatacaaaacttagccgagtgtggtggtgcacgcctgttatcccagctactcaggaggctgaggcaggagaatcacttgaacctgggaggtggaagttgcagtgagccgagattgtgccattgcactccagcctgggtgaccgtgagactctgtctcaaaaacaaaacaaaaacaaaaaagacttggatcccagagtgccttgaacatcctggggaagaggctggactttatcctgagaccactggagctgttcaagtttggaaacaggagacaggaggcaggaggcaaccaattctaatttgttagtagcatagaacaagccactggggtgaggctgcaggaacaagggctgccgcgaggcagtgtcagagtccaagagagatgaccgtgcccaacatggcactggctgtgggacttgccaggagcagcaggtttggcagagttggctgccgcctggagggtaagaggagacgcaaaatgagtagaggttcaggcttgcacgagtgtatggatgttagaaacaaggaactgggacgatactggaagaaaagcaaattgggtggagacttccagcatggggcatgggtggtccaaggagcctgtctgacatccagggagatgttccagaggccctggggaggtgtggactcagcagtccttggcttgaagaaggctctggagttaaatccctcagagagcctggcattgggatggggtcactggggaacagcagtggtgggatgactctcctaagttcctttccttcttacagtacgctgttgctgtaggaacttggttttctttaccatcactctatccacgagcgagtacggtagcttctaagagtctatcacctcctttacatttgcttgtctttttcactgtcaccttgtgtggctctgaaaaaacatatgatgaatcatttgacatatcagatgtgcagttttattaagaccaggaagccactggacctggctgtattaccactttacttatgttttgtaagtgggggaaaaaaaaaaagaaataagaggatcttctaactccaaatcatacttgtgcaccatcgcccaagaatattacatcagttgcacttatgataatagacatttttatatagtttgaattttttctttgtcatatttgacaactgaattctttggatatcacccataatctaatttcacctatgcaagtattttttgcccattaagatgtgtgattatttttactgaggtatatatactttagtagaatttgtaagatttatggttggtatgttttatatatacatatattattaaaaccaaaaaggaactatattatcaataatggttacatttctgcaatgaggatgcgcgtcttctgtgatcatacccctgactaataaacattgtgcctgagccctgtacaatactaggaagttctagaacttcattcccttgatttggaaacaagactacttcactgaagtcctgggataatcaggccaactaaaacacccttcaggcacctcggcccactttggaaatgcaagtggacattgtcatgagcttggagttttccatttcttccccaacaagtatattcatgtgttagatgttgataaaacttggaatgataaattgacataggaaggaagtgctgaagaaacaatatggaaaattaagtcaaggatattaaaatgaatccatctccatatctcctattatagctttgttaatagggctctcttttagaaatagagtaatattttcatgaagtttggaacttaagagaaaacaaaacaaaacgagaaaaccagaactatctgcaaaggccctcaggaatacaagatgcaactgtttaatgaaagcagacttttaaaacacttcactttttgaaaatgtactttttgagcagataatttctaaatgttttctttgtgaaagaaaataaaactacaggaatatttgaactatttgtgttcaagtattcaaatgaaacaaacaagcaaacaaccacacctcaagcgcatatgtggttgtgaggctttgggaaaggccgggcccatcctcttcccttccctgtagtgacatctccatcttgtggactttctcatcaatggcggctggaggcttgccttgtcaatgtgaggaaacagtacgcccaagccctgggactgaaggtaccctaagacagtccttgttctgggactagagaggccacctagagtaagcctatcctgcactgtgagtgctcagtgggaagaggttgtaggaacctcaggcccatacttaggacgccagagaggatttctctgtggacatgctgtgctgaaacccaaaggatcatatgcactttaaccatgcattctgttctcttttccacttgtaataatgccattgtttactataaatgacactgacatggctgtttttcagattaatgtcaagagcccttagaagatcttgggaattgtctttctcatagttgtcccagcagagttcttcctacttcctgtaagattataaacccagatataagtaacaacatcttgttagggagtaataatggataataagggatggataaaggacataaccttttgtgtgtgtgtagtaagaatacttaacatgagatctaccctcttaacaatgtttaagtggtcaatatgttattattaactataggcactatgttatgtaggagagctctggaacttctataattgtagctttatactcatcagataataactccttatatccctctttcctcaatcccctggtaaccatcattctattgtctacttctatatctttgaccattttagatgcctcatatgagggtcattgagttgttttttctcattgtattattgaagttctttataaactgtgataagagtagcaatcacttttctcattgttcttttttacttcatttattgtgtgtttaccatgtagaaacattcaatttcatgagtaaatcttttctattttcatgattttgtgttcctactgaagaaagccttttttctcctggtttcttctagtacttctgtagctacattttgtcacatttaaatgttttatctatctggaaattattttggcaaatagtatgaggcagaggtccaacttcagctttttcatacattcaacaacatgtattgaataaccctttgtttccctaccgtgtgtcagatactaacaggaagggaggtttgtttatgcatcggtgtgttcaaactgttcttaggagcatctcccctcttcctgctgtcagccttccctgatcagccacgctgacctctcaggagctctccttcctcccagtttttggctttaccactttcttcatggtcactggaatacaactgtgtcatgtgctgccatggaacagtcctattattgcatcatctgcttttaggaggttgtgtacagtgactgacagtgctatagtaaagaacagtcatattttaggaagctgggaaagtggaagccttctgtgcttctgtggtggcttctcccagcttaagctctctcttatgggaatctcacttgctgtgatccccttgaacacctatctccaccatgtttatggagacttctccctcagaattcaggtttctgtttccatgcatttcctgcctgttggcagttactgtagttcttccagtgatggcctgccaggcttgccttttgactaccaccctgtgtgtaacttgtgggtacctgtgccttcttcatctttgttgccaattccaagtggactgtctattccctatgaatccacatgcttgtgtcttcccattcttgtctgctttggcttttatcatttccttccctgacctcactagtcatctacatgtgccttgaagttctacttgggtttttgaatgactgtgttttgtggatatgtgatctgggtgttttgctggatcccagatgcttgctggctgtgttctatcacttggtcaacccaatacttaaaaaaaaattgtcagtggaattgagagccacattgtgcaatggggttctagtttttaaaaaaattaaattggttgattaaagtacatttttaaaaaacaaacttctctgagaaaatcccaaatagaatgtaaaataatgggataaaggacattgtttttctatgtgacacagttaatggcacccagtccacaaatgccagtaggaaacaagcagtacaaatgtggtctgattccccaccattcaaagatgctgtgttctccttggactgcgcagaagcagtcttcccacttgcctgccactagttcctgacagcagtcttgttacaaacaataagagtccctgtaaggctaaatgtggtccttattaattgattgcgttacatccaaagcacgcaagagaagcactggttctgttgatgcagtaagttcagagtggggtctggctcgctaatggtaggttcacaaagtgactgtgggccctagggaacctgggctgtgctgtgctgtgggactgtgggtcctcagcaggtactggagattctttctcccacacatgttttagatctgacttgactttttcccaccattcctactcccatctttgccatggtttccagttgtcacttgctacattagttttgtaccattattgtacaaagatcacagagcaaaaaggggtgtgtgtgtatgtgagagagagagagagagagagagagagagagagagagattgagattgagatttctccttcagaaaaatgtattactgggctgggcgcagtagctcatgcctataatcccagcactttgggaggctgaggtggaaggattgcttgagaccagcccaggcaacaaagagaccccaggtgtggtggcttatgcccatggttgcagctactcaggaggcagaggcaggaggatcacttgagcccaggagttggcagctgctgtgagctaaggtcatgccactgcattccagcctgggtgacagagtgagaccctgtctcaaaaaagaaaatgtatattgctagatcactgaatgtttgttttcctatctctttccccattccttccctcaaagcccagtaatgaggactaaataagttttattgttataatggaaggatactgagtttccagttaattttggaaattatgtatgtaggatacacaagtcttacatactcatatatttcattcaacaagtacttattgagtgtatcgattgaatcagacacagtccctgacttcacagggcttacacttcagtggcagaagcagaagatgagcaaatcatctgcaaataaagagtttccactgcagtgaatgctgcgaagaaaatgaaccttcataggagagctgaaaagagagaggcaatcaaactgggggcctagcacaggtgctctgttgttgtgggggatacccctggcaaaaggtctgggaaactgagtcactaatgtaaggcaaattgctatttgctctgagattggcctggtgggggggcagggaggttaagagggggataagaaaatggagcgagtccatatctttcttcaaaacagggttttgcaaatctgggaaagatgggagaccatttggaatcaatttagcatttagagaagaggcaagtgtgcaaaagaagagtgagttggcctggagtgaagaagcagagaggagatgggaaggaagaatgtgccttggtcctggccagcaaggcctgggagccacgtaacacaggagatgctggtggcagtcagcgctttgggaagcttccaggagattggcaaattgtgaagccaaacaggtggacttggggctgtgacaggagaggactgacctcctttgggccggaggactcacttggtcttagatggagggtggaaattaagagggaatgagagaactggcaagaactgctgtatgccaaagtcagggcctacaaaggggccagtggacaggctgaagcatgacaacagccagggcctggaggaatggcttcatgctctagatatgagccagcacagtaatgtgagactccatgtgggaccagtctccacagcacactgcgtgagccctgctattccttcccatggccaaggagctcagatctgcactgaagcagtgtgtgcaacaggctggagaatagaaagcaagagggagactgaaatccacatccagtctctgatgatggctgtcttcaggattgtagcagtggtgatgagaaaagctgcctgtttcttggagatgcctctggggcttgctggtttcatcatgagagctaggatatgaccctgaagctatgaaggaagattcttaatttttcttttttcagggcaagcaaatgccttttacaactgggcataacttagagttacctcttgtcctgtatcattagacagggtgatcctcaatttcatagccaggttgtgaggacgatctcattgctcagcatcatttcaatgccattttattattatttttgacctctaagtcttcatatcaaattatctacttgtgaattaagtgctaatttcaagtatcagatattttatgaacttagtttttgcttttgttaatattttaccagagatgataatttactttttaaataggaaacatcgaaggtttgcatctttcgcaaataagattttacttaacttgaacttaccaagggatatttttttaaaacagcttttgcagtaaaattgacacgcaagaaacagcacataagttttggcgtatgtgtacaacagtgaaaccctgaccacaatggagataatgtgcatatccatcaccccaaaaatcttctgctgcctctttgtgattattgctgcccttccccatccctaagcaaccactgatctgcttcttcattgtagattcatttgcatgtgtgtttttagcattttatataagtgtaatcaggcagtatatactctttgaggggagttgacttctttcagttagtataattgttttgatattccttcatgttgttgtgtgtttcaatttcttttgattgagtagtattccattgtgtacataaaccataatttatctgtttacctgttgatagacacttgggttgtctttgtatgtacatgtgctttcatttctcttgggtaaatatagtcattcgtcacttaatgatggggctatgttctgagaaaagcagtgttgggcaattttgctatacaaaaataataagggactattctgaacaattatattccaataactttgacaacttagatgaaatggaagaatttcttgaaagacaaaaactaccaaaactcacagaagatgaaataatctgtatgaattaatataagataaacaaagatagagacattgaatttgtagttgtaaactttcccatgaagaaagctccagtcccagatgtcctcctaggctatatggtatagcctgttactcctagactgcaaaccttgcagcgtgtaactgtaccaaatactgtaggcagttgtaacacagtgagaagtatttccgtatctaaacatagaaaaggtatggtaaaaatacagtattaaagagaaaaaaatggtacatctatgtggggtactcaccatgaatggagcttacagaattgaaagcatgaacattactgttcatgcctaggacattactgtacatcactgtagactttataaacactgtgtactgaggctacactaacgttattaaaaaagaaaagtagttgtgctacaatgttatgatggctataacatcactaggtgatagtacattttcagcttcattgtaatctatggaaccactatcttgtagaacattgttgactgaaatgttaagtagtgcatggttgttactaaaagtagaattgccaagttttatggcaggtggatgtttagcttttaagaaattgcctgtcttccacaatggctgtacatgagtaatgctcataaaatgaggggaaacatactccttcctctttagctttctagaagaggctgcgtagaattagtactagctcttccttaaatatttcatagaattcaccatgaggacatctaagactggagctttcttcaagggaaagtttaaaaccacaaattcaatgcctctaatagatatttatcttatattcttatcagatcatccatttcctcttgagtgagttttagtagatttgtctttcaagaaattcttccatttcatctaagttgtcaaagttattggaatgtaattgttcagaatagtcccttattattttttttagtatctgtaaaatctgcagtgatcgtatttctcattcttaatattggtaatttgtgtcttctctctcttctttccaatcagtctggctagagatttatcaatttttttttgaccacaaagaaccagtttttggtttcatttaatttttatactgtttttctgtttgttttattttcttgcttctgctcactttgtgtaaaatttgctctttttttcagttaggagatgaggtcattgatttgagactttttatcttttctaatataggcattcagtgttacaaattttcctctaagtattgcttttgctgcattccacaaagtttaatatgttgtgtttttatcttctcttaatatgcttcttaagttctctgtcaatttttaaaaagtctttaccccatgggttattttaaagtatttatttagcttataagtatttgtggatattccaactatctttctgttactgatttctaatttaataaaattgcggtcagagaacatatgttgtatgacttggatacttttaaatttattgatatttgttttacagcccagaataggatcaactgtggcaaatatactgtgtaaacttgaaaagaatatgtatcctgatgttttggggtaaaatgttctgtagatgtctatttggttgatggtattgttctagtattccgtatccttagtgcttgtctgtcttgttctgttactgagagagtaataaactgcattctataattttgatttttaaaaatatgttgctgttctattagttttccctcgtatcttgaagctcttttattaggtgcataaatatttacaattgttatatcctactgatggcttgactcctttcatttgaaatgacctttatacctggtaacatacttgattcttaggtctactttatctggtattaatatagcctcagctttaaaaaaaatagtattaatatggtatatcttttttattatttgaacataaattaggttttatgtttcttgtaggcaatatagtgttgaatcttttttttaatccagtctgataatctctaccttttaattggagtgtttaaaccatttaatgtgattattgatttgtttgagtttatattttttatttgttccacctttttattctttcttccttttggggggttgcatattcttgattagttcattttctctcttttgttgccttattagcaataagtgtattattttagtgattgcattggggtttatagtatacattttaatttatcatagtctacctttaagtgatagtatgtatttcatgcatagcataacaaccctgcaacaacacactttcattttttttcttccagcctttatgctacggtgatcatggattttacctttaaaatgttgtaaactccacaatacattgttattatgtctgctgtaaacaattgattatcttttaaatatatttaaataataaaataaggcttatatttacctgtgtcattatcttttctaattcttttttatttttgtgtaaatcaagatggccatgtggtattatttatcttctgccaacatttcttttagtgcaggtctagataatgaattattcctgtttttatatgtctggaaaaaatatttcaccttaatttttgaaagacagttattgctaggtaaagaattataagttgatagcgtttttttttctttcagtactctaaagatgttgcaccactttgttctactttacattgtttttgatgataaatcttctgtttttatttttatacctctgcatgtaacatatcatttttttcctttggctgcttttaaggttaactctgtcattggtttttagcagtttgattttgatatgccttggtgtagttttttcatgtttcttacgcttgggacttgagattcttgaatctgtgtgtttacagttttcatcaaattgcgaaaaatcttagtgcttatttctttaaaaatgtttggtactttttacctcccctttcttttgataactctaatagcatgtatattgggtcatttgaagtttccacaaagttcactggtggtctgttgatttttttcattttgcttcattttgaatgtgtttcattttgaataattatgttgctgtgtcttcaagttcgctaattatttttcttctgtggtgacaatctactgtttcaagtggtctctttcttaatacctttcatattttaacatgttaaatattttctctagcttcttgaatatgtggactatagtcataactgttttatcattctccccaactaattctatcatctgtgtcatttctggattggtttcaaataatttactttttttcttctgattatggcttgtatttttgtacttctttgcatgcttggtcatttcttattggatgtcatattttgtaaattttatcttgctgggtgctggatgtgtttgtgttcttataaatatttttgagctttgttctgggatgggcttaactcagaaacagtttgatccttgcaggtcttgcataattagctttgttaggcaggaccagagctatgtttagtccaatatatttccactactgaggcaagacacttgttaaaactttaaccagttccctctgaattatgaagtttttctctgtaactgttgggaacaggcagtactctctgccttatataatttccagacactgtttgctctaattcatttggatagttctttcactggccacagattactttttacatgcatatgctgaacaatcctcacctagttacttgagggaaaccttctgcagatgtacagaggtctctctctctctgtatagaccctttctggtatgttaccctgccagtgttatccccattggcctctctagactcccagctttgtctcctctactcagggagacttccaggctctgcctgggttttccctttatgcaccacagcctgcaaatgttctccaatcagtaagctagggcaatcatgaggaacacctcctttgcttttcatctctcaggaatcactggccttcaccatctgatggccagtttcttcagtgctgctgtttcatagattttttctggtttttagttgtttcaggtacaggtaaatctggttcctgttactccaaatggactgaaaatggaagtccaagagctttccttttttcaccactgaaatagactccagttagatgtagaaagttggatgagttcagtgtgccaacttttactttatgggaaacttttattagaaaagctaatttctgtaaagagagacaaaagaaaaaagcaacacgaaagtgataggtttcattgtccataaatttgtccacttgctacaacatgtgtttttgtggcattgctcatatcactgaagtagacaacaaaattcagtcagtgtgtattgatggcactcagacacagttgctgtgggggaaggaggagaagcaggcgacagggactgcttctgatgtgttcccaaaggcaacaagggagtaagccgtgccagaaacaatgttcattcacaaaacagtgaaggaacgaaccaatcatttgtgacgatgtgccgaaaggacacatccaggagtctggagaaataaagagcagtgtccactgtggtcatcaagggaggtgtcttgaagaacttgggtagagaggaagtgagataccactaggcaaaggaactagacttctttgggaagcaagatggtgagtggcttgattggcatggaggccatcttaggggacattttaggggacagtggtatatgagttttgctaataggtcatattgtaagataactttaattgcttcaacatttcagattttattggagtccgccaatgaagtgccaacttcctcagacagaaatagagaaaatattttcaaaacccatcctgtttcagtcagcttttaactacataagaaaccaccaaaacatggtggtttaaaacaacaaccatgcatttacctcatgatcttatgggttggtaattttggccaggctcaccttgaaaaattactctggtctgagccgggttaacttgtgtttgcagtcagccggtcgttgatcatctcatttgatatctagcaattgtctggctatcagctgacttgatggggcagcttggcaccatgcctcacggcccagccacctcgcccagacttgttcaaatggcagtggtgtagggttcccaagggcaacatgggagcaagccccggcgtgcagatacttttcaagcctctgcttgaatcgaatcatatttctgattgctacattggccaaagccaatcacacgttcagcctagattgaaggggatggagagagactgctttttctttaaaggagttgctgcaatattctgtgtctatttttataagaaactgtgcgtctgctaaagatttattgtgcaataaacaaatagaagagtgacccgctgactgttgagtttaaagttactcactttgttcaaaaagtaattgcaggctatctggcagacttaaattatattttgaatggttcttaagtgttttaaaagtgaaactagtgtacttcctctttttttaatccttttcttctgggcttagtgcaactgaaaaatctagtatattttaatctctcctatttgtcttagccttatctttataaagatttcctgttttatgtttagtctatttgcaggtaattagataaacaaagtgccaactcatcatcgaaaaagaaagactgtcattgacagaaaatctccccctcagcttttgatcatctgtctgtgttgtctttgctcagcctgggcagtgggtttgttctgttaagagccaagagacattccaaactacctaagatggagattgggctagttgtcttgtatcgttcttctggcaaatcacttttctgttaaaaaggcaagaagtcagaaaaaggagaggttactgtttatgcattaaaaaaccccattgtgttatggaacaaatgaactgtttatttccgaatctaagaagttattctcatgatcaagtatgtaattttggttctttctgaaaccagcccttttattattcaagtttgtataatggaaataatgttgaattcctatgagaaaaaacaatgtaagccatttactttacctctccctctcaaaaaaagtgggaacctgagtaaagtattcctaatcaccacttagtaggttttctgggtccctgacagtagtgaacactcccagagagcaggcagagggagaggcacaaagaaatggctggagactatgggtgaacttagcctgggatctggacaggggttcctcgatctgtcctccacactcagcgggaaggagggaactgcagggcattcctgaagctaacccaaggtcaggtggggagtgagtagccacagctgccttaggacccctttcttctgttgcatcctgctccctttccattccattgcttcacggacagaaatccctctctgagatacatatgtcagagggatatatattaaatattagtttaacacatatatgagggatatgtatatccctctgatatatatattttggttctttctgaaacaaattcttttattattcaagtttggataatggaaatgctgaattcctatgagaaaaacaatgtaagtcatttactttacctctccacctcacatatgtgttaaactaatatttggatctaaaatttcagtctgccattgatttccactgtgatttcagagtatattttcaaaaggaaggaaagtcaaaaattctgatactgggtttagggaactttctattgcttctgtgctgaaatctgaacaatgagccctgagttttggtgacactgaagccttggctttcaagttcacctgacttacgatgcacctgtgttttctgtcacagcctcagtgcagtgacagcctcatgactagaaaacagtgctgagggttgaatccacatttatataccaggggatgcagatcctcttccaccctcaattttgtgacaggcttgaggcccttcttttaaaaatttatttttatttttttgagagacagggtcttgctctgtcacccaggctggaatgcagtggcgtgatcatagctcactgtggccttgaactcctggccttgagcagtcttcttgtttcagcctcccatggctcttcctgttcactggtgaagctgcttgtcaattttgatgcatttattcagcaactaggtgtctggttggactttaaattccctttgtggttcttcttgcattcttaaaatggaggtcagtaaaactttttctagtttcagtgacttgctaagtgagagctgaagttcctggaacccctgtcacttggctaggagaatatgaatacaaataacgctaactgagacagtgaggggagcatcttggggcagctccgagacttcacatgaagacaaacatgtaaagctgtcacatgcaagcacgtgcccctgggagtaagttctgggataagatgtcacaaactcttatgcaaagaagaggaagacttgagaatactctatgatgcacactgctctggatttgactcttccagtaacatttttttcctcaaaaaattgaacttgaaatgtactgttacttctggggatttttgaatgccaatactactttttgttgtcctgtatttcctttccctggaatcttagggccctttgagctcagtgtcttcccagcgatgggaggctagggaagaactgccgtgattgtcagcacactgggttgtcagccataggacaggcctcctgcacacctagggaaggctggctaatcatgtccccaccctccatggccacctccgtgcaccagaaatcagggtaagctgggtgtccctggccatgcaagttcttagctgtgtcctctgatgctctgccactcacatgtctcagtccctttccacgtggtctcctctgttcctttgcttcctgctgccaccccctttctctcttcatacagttggcatctttttttttttctccctacaactttggctccttctctattttatcctctcacactttggtctcatacagggccaccaagggcctccccacctccaggcccttttgcttttgcttctctcaaatgcacaatctctctcccagtgcacagccctgagacatgactatgattaactcagccttctgtgccaggagcctcctatgccactggatagcctgccttttgatggggtgcctttggggcaggcacccaccctgcattcactcagctgttgccagtgggaagggtctagtgcaaaaaactcctctgtaggtccttatcataccttagagaataggctgggggtctgggagcacggagactagcatatacatattattctgacttcatgcatcctgtttattcaatcattagttgattcatcagacagtgaggctcttctatgtgccagggtagagatgaatgagaaaataggatctgaccccaaaacgtaagctgctaagaagacattatttggctcctaaaatcattctcctgtataaactaccctatttttggttgtgtttctgaattctagaactggatctaactattgatgttcagttagcttggggtttcaaagatatttgatatacaagttaattatccacctaagaaggacttttatttatttaagagaaatagaatggctttaaaatatatattcaggacttacagaaaattttagataaatctagaaagttatagagcaataaagagtatcagatataacattgaaacccttatccctttgatttcccttcttccccagagatgatcactacactgaatttggtgtttgttattctcagatatggttttgtttttatgaaatgtacatgtatcactagcttgtagatttgccatacatgtatttaaacttcatagaaatgatagaatatggtttcttttcttcagtctacttttcactatctatatattttgctttggggaattacctatgttcatatcattctagttattaattttcacagatgtagagtattcctttctaaaaacaaactatattttgtttatttgtaggtatttgtataattctaattaaccactagcaagcaataaaaacactgcaacatatagaattatttaccatacatgtctatcttctttatgcatgcaaaagttactttctagataaacgtagaagtggaattgctaggttttaggatatatacatcttcaaatgtattaagtgtttttttttccaaaatgattatattaatttcgacttctagaagcagtgtatgagttattctgtgccaatgggttagtgtcatcagacattaatttttgtcaatccataatctgataggtgtgaaacagtatatcactgtgggttttgcttgcattccttttccctgatttctagtgaagatgagcatcactcatatctgtattggccatttaaaatgctcattaccctttgcccattttcctctgggtagtttgtcttttgcttactgatttgaaggggttctttttgtacaatgtatactaatcctttgtagtttatatatgttacaagtagtttctcccaggttgttgctcttctttattcttatgtagtctttcaatgtgcacaaattttaaattttaatatatgcaaatttatcaaatctttcctttttggttgctctttggtctaaaaaaacttccatatcttgagatctcaatgttgtaaagttttgtcttttacatttttcacttaaactatctagaatttatttttatatttggtataaggtgggactagttgtattttttttttttttagatggagttttgcttctgttgcccaggctggagtgcagtggtgcaatctatgctcactgcaacctccacctcccaggttcaagtgatccttctgcctcagccagtagctgggattacaggcatgcgccaccatgcccagctaattttgtatttttagtagagacaggcttctccacgttggtcaggctggtctcaaactcctgaccgcaggtgatcccgcctcagcctcccaaagtgctgggattacagacatgagccaccatgcccagcctgtattttgttttatatggctaaaagttgtctcagcaccatttgttaaacagtccatcacttccccacagatgtgtaataacacatttgacatgaatcaggattctatctgtgtatgagtctgtgtcatggctcactgtctcactccattcgtccatgttttcatttgtgcaccaagaccactttgacgggcaatcattgtggtttcagaatgggcttcatattgaatgtggccagtgctctgctttgttcttactcaaaattgtcttggttatccttaaaacctcaggtcctgtgtaaaaattttggactcagctcataaaatttcatgaaaaatccttttgggatattgatttgaaattgtattaattggaaaaaaagaattggcatcctgactgcattgatttttttcaatacataaatgtgatatagctttcatttgggtcttttaataaggttttataaaggtctttcatattattagttaagtaatttcatagttagcttatgattaacttggtaaattgttgctaatgtaaaaatgtaattgctatttctatgttttatatatagaaactttgctagactcttaataaaataacataggttttcttggattatctttatagatggtcagattatctgtaaatagtgatgttgtatttctttccttcccttatgctttttacttttcttagtattctggcttggaccaccagaataatgtcaaatataagcaatgatggaaacatccttatattatttttaacagtaaactgttcttaatatttcagcattaagaatgatactggccaggtatagtggctcatgcctgtaatcccagcactttgggaggccaaggcaggattgcttcagcccaagagttcgagaccagcttgagcaacatggcaaaaccccaactctacaaaaaacacaaaaattaaatgggcatgatggtgcatgcctgtggtcccagctattcaggaggctgaggtgggagaatcacttgagctcgggaggtcaaggattcagtgagccatgatcattctggcctgagtgacaatgagaccctgtctcaaaaaaaaaaaaaaaaaaaaaaaagaagaaagaaagaaagaaagaaaaaaagatacttactctagtttttaaaattttccttgccaaatacccactgtcagattaagaaagttttcttctattactaagcatagtaaagggtttttttttttaaacaaatggttgttgaatttaaagctttttctgcatttgcagaggtagccatggtttttctccaataaactattaacgtggtaaattgtattcatttatactgtcatcttacattacccttacatttgttgggcaaacccaatgtgattttgtttcagatttttgcgttggtgttcataattgcaaatagtatataagttgccgtcttcacactgttcttatctggctttagtgtcagagtaatatgaatcatgtaaaatgggttgtgggagattttttcttctttatgttgtctgaaactttccatatgtctaacttgaactcttccttgagtagtagaaatcacattaaaaatctgactttcgtggattttttttcatgggtgtgaatatatttgtaattaattaactcaatttcttttgttaacagggctattcaaaatttctatttctttctcaatcagatttggtcaattatatgtttttagaaaatcatccatttctttaatttttcaagtgtattataaaaatttccccttatttttgtaatgttttttggtcactatatctataattgtatttacctgtcattcctgaatatgctcatttatggccctttttcttgaataattttgatggaacttgtctattaggtttttcacaattataaaccagcttttagttttgttgatttttgtctatacaccttcgttttcctattttattagtctttgctctttatttttttccttttgccttctttgaatttattccactgttgcctttccaattgttgagctgatcactcattaatttttactctttcttttcttctaatataaatacttaagacaataaatttccttctaaatactactttagaggtattctacaaaacttcatattcagctttttcattatggtaccctttaaatgtattctaattgtccatgtttttttttctgacctaagttattagacatgttttagtttttccaattatatggatttttttcaaatttatctccttgttattgattttcaatgcagttgcattatgatcagtaaggtagctcgtgtgaaaccagtttgtggcattcattcttgagctttgtgacacaattgatggtcaatttttgagtagtccttatatatttgaaagaatatgttttctcccatttgggcaccaggttatatacatgttaatctattagataaaacttattaattgggttaaacaaatctattatatgcataacagttttatcaattactgtgcaagaggtattacaaacctctttactctgattgttgattaggtttggctggatacagcagggaagaattcccacaaaataataatagcttacaaaagttagaagtttgtctgaacttattttatgaggaagataaataaactctatctatgccttagtgtccagagctgatggaaatagttccatagtgagcctggaatattgaatttggttactccctccctgtagctgccagggatggtggtttcttccctccattttccctgccacctatgagtgatagccataggtgactcaccttttctagggagaacatctgtgggactcatggcagtctgtaatatgaaagtcacatctttctcctgcactgagatctgtgttccccaccttgcaggtatatttttcactgaatccaggtaggattttacccaagctatatccttggataaataaattggcaaaatatatttcataaatatttttctctttgttttggagatttttttccataagtgaaggcctcaattgtccataacagattttattctccagagatccatcagactcctttacatagctaacccctttccttatatgtcatacggttacttgattttctcttctcccactcattctctgatttaacatctcctgtgatactcaccctgtggtttctctccaaggctttcacacacattttcagtgaacagtccagactcttgtgtgatgttactaataccactgcctgtcctttgaccatgctgagtccttggatgcttcttgacatagaatgtcatagaatgaaatttccttaattctattcacatttcagcccattgcaagtttttttgtcctcatctgtcatctcattgccttgttcaattattctaaagaagtgtattgtgagactgatatatagtaaaatatttttagtgcatgtataatagaaaatagttttataaaatcactttttttaaaattttagatttggtggtacatgtgctggtttgttaatcggtatctttcatgatgctgaggtttaagcttctaatgatcctgttacccaaataatgaatgtattacctgatagataggtagaaaatagttttagattgaaagctgattctagctcatctacgtcttaacatagaccaactgtaaaatatatatagaatgtatatacattcctggaatacttctataactcccattcttgagggctgcttacatgtcaagcatgttgcttgctattttctgtctgttaccaccttttctcctgcgagcacactcacagtatgatacttttccccaatttacagacaaaaatctgaaacaagaagacccgaggcattcagtgattttccccaagcattgcctaggtaccggcagaccctcaattctaaccaaggtctgactggtgcttacttcagtacttttaatcacaggccaagcaactgaaacattaactcattgtatctccaggtcatcaccgagtggtcttctcacatcatccttcaggcagcaccaagagtcactggcagcagagagagagaggcggcggcaggagagagaagaaaggttgcagagaatagagcgggaagaaagaaacaaattcaggtaagaaggatcttaagattttttttaaatagtgagttaaaaattaaaggcatgtgactttacaactgtatacatttaatattggcattaaaggaagtaatgaaaattctgtctgtatttttaaggaagagaaagacatacctgaaataggctggatctggtttgttatggcttttgtttctctaaccatatggcaggaagcacagtcagccaaatacaattagggactcatgtattcttgggccctccattacctacctcgtcctatccaggccctccggatgacagagagtgtaattatcttaacttaatttgccatctcttcctaatggtcctcatgttttattcatattctatcagatgcccaaaaagaaatgcttttcccactttctggtttgctttttgatccctgtaacaatcttcaatattttttgtaaacaataatctcttgctatgtggggggaaaagtcattgtgttgattactctcagcccatttcccccgatctcctggtctctgtacagcttcaaggatgtgttcctggctatagctcattccaggttccatatcttggcctgtctgtccccactgatcccagtgtgcctcggcttctccttcagccagtccacctgttctccacattctccaggtcatcctccttcacacccatcccctgggcttcatgctgtgctgtgctttatggaatgaaaaacagttgctgtatctctccttacacattacttccttctcctcttccttatatcctttttcccttttccccctttcttccccacctcctcctatactttctcttcctccttaatcctttgaagtcatttaccctatagcttctacattctttcttttcatttttctccccatctctacctcctgtttccttagttcagtttctttggcaaacaatattcccatcaattattccccattatatctacaaggaatgtaaggcattgttaatgaggatttacagatttaataacgtgtttttgttttgttttgttttgttttttgagacagagtctcactttgttgcccaggctggagtacagtggcgcaatcttggctcccagcaacctctgcctcctgggttcaagtgattcttcagcttcagcctcccaagtagctggaattacaggccacaccaccacgcctggctaatttttgtaattttagtagacatggggttttactgtgttggccaggctgttgaactcctgacctcaagtgatccacctgcctcagcctcccaaagtgctgggattacaggcataagccaccatgcccagccaataacttgtgcttttctgaagccaagaagtatatgtgtaattgtaaaaatgatcaaaatatgagcacagttgtgaagttgcttaactataagtcactacttcttgaaaacaaatgccaagtctttgaaatgctaatcctcatttttctaagactgggtgaatgggctgcatgaagtaaaccaacatcatttcccatcaagatagtgtagcataccctcagctgtcacatttctaccaaacgatatttggaaatgccagctctgtatgcaccatttttcatgagggtagttctggaagttgtcacttttagaaaggccaattttttaaatctctggaacaggttaaatgcttcctgatttatggttttctgggagattggcatattttaccaccaaatagcagcagagaatctgagtgaaatacatggaaaattcagagattagcttacatccaaagtgttttattgaaaacctcttgaaacagggtgctggttctggggaaaatggaattcattcactccatcctgtctctccttcattgctgaatgcaaccataagtcatggagagaatgtgtgaaactctgaaaactctgaaatataaaagagagcaggtgaaattaggaagggagactaaaattcagttttacaaaaccagtgagagtttaccattttttaccttcactattacttggcatgtactcaaaggcacccaaacctagaagtgtatgtcaaatctggaccaaaagaaccccagaagaagtcctctttttccagaccaaggcacagtaaagggaatttctaaagataaaagtgtagagaattcctgttatttctttatctcctaccctagcctcccaaacaatattgctacagaagcacagcaatggcagcagtgtccaggcagttgcctgaaatgggagagaggggaactcttcctctgaccataagagctatgaccccatgatcactaggcatatcactttgctctcctcctgctatattgtcctagatgcagatgcagttaccaaaagtatgcagcaggacagggaaagtaaagcccaagccttctggctggaggaccataaaaggaaacccaaggagccagaaagtgttaggaaagccacaaagagccaggatatcaagagagcactcctgaatgcatgtctgatttgtacacatgtggcttcaaacctacatggcatgccataggctttgagaactaagtacagagtgggagtggatcaccacccagatcccagaaaactgaattaatattggaaccaatgtctgaaggcaggttacaacttgcaggttgaacttaacccggttgattacctgctaatacaaaataaaacaaaaatcaagattctttgtagaatttaaataagacctcaaatctcattacaaaatatgtaaaatgtacagaatacaatccaaaataacttatcataaaaataattaggaaaattttaactcaaagggaaaagagaattaaaagatggctaaccacaaaggacatagatattatacatttaaagactttaaagtagctattataaacatgctttaggaagtaagggcaaatactcttgaaacaaatgaaaagatgtctctgtaaaaaaaaaataaaagatataaagatccaaatggaaatatatatagaacaggaaaattaaaatagaaaatttgtcagatgggccaaatagaattgctatgagagaagaaagtgaactcattgctatgagtgaacctgaagatagaacaacagaaattttcctacctgaaaactaaacacaacaaacaaaaattgaaagaaaaatgaacaaagctgtagggacctgcgtaataacatcaaaatgtctagcattcgtgtcatcggagtcccagaagtataggagaataggacaagagtgcattggttttttttgtttgtttgtttcttgagacagggtgtcactcttttgccgaggctggagtgcagtgtcaccatcttggctcactgcagcctcgacctcccaggctcaggtgatcctcctacctcagcctcccaaatagctgggactacaggcatgtacatgggactactggctaatttttgtatttttttgtagagatgaggtttcactgtgttgcccaggctggttttgaactcctgggctcaagtgatccttctgcctcaacctcttaaagtgctagacttataggcatgagccattgcacctgcccatgtgttataatatacaggaattatgttattcatatgtatatgttggcagagtaagaattaggcctggaaaggttgtcatcagaggccatgctaataactgttaaccatttgctcttgatttcaagtgattctaacttgtcatttaagaacacagagagaccttggcaaaatggccctcctccactcatccaaaatgaatgctaatcaaccgtaggcaactactaattatggtgactgcagttccatatttctgaggatgtgaatgaaaagaaattcaaaaaataaataggaaaagctttctaaagtagttcctgaggttacccaaatgactgaccttttatcagccatttcattgatttaaattgtttatgctcctcgtgctttttgcaaagcatctaaaagttgttctttatctattgtcatttttgttgaatatggtcttaagctttctgagttataggaaatttagttctagtgtggaaagtgatgaggttggatgtttataaacgatgacaaatctgagtccttgttgcatttttctcccggtcctacactgctgtagtctaacttactgcccctttatatccagttatcagtacaccaagaaatagaatatttaaactatattatgaggtccagtgttgaaaaccatgatgttaggattctccaagaaagtaaacagtccagtgagagatgactaaccacatagtcttaaacttagattcaatttggaacctaaccagcaggaacagaaaaacaaaacattaaaattaagaaaacagcaggaacagaaaaacaaaacataaaatttgggcatctgtgggtacagacaaaagagaaggaacaaagcaggagcttcagtgatcctagaatagaaactgagaatgtaatggatgtggagaaggaatcctgggttgtcactgtggatgacagtgtggcgattcctcagagacctagaaccagaaatgccatttgacccagcaatccgattactgggtatatacccaaaggaatataaatcattctatcttaaagacatatgcatacgtatgttcattacagcactattcacaatagtaaagacatggaatcaacccaaatgcccatcaattgatagactggataaagaaaatatggtacatatacaccatggaatactatgtagccataaaaaggaatgagatcacatccttcgcaaggacatggatggcactggaagccatcattctcagcaaactaatgcaggaacagaaaaccaaacaccacatgttcttactcataagtgggagctgaacagtgagaacacatggacatagggaggggacctgtgtccatgtgttctcactgttctgtgtgagaacaacacacactggggcctgtcagtggggggattggggagggagagcatcaggataaatagctaaggcatgttgggcttaatacttaggtgacgggttgataggtgcagcaaaccaccctggcacacatttacctatgtaacagacctgcacacccctcatgtatcctggaaataaaaaaaaaaaaaaaatcctgggttgtggaaggaatattcagcttgtggagtgcaacatagaatggccaaggaacttagatttaattcttaagatggctgttatgaagctaccagagctcaactggatgctaatcacctccaaaagctattgcttgcttgttattgctgtattttatttatggattttttaaaaacttctctttcctcagatacttacattctttccaacaagtaattagtagtgtttctgggtgaatccaataatcctatgttttctgcaatccctgtgattgtattgaagatcgattgtatttaataattttgaagtacaggctttaaacttttaaaaattcagctacaaccattttacatttctgaggcagtgccagtctttcatgatatactgtttataatttattggtaattttctgagtatctaattctgttactttcttttcctgtttgtttgttctacatatttccattagccgagattatttagacaaaagagaggagcaaaggcaagcaagagaagaaaggtttgtatatttcttctttcccattgtaacaaatggcatgtgactttgcactgttaacctagcatgcagagagactgtcgattaaaatataactgcttcacctaaaaccttacatagctggcattttgcagaacagagtgtactagttacctaaattttccaataaaagtatggagttgtcatttggtgccatcatggttaagtgtgtctattccttcaaatgagcacgtttatgttagcataatgacatagggcatatatttgaaataccctgcaccaccactgctgagcctggactacatgttcctaatgcatgcttttatgtcacatggtcagcactccttcaagaaatattttagtatccacactgtgccaggcagcagctgggggcactagatatatctgagactctttctggatgtgcctggtcacttacctgtctccctactgaactgtactcagctcctcgatggcaggaacaatgcctagatttcctttatttccccagtacccaccacagtgcttggcatgtagttgggacttaggaataatatatggaatcagtaaatgagtaaatgaaccaacagctttatttaaaatattcaagctgtaaactactttatttctttttttcattttaaaaactacttcatttatggtacgaatctttgtggtttgtgatgctaactagaaaatgcatgaatacatttttaaatttctatccacagaatatttgtatacaattttgtaagaaaaacatatatgagatacattactttataagattaagaagtatgttattaaaatgttgctgtaatattcgaaccagcctaggtcatataacagagcagctcaaaactctggtgttgatcagtagtatatttcaatggcaacatgctttgaatctcaataaaagatacaaagatgttcagtgtctaataaatgcagagaaacagtggaaactggttttacaagtagactggcaaaagacaagttttcacccccagctctttatagcctgcagttgtcccctctaccaccaggtggggtgactgcatggagagatggaaagactgcttttaacaccttttatgctggagccagctgggaacctaacaatttctggactgggccaataagaagtagaattgtgctaattttctaaacaccagctaaatacatcaggacagtctctgaggcagggaagagtggagactgcctgtcttcaatttaagaattagatgcttagatcaacctcttaaataaaatgatggcattactttgattccaacattctatttgattattgtcatcctaataaccagttgtggctggcaaatctagagtgaaacatgctgctaaagaaataggaagcttatatttctcactagtacctgttttttacatcagagggcatcacatatactttcactgaaaatgcggttgacttcctgcccaggcataaggaactaaattttattattttagttctccccccagattctgtacttatttgagctttcaacaacttgactgttaggttaagtccacacagacaaggcttggcagctcctggggaggtggtttaagtgctgtgtcaagatctgaactggctcagctgacttcaaaatttccccaaaccacggaagtccagctctttctggatattatttactgctcttttttgtccaaacaagacttcacttatgtctggcaaactcgtaagaggaggttgctgcttctcctctctcctctggttctgcccatagtctttgctcccaggctgcccatcagcctggacacaggagtgtgctccccaggcccactgtgggattcttcccttgaagccacctctctgtttacacggaggtctagggaagcaggcacgcattttcctttggtttggctcagccatttttcttgttagttttcttcttgaataacctggtgaagatgggagttaggggaaatatagactttcatccctgtttcaaaagcttttaagagttcctactaagccaggaaaaagtaagatttccaagtataatggaatttggaaatggaaactagtagagatcagaggtgggaagtagtacagaaataaggaaaagtaactcttccagatagagcaatgtgtgtttgtcaagtcccacatctcttacccttaatgcaagactcagaaaaagacagccagagtcacagcagatggtttttgaggtttgtatcatgtaactgtaacaagatgaatgtcatcttattttgaggtgtagtgaccatctggatacatgttatattatttcatatcatctcactccataatttcagacaaactatgttattggcaatggtgcagaccaggagtaagtttctgttgagatgctacttctcatccttttaagtattagaagaaaggctttataggataatgattgattaaaatgacattcacaaataatttaaaggagaaaaaagaagtgtgtgtagtaaggaatgagccaggctgggggtgtgttgtggggtagcacaggaggatacttctgtttgggtttgttagtctgagggagacagcagggcatggagaagaaatgctttatagcaaacaggggctatgggaacaaagtgcaaagaaaaggttggaactgggctagggttttggaaattgtgcatgaaaatgatcaatgaagcagtaagaaagggttctgagccttgcttagaaggactgagaacagggcagaagttaaagggagccagagtttactttaatgtaagtgagaatttccaaatagaagtgtggcaggaaaagtcatcagtaagtaggtctaggttaatctaaagtcaagcagagtttctgtagggccctgtgaaaagagactgagccgcagtaccagccctgccactgagctctggcggatgttggagttcatcccagtggtttatttgtctctctctcccactgaactgtgagctctgtgagggtgggatttttccttgtttattattaaatcgtgagtgcccactacagttcttggcacatgacaggcacttgacaaacattcaataaataaatgaaaagatgaatgaacaaacaaatgatataggcagaggataaacgggaatgtttggatgaaggcagcaaaagtaggaagtcttttcttggggctgtggtttgtggatagaaagcccggtgcttcccacagaggaggctctgtcggtctgtggattgagtgtggcttcgcatggcagcagggatacgtgacagtcattgcatgggccggtgggtcctcagatcaagtactattgggccccatagcacttaagtcattgtctaggaaaaggtcatgacataggtccagcttcctccccaagaactgctggaggttcttctggggcaggaggggtcgctaagctgtaacaccgtaaatgcctgtggcatggccgtctccgcgtaccagcccaccgccttcaccactctggccactgcagatgaacgctgctgctgctttttcagaaaggtttagtgctcttgacctccatgcctctctgccccgccatataaaaaaaaaacttttaattatgatcaaatgcacatcacatgaaattgaccatcttaaccattttaaatgtgtatttcagtagcattaagtgcattcacattgttgtgtaaccagtctccagactcttctcatcttataaaactgaacctctttatccatgaagcaacaactcaccatccctctacctctgcttctaccatttttgtctaacacataaacatcatgttttgggacaattcagattaaacctctaactcttcccatgtcttacagatcttcagtgatggcatctgtgaggccaaagggtacacaggaatagcatttgagtcaaatatatacaggctctgggatgagtggcccctggagtctcccagaaagtgggttaaaccctttggctccccacaaattcctgcccacctggctgcccacagagaggcatgcagaaggccaggaccaggaatgagccagcaaaaatgaatgcagcaagtgggatgtcctcctggctggaagcctttcattgagggcttcatcaccaccacccactccagactcatttgatttcttgcagtgggattctgacctcctgaattcctggacctgtccagattctcttatttgcactcatttcttgcctgcccctttatcctgtggcagcagtgtgggaatgcctgtgctcacaactcctggacttagggcatttctggccttgaacttgccaccatcccatttaacacatacctgctggaggccctgcctcttacccttaaaattgttttctttcaaggttcttgttacttccacagccaagtggctttttcttgctggcccgaattaaggccacaaacacattccttttgttgcctctcttacccctcaagaggtggtgctcttggccaagcctgaagtgtttgtgtctacatatacatgcactacacaccttttatcagagattcaccatgaatgcaagctcattccccacaaaaatgaaatgggatgcatttgctccctcagcatcctgggctgcaggtggacctctgcaggtggggtgccactctgcaggcttctccctgcatgctctgcctgcttcccatcagcctgcaaatgcaaggcaccgagggaaagaacagaggatggtaatcttcctgttcatgaaaatcctattatttgctttttgaaaacagacatacacatgtgaacagatgactaaatatgccaggcagtaaatgtaaaatgccatctgagttgaagggactacatatccgacatgagttcagaggcaaggccaagatcacttccagctgtggtggtcaaggcagccttcctggagggagatgtgcatgcaagtgtggtccgaagggtggactgcctttgggctggcagggaaaaggggtgaggattacagatcgagaaaccacacccaccttgaggatgggatgcaaaaaatgcatgctttttaaatgcattgttttaaaatattttaattatgtgctctgcctttcttatctgggtaaatgaggaacaccatgtctaatgcccattgtgaggaactgaagcagtgaattggatagatgcaaagtgagcgtcttgagtaagctgttccaaagtttagtggtaggtaagatagtaagaaacctgttacagctgaatgcataaatttatttctgaaaaaataatggtgagtaaaattagcagacatctggaagaggcacacatttcaaagttattttggtctgatctataaagcgcactatgaggaatatgattggtagctggtcttaataaacagttagtgggttctgcctgcctgaaatgcaaaacagatgtatctttgttcttttaaactgactttgatgaataaactctatgtgacgtcaggttcaagctattggatgtctgattcctactcagaaatattttagaatataaaaaaagtttccatggtcagcactgagagaacaaagtgaattccagttacattgctgttagtattgaagcaggttcagaaattcagagaggcaggccttcatccaagcaaccccctttggtatatggggggcattttttttctctctgccacaccaaggcacccacccatttcacagctgtgagctccgagggggtttggttttcagccatcactcttgaggctttttggtggtggttattgctgttttgcttatttacaaatgttccctaaaagagcaagataggattctgcagcagtgatccagtatctagggactgtgtgatgctgccatttcccccaatttgcttggttatgagtgacgtgggatttttaatcattagcatcttggctttgctgggtgtttttggcaggctgactctccagccagccctgcactgtgctgtgtgcatcaggaaaccggctcattctgcaggtgtttcatccataaacaagcatcagccacaggctcctctttcgtttgacggaaaccctttggaatttaactttcagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaaggtgagtacagggagagtagagggaaaatgaacaggttaacatcagacaggcttcctcagggcagtagtgatgatttcaacctgcaggctaatactgagacagcaactatgggtacactttgttgggggaggggggttgtgactgcaactgcctggtcactaacaaactagacgtcttcagagccacttatattaaagcaaaatgattcatcaaagttgtcaatgtatggccatggaaaaaggagaatatggaaaataagctttactttaacatttaatcctaaatactggaatattcatttaatactttatcattttgagatgtgggtctgcccaatcaagtgaccaacattcgaatgttcttacccgaggaactgttagtctggtttaaattaaactgaaggagaataaaattaattacagcaagcaaagaaaaatgtggacctagtgaaaatagaaggtaaatatggaagaaggaaaataattcaaattgtaaaaattactggcacatggttggatgtgggtgtgtgtgtgtacgtccttatgtacagacaggcaagctctcctgggagatattctgtcttcttcactttatttggagaggcgcgatgatattgtacactgcagccttgagcatcagctgttttcctgcctgctctgcatactgtgggtccgttttctttcacattaacacagggatggttctcagcagcgtttacacagtgtgtgttgactaaccctcctgctagcactgtttgctttagtcaagtgttatggcttacagcctgatgtagacttagccaattgaagacagcagaggcattaagcttttaattctaggagggttgactaaatatggcataaagtttaatttaaacaaggccggactccatgaccttagcagaactggatataatggaacgatattgtctgtccaattctttgctggctctccaaaccttggctcattctgctggagcgggccggctcctccacagcttcccgtgacatcccgttactcccgatccctgagccatggaagattgtcccaggcagatggctcagtcatggatgagtaatgtcggtcttaaaatattgagactctgaaagtcaagaaaagagactgttctataacagccgtgtgctttccaaaccctgccttatatcattgctattatctacgttgtggtatttccagaggcaatatgagagatatcctcctgcagagttgtggttcagcactttatcctgggacgtttaactaaaagttgtatctcccgtcctttacagaatgattgtctaaactgtgaagtacagaacagctccgagctgagagggaattgacagtgtctgtaaatgtcatttgtcctcaaatttttaatctccttgatgtttgtggcaaaagacaatttctctccttgatgtttgtggcaaaagataatttcttacgtatttgattgaattacagtttaactcgagaccattctagccactgcaaaagaatatttcagcttcagtaagaatacagaaaatagtcatttcatgtatacgtgggtgtgtgtgtgtgtgtgtgtgcgtgtgtgtgtgtagtatgcatttggggaagatatgtcagtatgctttcaaaagaatatttgcagctgggcacagtggctcttgcgtgtaatcccagcactttgggaggccgaggtgggtggatcacctgaggtcgggagttcaagaccggcctgaccaacgtggagaaaaccggtctctgctaaaaaaaaaaaatacaaaaaaattagccgggcgtggtggcgcatgcctgtaatctcagctacttaggaggctgagggaggagaatcgaacccaggaggcggaggttgcagtgagccaagattgtgccattgcactccagcctgggtgacagagtgagacaccgtctcaaaaataaaaaaaaaaaaaaagaatatttgcaagtgttattttctcttcagagaagggattaatagagactgagagaatgtttgaccaaaattacacaataaatgatacctgcttctgaaagaggaatactgggcttgaatctgcatataaccaagaattctagcatcatttgatgttgtttgcttttttcctggaaaaaagtcaaaagtactggctcctgtgagatctagaagagctgtccattgtatgttaagtaatcaggatccaaatcagcaagagcaaacagtcttccttgtcctgatatgtaattgatttataaaattggacatcgcaagtgtatgaaaagatggtggtctcagaaagaaccgcagaggtttccttctgctttgtagacattggcctttatgacagaaatgcaaagttggtgtcaccaagtttttctcagcctactttattctttgaagcattctgttagcatccaattaatagtatattctttttaccaagtcccattttcaaatgttcaaaagtaaccttttgcttatccctagcatttccagtatcctgacatctggaggaagaattaaaaatataatcacacatccagatgttggtcctgcaccaaacacctggcatgtccaaacgtgccagggattgccttgctttttcactctttatccttgtgggaacatgcaatcataatacgcttcacatttttgtagtgctgtgcccctttttcccaaacgtatctgggtaggtaggggagatgttattatccatgttttactgaggcccagatagatggaaagctgtgcttcagaccatcttggcacagtgctgggagtgtaattagtgttctgatgcccatctcagccatttgtcatggagtcatggctctaccatgtttgcattgctattcatattaatgccacaccatccctttgctaaccctctcaccaacatctgcaaaaattgcagcctacatttcagaattatatttacaagaaaaggaaaaactaatatttgttattgaattttctgtgcctcaggagtacaggtccctttatgggttctttcttttataactcctgtttcagattctgaagaacttttgaaagaagaagataggaaaacattaaaaactccttttccttttgtcttacaaaacgtactttttaaaagggaaaggctaatgataaatactgatagcatgatatgccatctagtgagatctctcagccaaaagcttccccaggttaatctgctataacttttgtatgaatgatgcccctaatccccaccaccaagtcaatacatgcttgaattaattttccatctgaccctcttgtgggcttagcagatgtatgtccccatactgcctagacttggtgatgatggtctaagtactttccttctttctaaaagtaccagcccaagggagggaaagaaagacatacacacgctcctgtttgcactgtgttggaattaatggagtcagccagcccaaagtttgggcaaacatggaaaggcatctcttcattcattgctttgatatcttttccttattttcactgatccctgggggtagacatcagaatatctacttagtaagtttatttcctattatttttagaaactcatagatgattctgaaagcacctaagtgattctctttgtcagaaaaggtacagtgttcttattaggatagagttcttcaacataattcttgagaaagtttctctgaggatgaaaactaataataataatctgtgtacccataagtaaagtcaagatagccagataacctcttatcacaatttatgtcagatccaggtaacctatttcatggaaacagaatagagagaaactactcacctgaaaaccatatgttgatggtggtccctggagggcatcccggggttaagctgccttctctagagagctagaactatgttccctccttgctccctcttgtaaacgagtccctcctgaggccaggtggagataaatggcatttcccagtggaaggaagcagctgtcaagaatttagaagtggctttcacccactaacctagccatgaaagcaaaattatgtctacagtattttattatgagcttgatactctccatattgcacacagaaataatacatcacagatacatttgaaaatgatgccacactatattatttttatttatgtcaaggaaaaatacgtttgacagtgatttttttctctacctgtaattggattccagggtatttccaaatgtctgattgtttggccctggggatatatacggcctatatggccatggcctactcaccagcagacattattgacaaaggttaatgatacttcctgtcacagatgcaggcatttaaagtatgggtaaatatggcgattcctgtagcctcctgatcctcaaacctggaaataaaatttagacatagagtatcatgaaatgtttagtttgtctaaatgatttttcctgtgggcatccatttgtccttttggctgtcatcattgttagcgttgactgtctttgtcatcttcgttgtggaagatgttctgagtctccttcaggtgtagggactctctgaggttatctaatccacacagcagaaatcagaaacatctggtatcctatttccaactggcacggtagcaatggaatattgtccatcatcagcctaacactgcatgctagttctcttgcataaaccttttggatgcctccagttcagtgtttcatgaattggcaggaaactagattccttgtggttctatgactcagggctgcctccctccctgcctcacctgactgctgctacttgataccattttgtcaattggacaaaatctttcagcaactctacccaaggctgaggtcctacctgctacacctgctgtgggcagcctttgcaaatcatcgagtttttctgccttgccatttctcagtctctaaaaatttccctttttctcctcatagaaatgacagttgtctgaagtgtgtcttcttgcatcatatttggaaacattaattgggattgagtccttctgaagtagacaaagtatataccttaagtaaagataggcatagaatggcactggaaaagttggtaaagaagagcattatttctaaggcaagagaatagcttgaacccaggagttcaaggctgcagtgagctatggtctcgccacagcactacagcctgggtaacagagcaagaccccaactccaaaaaaaagagaaggggaggtggacattacctgatcaaaattattatttcctaggcagctattaggtgtcaagagctatgaaggaactgaaacattaccctatttgtaagctaatgtgctgccttgccacaattccgtggatgctggcagaagacacaaaattcctgggtcagagacaaaggacttcattacttctagtgatagcaatagccagaatatcaacatttgtgccatttccccaagcctcagttcccacagggtgatgtgaatagggcccagtaaaacatgcaggcacattgtggggaacctggggaaaggaaccctgagccttggggacctgaactcttttataatgggcggtaaacatgccttccgtttgtcccagagggagacattgtctttattacagtgggcaataaaccaaccagatctttgctctagggagaccctatcttctaagagaagaccctgtcttctaaggctccttgctatgcacacatccttagaaagatagtgcagaaaagactatcaatgcctttgcttgcaagactgaagaaacgtgggagagctgtagatagttgtttcctaatattagattataatggttttaaatcaacctttactatgaaatttgtatcctaaagtctgtttagtgtaaacaaaaaattcaagttttgaacagcaattagcttgttcttatttaacaaaaaagaaagtgcctcaggagctacaagacctcgcctggagcaggcacttgggatgaacaagtttgctgcatctggagacactcacagagaatctggcttgttggctgggtgagacatctgcacctttcatcccaggtgggagccttgggtcagtgctttcaggtgcagtcaggaggctccacatgtcaggacaatgagggttcttgagccacagtggtactttgaatttccagacaatgactgagactggggaaattagcaaaggagaataactctggggctccttctagcatccttgtccatgctcaagatcttaatcactactctgctatctccaccactccccctttcccttcagcagccctgctttcccccatccatctttggaacacatttgttcaaaatgatacaacacctgcagtatggcaagacacactcacgttgactttctggtacctgaaatacactttttcaggagaacctctgggttcagtgaccatgcagtgtgtttcatctgcctctgggcatgatatgcatctttggagccttttgaatttgtaacttctgtgagaaggctgcctctgccagatacatcgggaagttcaagtcgctttttgttgactttctggatccatccccctctggatgcctctttgtcctctagatcatctccaggctaaacaggatagttgccttttgagtcgcgtgcatttctcattgttttctcaacatttgtcttagtcttttctcattgtttggttgcaatcctctcactgactcctcttctgccttttcactacgtggtgggtttttctgaagttcctctccagctcctctctatcttcatacacatcctctcactgggccctcgcattccacctgtgatttttacctacctcccatatgccttgaatccctgaggtctgtactgccagccttggcctccctgagctcagggcgtgtgtattgcacttccccagccatctccactaaatgcccctccaactcttcagacccaccaagtgccaggctgagggctgttcagatggaaggtgatgtctatctctcatccagaaacccccacccgaaacctgcttatattttctagtccccacctggttaaggctatctctcgtggcccaatcatttaagctggaacattcatataatttttgattcctccttcaacacttaccttacatccaatcaatccccaagtgtcttttgtgttgttttctctcaaatcagccctctttcttttctcttcattgccattgcgttagtcctggcctcaaccatctctgatctgggccatttcaatcacttctgataggtttcacttcttccaggctcttctcagcaacccaatttaaaaaaaagatctctgtaccttttcttaaaattatcgggtggctctccattatctaccacataaattcagatcttatgtggcattcaagaccctttgtacccagtaccaaccaccacagccaccccccaacaaatgttatgctccatccacaccaaaccacagtcagtacctgaaaatgccatgctctgtgcttggagtgcactcttccattgggtgccccctggactcttcatcgagctgaggcatcttctcttctctaaagccgcccttgatccctctcttgtgtttcccttgcatcttgtgcacagttgggatgcagggcttacctcactgtccatgtgataagttgctcctcccaagcatctacgtgtgcctcgggcagggcacgtgcctgtgcccacctttgttattcccagtgcttggagcagaacaagcattcagtacatgggttatgagttggcgaatggtcaagcatgacaaaagaaagcagactcatgaatctgcagagacagctgtttcctctctacccaggaagaaatttattacatgagccatgggtggaggacacatctttgactatgcaggccactccataaggactgaataaatgatgttggtataattaatagagaggaaacttttacagagagttgacatatctgggccatttctttctgaggatctgactctaatagaatagtcaccctatatgttatcaatatgagaataattgaacctgaaattgcttcttttttatcctgtatgatactacagtagcattatatacatatttaagcaagtgaacttaatcagaagcgtaatctgaggggcaagagtgggaagtggaaattctaatttaaatagcgcttttaatcctgtctaacattcatattaagtgcatgtccctgagggagcatgaccacaaggagcatagatcttttcttcttttccttgaaccattcctgattccaacgtgccccttgtcgtatgaacaatttgctgcttcaaatgtgagtttagagtttacagatttgtatttgggggtaacacagcccatgaatgcaatcccagcacttaaggagttccactgacgctaaattaaaaccgtgattgtcaaaaccatggagaagttatgggatctataaggtagcactgtccaaagggacttttgaaggtaattttgactatacatggtcaaaattgttcgggtcaagcaggttcaggcctaagccatctctgaagtcatcttcagtggggcttaggtctgaacctctggaaaatcaaactctgaaacttgaggacaaagcatggcttaacttttaaggcataaaaattaggctattgaatcagtattttgcaagtgataagctgtctcttttgtgaggcttgagtagaatttcttttgtgaagctgagtttgtgcccatcctcatgcaactattcctgtagagcagtgattctcaaccaggggtgagtttgctctcctgggggacatttggcagtgtctggagacattttcagttgccacaatagcagaggagaagtggaaggttggtgctgaagcctctagtgagtagaaaccagggattctgctaaacatcctgcagctcatgagacagtctcccagaagaaggaattattcaacctagaatacccaggtacccaggctgagaaaccttgctctagagtgaatccaagtgaacaacctaggaagaactggtctaacaccaaaggcaaagtctaaaagattttgaaagttgtaagcttttttctcttgggacctttttcagatttctgtgattaaaacacacgtctgtagtcaatcgtgttagttattagctctgagctggggaggtccctggaatctacacagtttggagcaactattatagaactggctggcccagcccttggtttcataagacctgccagaaagccaagtcctggcagagtcatctagacactaccacagattgaaatcaactgaagccacccagagatgtatcaagttcagaactttctaccaccaatttatcacttcaaagaaaaattgcataaccagaaattctaattggacactctgaactcggctgtcagggacgtggatgaaagcaacattgaaacattcctgcccactgtgtgtgtgtgcgcgtgtgtgtgtgcacgtgtgcgtacacgcttaattccaggaatgattatgtacttcttgattgcttaagtcacccaccacacagtatagccctgtgattaacagcccgagctttgcagtccagccaatccaggttcaaatgcaagctctgctagcatgagctctgcttagcagtgaggtcctgttggtcagagggttgctgaatatattcagtgaagggactgtttacagaggtatagggaggtcatgggaccatcaaaatgtggtgatgcttcacccagagactagcggtcgtgggacactgttcccaccttcaggcctgaagaaacttggtgaatgactaggacttggtaagagttgtggccagaggagagagaccaagggacagaaacagtggcctgacaacctctgccaaactaaggccctacgtgaaggaagcaggggtgttaatatcccagtttccttcttcctacctttgctagaacttccaggggctgagccagggagagggagagcaaatacagctggtgttctgtgcgggagtcagcatcctcaggcacagagcagaacagagcatggatcaaacagtcagagagtagccagcctactgtgtagctctgggcaagttgcttaacctctctgaacatgtttccttatttctcacatggggacatcaatcttcactttatattgtaggtgtgggaaccaaagaggatgatgtaatatgattcctggtacagcatctgggtgtagaaggtgctcaatatgtagtaagtttgatttttactgcacttaggcaagcaggacctgatgtccagtgaggttttggggaccagatgaggagttggtgttgggatttgggagggacaaagaaaacaagattgtgtgagtgatggtctgccctggcggacttcatacagggaccagctggccgaagtcctcaggccggctcgttcctcatttctctcctcattttgcgacctgcatgaggaaagcatggtcacattctccatctgacggggcagcctttatattcttacacctaagaaaagcacttagtttctccccccttccatgggttctcatgttgatgggttcccatcctggtttcccaaaccccactcactccagtaatgtctgtttctttggggtgaagaattccttttagtggctgtgttctggttatgggtccttccccacagggtggttggtgacagcccagtaccctgttatgtctctttgaggataccctggaccccttcttttctattacttcttccaccttgcagaaagtatccattaccacatccttttatgcagtttagtgttgattttcttctttggcccttctattccccctaccccaaccttcaaatctagctgcaagccctcggagccaggtcagtgcaggctctggccaaacacatttttctggtctttgctaagtgcatcctagcgatgctgagaccccatcgatctgcgctcttgggctgtgacccaggaagacagatcccagttttggatgcctgtaatgttaccaggcattccttgccatgtcttccttttatttccaaatgcacgcccactgctaggagaagggttgcctgggcacctggcccaagtccttcctgcagttcccctcctcccttgcacagcccaggagatgcaatcagatctttgtgtccttcctccatccagggtggttatggacaagcatggtgagccgtggcatctcttgacctgctgggtttggggtatcacagtcactcctgagcctcccttgaagatgcttagaggcattacatgctggggaagggacactctgctccttcctgcctggccaccctggcacgggccttcactgttctctcctggcctcagctttctgagggtaataccagagccctccccatagagagatcgtgagggcttcggaaggcagttcctgtgaagtgctcagtaaccattcctcaaagggagccagcagccctgcggaactccctgccccgctccggtgtgaacacggttcctcccccagctgatgtctgggatggaaaaacctcctgctgttcagagtctcagtcccttacccatgtgttcttccagtggtgctgtgtttttattttctttttctcttgagctccactgattggtgttcacctcttcctcctctgtctctctctctaaggtttgcttcgtggactcttgattccacactgactaggggcctcactccacagctcgcaggcacacccaagctgttcccagcagaaagccttgcttgcctgtgatgcaggtggagacagggctcacctcagacaaaatgaaacacagagcagacatcactgtccttagagtaaagtcccagatccctccatcaacacacagcgctggttgccctggcccctgacaaccacccaaacctcctctcactcctcctgccaggccacgcagctttcattccctccggcacgcagtgggctctgggtgcctgcatgtgcacttccctctgcccagggcattctcagcatttccccccttttaactcatttttaccccttgagactcaaacatcattttgccacagagacttacgttccaggccttgccaaagacccttgccatgccttcccagggcaccgtgcattttatcttacacatccatcactcttacaaaagtattttcgttattgtgtctgctggcagttgagaggtgggggtttccctgtgcccactggtggcagagctcactcacttttgccacacggatatcacggcaggttgttcaggatcctctctaatctgcttctctctagcctctgtgacagagctaggtcagtctcatgggtcgctgtgtctgtctttcaccaccaacaccacattttcaggccagagaaaggctcattaaattctgggactggtaacagtgagaagttgtaaacattcctaggagggaaacaagcaccttttctccctagttgttgccaaaggtcatagctccctttaggacttttcctacaggattatatggtttctcccgtttcctcgggacttggtgggtataaatgagacgttttcctgcattttcccagagggcagcagacctggcttagagacactcagaaggaactgtgtgtgtgtgtgtgtgtgtgtgtgtgtgtgtgtgtgtgtgtgcacggagagaagtatgagtgagggaaatcctgctgaaagataatgggaaaggggaggagaaatgttctggagttcggtgtggagtctcagggctgtcctgggtgcttcctgagtatcagtaagaatgctgtgagcagacgctggccccaggaccacgctggggccctccagcaggagaggaaggcaaggtcttggccctcagacaactttcctgtgtttgattaagacagctagagaagggctctgccgtggaccctggcagttttgcttgacttgaatgtgtgtgacagttatttaatttgttcatcattaggatggcctcagatttgcaatcagaccttgtagacactgagtcatgtattctgggcaggagatgactttgccgattactacctccccagcagtcatgaaaaaaagataccaccccagtggttgaaatcacaaattgaaatacctgattccaagaagttaggccctagtgtattgggatgaaattgtactcctcccccacaagagtgtggcttttccagagctcgcgtgtctgttagcacacctgcccaggcagcctaatcagggccagagccgctgcttgggtagagtcctgcatgttcagtggaatggaacatggcagtgcacacccgcaggctgaagtcaaatagccatcaatcacagagcctccctactttgcccagatccctggggtggtgagtagacacaggcttatggcagccaactgaccccatgtccctgtctgtaatgaagccgccaggaggggcccttgctggttttcaccatatgcttaccaattaaaacttcagtccatgccacatgctgggctgttggaaacacatttttgttttgatgtggctattttgaagtccatgtgtgcaaaaacatgtgctttctgtcaaccaaatgatgacgctgccgctgctgaggctgtgctcttgccatgcttgtaaaattaatggggttttgtatctctcctaaatactctattatcagatgaaaaagaaattaccataaaaattccttcagtaccaaagggaatgtttctaaaaggcctgttcactccatcccatgacccagcacagtttttacttttaaggaagagtgtatgatgctctcattctcagacacgtggcctcacagctgtgtgcccattggcttccttctgtaactgccacccatgaatctctgtctggaaactatgccctcagatctccagttcctaaagccttcccctcttgggatgcccaggagggacagcccctcagctgcaggggggtctttgctgcccctccccatgtcctccagccttccctggaagcaggttcctgccccaggctggagttcccagtagaagatgcacaacctgtaatcaaaggagaggaatttactcctccacccccaaattcctacctggcacttggggacatttccacggaggagtgggatttggaagttgcccaggaatatcaggaaaggtgacatttcatctgctccactgcatcttccctgcccagctaactccctgactcatcctcagaggatggcagcctgagagcagatgaaggattggggggtgatggccccgtgggtcctgaagaatgagttgctgggaagctggggttagctgggccccctgcctagtgaggcctgaatgtccctttcccttagtaatgcccatgcccagcctgctggggggctggttctgtgcaccccatggccagccgtgcccattacctggtgccgcaggatgcctccacagagagctgccctgatctgcgtgttctcatggaatctgggcaggtcccttccagcccctgccatgcgtagaccctgccagaatttctgtgttgctttgagcagtgtgtacctagggttcaagcacacacccttagagtgcattgccagggttccagaagagtgggctttgctcagcctgagggcagttcccttaagagtgagccaccctcctccagccttcatgtgtggcagttggctcagaattttgtgtattctcgatcattttgctacacatccacagctcatagctgagggttttgctcagaaaaaataaataaataaaaataaaaaaattttaaaaaagcataagccagattgtgccatttccctgttccctagagtgtcacacgagtgagaacatgatcatcttacctcagtgacagcatcaaatctccagcgttgataggtttgcaaatagactgtgaccatgagtgattcttccaaactgctttcaaaatctcaaactaacttcacattatgagcaaatataacccaagaaaagggtgatgaacctcactggttcagccaactgatttcaggacacattagctgtttttcatcagcttgatccaccatggattttgtttctctttccctaaacaggcaaaaaggttatatattagtttcgtattgctgtgtaacaagtttccacagacatagcgattggaaacaacactcgtttattatctcacagtttccatctgtcagaagtttagcacagctcagctgagctcttgaccttgcctgtccactgccacaaggctggaattaaggctgcggctggctgggctcttattgggagactctgggaagagtccacttccagcctcattgagggtgatagcaacatccagttccttgtgcccacagaactgaagtccctgttcctggtaggctgttgaccagtggtggttctcagcttctagaggccacctgcattccctgtcaagcagcagtgatgtggcagatccttctcctgcttcgaatctctgacttccttttctgctgccaattggaaaactctctgcctttaaaagcctttcctgattggatccaactcatctagtaaacctccatatcgtaaggtcactgactagggactttcctgtcatctgcacaatcccttcacagcattgcctcgatgagtgtttgaataaccagggcataggtctcttgggggccatctttggacatctgtccaccacagagaaatcaacctcacattcattctcacctcacttcacccttccaagaaatctgtcgtcaatataatctccattgttgtctccaccagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtaaatgaagccccttgtttcagtcggcatgtgccagggaggcctggggtgcaggggctggttctctaagagcttgtccacaggctggcctctgaggtgacctgggtcaacccactcatgtggctgtgtcacccagtgtctggggacaaggagtgtggccacgctggcagccagccagcagccttctgccctgtagaaagacagcccccaaactgtctgccacaccatcacattcatcacctccacacctggggaaaagggccccgataaggagggcttttcctgaggaataagccccagaagagaaacctctcacttccccctgactgttccattgtgaataatagtaaggttgataatagtaaggctttttccgtttttgatataagtttagaaactgtcacattgtcatctattcctttaaaaatgtgtttactgaagtgtgttaatcattttgactggacatttcagactgggaaagatttgtttaaatggattgaatgagtatttccaaaaaattgtacacagtttactgaggtcaatttgatgtactggaatatagataatttgttttctatattacactcataactattcttttctttgtataaagtatatgcttttccttatggaagtatatctttttgatgttacacttaatactcattcagttctcctatgaatggtaactttagaattagggaccaaatggaatgttagattataggtttggtttagcctgaaagaacctcaccaaggacttgagaagggtgccacagagggttataggaatcgtgaataattcatatgatctgtgacaccacaggattacttttcctacccatgacttgtgtgctatcaaggtggtagaatgcctccttcctcaacaaacactcctaaccagtggagtcatgtcttatgggccagcctttcttaagctacatatgagtggcacccactcgagtcgatgtcttaggcccaaagggcaatatgacacctctacaaaggcctgccaaccagtgccatgacccatgaatggcttattcattcctagattaaaaatacattgtctcagaagcatggatgaacgaatgaatgaaaccagaatgtcttccaatagacctgtcagtcaatggcgtagtctaaaatagttactatttggattttttcccagttagaatatactactagattttatgctttatattgctggtcactatgatgcagtaaaaacaagaagataaaagactttattagtttacatcttaggaattattgcattgaaaatccagtgtcttcatttggttgaatatgtatgtgccaagaggtattatatatactgatatttacttaatttctttcaaagtcagattacagttagtcccccaaattcttcttatcattcatattaatgtaattattgtcataatactgggtgtagggtaagtcttattgatcagattggtcttaaatcatgttttatttattaggaatagctttaagaattattaatcataactgggtttagcaggcctaaaacatatcaagaaattggattagtaaaaatataccaggcgacagggctttcttggatcagattgtccaatattcttccaaagaaggacaattttccaaaagtggaaaccgttcccagtgaagaaccactgactttctaccaaagtgggcaatgtccaagtatttagaagcagaaattagggctttgcaatgatttttctgctttgcttcagtgctgttatgagagttggtcatgtttatttactgtagcttattggttcctaaaaaatctcactgctcacaggcatcatcagccactgtggagtccgggcagctatgtcattatagctcttgcttttcagagtgctgtcaaatcacagagcaaccttagagataaaaaattattctcaaacgtatttctaatgattatgtcaaaaatgaatttgtaggacttgaaaaagtctcattccagttatgtggtttaatttttctttgtttaatgtgttctactttagggcatgcatgtgagaagctttatcataacatacattttacttttttgtagttacttgcataattgtcctttgtctccacttgaatgtcagctttgtgagggtggggatgtctgtctattcatcgtgagtcctcacttcctagcagggtctcacaaaacaatcgatgaataaatgaagaggcgtctggctaagatggggaagcttcattgctcctgggtcctccctcttacaaccaacatagcagcaccctgagaataccagaataatcagaggaggactgtgaaaagtggaaagaagaatgcagactgcctaggaacctctggacttaaattatatgacagtgaagctccaagtaaaacttattcccctagccaaaggactgggaaaaggattgcctaacagaatagaacacaggctttttacttattaatacttgtaccctagacaggcactaatgaaaaacctgacccagagtcaatggagactgataagaagctgaacctcccgcgtcccttggaggtaataaggcaatgtgagtcagtgatttaatttccctgggaagatgccagtgaggccaagggagggggcactgacgttctaccctcctcatctgcaatgagccagtgtgagtcagcgctcttgctggggtggtgacagaaagatccagcaaggagctgaacatctccctccaccagcacctgtatgctatacctaaaaagggtgactaccagctaatagattagataggagccaaagtctaataaagcataaaatgtccaagacataatggaaaaatcactcatcatttcaagagctaaggcaatcacatcttgaatgggaaaatgcaataaacagatgccaacactgagatgagccagacattggaattatgtgacggggattttgaagcagccataatgatattgcttcagtgagcagttacaaacacttagggaatacgtaaaaagtaaaatatctcagcaaagaaataaaagatattaaaaagaaccaaagggaaattgtagaactgaaaaacacagtaacaacaaaaaaaaaaaatacttactggatgggcttaatagtagattggagacaacaaaagaaatgattagccaactcaaaaacaaatcagtggaaattacgaactctgaatgacagaaaaaaagagactgaaaaacatgaacagagcctcagggacctgtgagacaataagactcgatctaacgccaattcatcggaatctggggaggagagagagtgtaatgctgaaaaatgctttgaagaaataatggaccaaaacttctcaaatttgtcaaaaggtataaactcataaatttaggaagctgagcaaaccccaaacaagacaaatttaaagacattcacaccaagacatgataatcaaacttatgaaaactaaagaccaaaaaaaaaaaaaaattttgtaagaggctagaaagaaacatattacctataggggaacaccagtccaaatgacagcacattgctcatctgaaaccatggaggctagcaggaaggggcgcaacattttgcaagtgctaaaagaaaagaaccgtcaactataaattctatatccctcatatgtatcctttaagaatgaagggaaaataagacattctcagataaagaaaaactaaaagagtgggtccctaacagacctatcctcaaagaattactaccggaggttctccaaacagaaataaaataatgacagaaggtttggaacttcaggaaggaaaggacaacagaatgggtgaaagcaggggtaaatagactttctgcttatgagttactaaatcgtacttgatggttgaagcaaaaattataacatcatgtgatgtagtgctctgtgtatgcagaggaatacttaggacaactatactttcagagtagggaagctaacggtatcaaaatggaagtaagttttccacacttcagagtggttaaacagcaatactagtttactgtggttagtgtatatattgtaatgcctagagcaaccactacaaaaaccagaagaaacaatgtacttggaacactataaataaatcaaaatgaaattctgaaaaataatcaaaggggatgaagaaaggttgactaatgggtacaagtatacaatttgaaagaaaaaataagatgtagcgttctataggatcagtagggaaattatagtttacaataatgtgtatatttcaaagtagaataatttgaatgtttgtaacaaaaagaaaagacaatatttaaggtgatggatatcccaattacattgattttatctttacaaattatatgaatgtattaaattatcacatgtaccccaaaaacatctattatgtatcaatttgaaaatttgttaaagtaaaaaaaagtattcaagtaacccatagaagacaaaggagaaacaggaactaaaacaaatagaacaaataagacaagtggcagacttaagctctaacatatcagtaattcctttaaattaaaagatagatggcagagtggattaaaaatgacacaattatataccatatatagaaaactcttctcaaacataatgacacaggtagattgtaacttaaaagttgggggaaaaagtctgtaggactaggtacgaaaggaagaaaaaaaagttgagaaaagatatattatgcaaaaattaaatcagagaaaagcaggaatggctacatcagttaaagtagatttcagagcaaaggaaattactaaggacaaagagggtcactacagaatgataaaaggagtcataaattaatgaagagaataagcaagaaaactggcattttaaaaatattacctgattgcctgggcgtggtggctcacacatgtattcccagcactttgggaggccgaggcgggcagatcacttgaattcaggggttcgagaccagcctggtcaacatggtgaaactcccatttctactaaaaatacaaaaattagctgggcatggtggctcgcgcctgtagtcacagctactcaggaggctgagacatgaaactgtttgaacttgggaggtagaggctgcattgagccgagatcacatcactgcactccagtctgggcgacacagtgagactctgtctcgaagaaaaaaaatattacctgattatattattttccctgttcccaaaataagaaaatgctcacatttcccaataaatggagaaagagcaaggctgtctcttaagaagggctcagccactttatctgctgcagcctcctagtggtctccctagtatctgaccagttgttgaaactctacctagccagattttttgctattatcctcagatggcatctcatctccttttgatggtgattatttcctaagatattttgtttgtaaaacctaaaagagggttcagtagctccttgttctggtgttgagatggcctaaggtcccctggtcaggttaagccattgttgcaccaaggacagagaacaaagatacactggaaatcctgggggaccttgtgatccccctgtcaatgcctcctcaagccagggcccaccctccacgtgtttgagggggatgttccttcggctgaatgaagctcccaatgctgacctcccaggcctgggtctgctgccacatcccaacattaggatccactgaggccctggaaagctgatggaactgaagcactcactacctggctctgccagccctgatgaggtttggctgtgttctcacccaaatctcatcttgaattatagttcccataatccccacaggtcatgggagggaccaggtgaaaataattgaatcatgggcgtggtttcccccatcctgttctcatgatagtgaattagttctcacaagatctgatagttttttaaggcgcttccctctttgctgggcactcattcttctctctcctgccaccacgtaaaggaggacatgttttcttccccttctgccgtgattgtaagtttcctgtggcctccccagccatgctgaactgtgagtcaattaaacctctttcctttataaattacccagtctcgggcagccctttatagcagcatgagaacagactaatacaagccccaaagaggcaaacccagaggagtaacattcctgatcattccttcattcattcattcagttgtccagatgttgcagaaacaacagtgagcaaaacaaacccaaatcctgttctcacagagtttacatccatgaaaaaggcaatttattgagtaattataatcatttcagtgatagggcagaggcagacaataaaataagtaaaacgtgacagatttgatagtcataagagctgtgatgaaaaataaagcaggaaaggatgatcaacagtgttgggggaggattgcacagttttcactagtggtcagggaagacttcactgagaagatatggtttgagtaaagacaagaggtcaaggataaaattgtgtgattaactaggtgtagtttatcccaggaggggctgacaccctgaggccagatcatacttggtgagttctaggaatgggaagaagttgctgtagctaacgaggtttatgggcatgtgtgtctgggggtcagggagtgttggtggtggtgtgcgatgaatgaaaagtaaggaaggatcatggaaggccttgtgaacgtcatgtcattggccttttctcacagtgaacgttggtgctgttaaaagactttgagcagaaagatatgatcagacatttttataaacatcatgtggctgttggggtaagaactggctgtcaagggacatgactagaagcagagagtccagtggggacgcccctgcagtactgcaggcaggaacccacgctggcctggcccatggttgtggtagcagaggtgctgagaaaagcagctggattctggatatgacatgaaggtgtagccaacaagatgcacagcaacactggatgtggaggatgaaagaaaagaaggagtcaggaatgactctgaggtttttggaattagcagcaagacggattaagttgccgtagctgagacagcaaaggattgcaggagaagcagtttaggttggggagagcagggttggagaaggtggtattttatggatggcatttaatgccttgaaactagatgagactgaaagagtgcagatggagagaagaggtccaaggacatttaaaggttaatgataaggaggaagcagcaacggagactgagaaggagtagccagatgtcctgggagccctgtgagggaggagggagtggttggctgtgtctagtgcaacacaaaagtcactggtacctgaaagcagcagctgagaagggtggtgggagcaatagctccctttgactgggtccaagagaaaagaaaaagagaaattggaggcagtgggcaaagcaactcttatgaggaaatgagaaaagttaaagttaggtgatagctagagggatgagtggggccaagggtggttttgcttttttaagacgggggaaattatatatgtgtatgtgtgtgtgtgtgtgtgtgtgtgtgtgtgtgtgtgtgtatgtgttaatgtgccagaaggaagactctagtgggaaggccatgggaaatacaggacagagaatttctggagtgggttactaatgcacaagtgggcagtcgacccctgctaagaggtatgtttatgaggcagttgcaggagggaagctgtgttctgagggtcaatgcaggtgggagagtagaggtggaagggaggctctggaagatgccttctggcttcatctgttaagtcactgaacttggaggcaaggttatctctgaggatgagacgggctaggaggttagagaagagagggctatggaaagtcaccttggagaggagtgggtgagattgccaggcagcattcagccccctggagactagggaccgtgataaggagtgaacctaaagagtgatcagtggcacagtttgtgtgtttttgaggcactttgagctgcactagtgcagatttagagtaggggagagaaacagaggtaatctttcaggctctctaatacctgctggggccagggagtggcttcttgcctccctatctcaagttagggcagaggctccttagttacctgtggctgagtaggtcctgacccgctgccttgggtgggcaggaaaaaggaggaagatttctcccatgagcccaggtaggagccaggagcagcgtcatgcctggaagagtcttgggtcctggtgtgggtctttgggactataaagcagcatctcttcttgcccaagagcgccttgtcagccacggctttgactgctcatgcagtgtcttctctgaagtcactcccatgtgtcaggctcacttattctcatcgattctctcatggaagtgaggcccccttgcccctttctcatttttctctcccatgtactttcaggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaaggtactgctagtcttcagcatgcttcttgattggaagttgggtagggctgaagagattcgttctgtataaaatactattttgcattgcttttgctatttggtaaaaagtccattggtatgaaaatttgatctttaatatagtgttccttctgccacatgctaggtgtaggctacatgagtcagagacccttattagctaacatggtcaccagcttacttatattaggcaaaggagctttcaaagaaccagatagccctgaggaaaagacaaaaatggtcaactaaggaatgtcagcatagcccaatagcagatattgatgttaactagagaaagtggacttgctgactcaccaaacacgggatatgcttatttaatcttaccttcattgactatgagtgatagtagtagtttgaactttatctgtaaccacccaataagctcaaaggcaataatccaactgacatttctttggcttggccctgatcaagccagcattctgcagctatctagttttccagcagccgtatatttggcatcctgtcaatattacacatgcctctagatttagtattttggataaatgtttgagagtcctatagccactgctgctgtgatagtaacaaagatgttataccacttttatcaatggaaacactgtacataaagttattgggcaccaaaggttaagtcatggttaatttacactgataaactgcaagatatgggatcacagattttatatctaattccctacattagtagagacttcttcgcctatcttagctgacttttaaaaacccattctggatattttccagttttaaaacaggtttaaggttatctcctcttttaaggtataaggggtaggagaaagcactttgtaaagcataatttagaataaacatgcaagagcttataatcatgaattaattttaactccctgcgttgctgcatgcatttatcatctttttgggtgagtatgaaactgtctgagtcaggtttccagcaatgccatttgggcaccaattctgtatcaaaattacatgcaggatcctcagaacaagtgagcccttcagacgaggagcacagtgacagagttagtgcctgtcactgctgtgggatgttgacaggccagccaggggagctgtagttgatcagcttcctttcaaaatgtgctgggattcttaagctgcttgctgcccttcactgattggtgtttaccccagtgtgtgtttctcactcactcatggcatgagtctaaatcatttccagcctcaggaatctcctcaagtcaaaattaaagctttctcatttacaaatctacaccgttaggatccagtgtaaaaaatcatgcccaatcagtcctgtccttcagttgaaagtagacccagcttttgtcctctccagaaaataacacctaagaaagggttgccagacacccactcttggtgtgtctgtgtcctgactttctaggactggtaccaagtggtgccgagccatccacatgccccgttccaattctttttttttttttttttttgaggcagagtcttgctctgtcgcccaggatggagtgcagtggtgtgatcttggctcactgcaacctccacctcccgggttcaagagattctcctgcctccgcctcctgagtagctgggattacaggtgcccactgctacacccagctaatttttgtatttttagtagagatggggtttcaccatgttggccaggctggtctcaaactctcaacctcaggtgatccacctgcctcagcctccccaagtgctaggattacaggagtgagccactgcgcctggcctcccccttccaattcttataggcagcctgacatttaggagaagaccagccacgattaagacagcagtctgtggttgctagaagttacccatgacctgacttgctgacaccaccttccaacctactgacctaattggacagaatattcctcctccccctccttctcctcctcctcctccttctcttcctccttcttcttctcctcctccttcttctcctcctgctccttctcctcctcctcctcttcctcctcctcttcctcctcctcttcctcccctcattgcccacttggctggctgcacctctaggcttttcgtggttcccgatcaggttgctgggaagaagctgccccttgactcagtattgggaggaataaaatggagtaaaagtatggaggtgaaggcactcctagcttcatttttacaagattaaaagtttcctcgagaaggcccaaaattaatgcttcacctacctccctccttctcttggtcccactgcagccaatttggtccgtgataatattctagcctcttttgtctcagcccaaagttccatgattgcctgaagcaggtagtgacctctagaacaatgtattgcctagctaatagacaaatgtttgcatagtttttatcaagtaggagcataagaggaaagtggtatattggacgaaaagtttaccaaactgattccagaatgttctataatgagacccaaaaacccctacctttgtctttgggataggaaatgtgaacaggagctactttacaaaatgttacaaaaggtaagaatgcaagttaggattaaaacacgtcactgtgttttggccatgatgggtggctcattctggtaattccagcactttaggaggccaaggcaggtagatggcttgagctcaggagtttgagaccagcctggacaacatggtgaaaccccatctctataaaatgtacacacacgcacacagccagggatggtagtacattcctgtagtcccagctacttgggaggctgagatgggaagatatcctgagcctgagaaggtcaaggttgcattgagctgtgatcatgccactgcactccagtctgggtgacagagcaagactctgtctcaaaaaagcaaaaaaacaacaaaccccacattacactggagagctgaatccattttgcatatgttaccactgtagatataaccaatttcatttctgtttctaatccttgactgtggttttcataaatcaaaatgtaaacagccactttgggtttctggctcagaaatttttaaattaagtacaataaataaaatgcaacaaaagtagagtgaaatagacttcacaagacagcacaaaacaaagagaattggttttaggtttcatcaaaaaaagtaacattagaccagagttattgggcatggctgtgactaagccacccaaaaacaaagattcatgagccagatctaaggctggggtgaccacctaatgaaaaaatgataagactgaaaagatgcgatttttaattttctttcaaaatagtttctggaattggatcaatttttctctatcagctggaattatatggtattttaataagatgaatcatattgtgttttatggtaaaaggtagaaatcctgtgctaaatttcattatgttctgactgctggtctaagatgtggtgagccccataggagacaaagtgaccctaagaaagatgtcagggcagaaagccctgagacttccttgggcttgacatcaccctggggagccccaggaaagtgacttcccaacccttgtacctaaccaggggcagcaaaatccctcctgttctcaaagggcagcttctatgccccaagttacagccagaccaaaacagacatggagtggaactcagtttccactttggggacctgatgttgtcttactctcttgcattcattaggtttgtcatagggagggagcccagaatgtatctggagaagtttatttatcttgaagtttctaaatctatttgaactagtaacagcaacttttaaataaaaattaggtcagggtgagccttggcctgggttatttttcttatttttatttcttagagataaggtgtcactctgtcgcccaggctggagtgcagtggcacaatgatagctcactacggcctcaaactcctgggctcaaacgatcctcccacctcagcttcccaagtatatttttaaaagctcctcagggactctcaagtacaaccaaggttatgagccactgatttcaggtgaaaaatgaggcgctgaaggagcactgtgttccccaccaccactctccacattgacaccccctgacccttttgattttcctgagaggagatagaaatcctcctatgctgtattcaagttcaggacataataagttatttaacattcccctcagaaacctgaattctacctagaaactctgaacacagctctgggacttcagcagggctgaagtgtgcccagacacttctggtgtgtgcctgctggtcctataggatgtggtgaatcgtataggagaataaaatgaccccagagaaagatgtcagggccaaaagcccctggagggcatggagactcccttcctctctcctgggtctctggattaggataacaaataaactgaattcatgcaggaagtctgtttaacagttggcctctgctctagacaacccaaagggcaaatatgagaaattaatactctttcctttaacaataaggcaaaccttacctggcaagaaattttatttctgactaaggattcctcagcctttgcttgggcttagttttttgtttttgtttttcattttagggtgtgtgtgttggtgggtgtgtggatggggggcggtttgccttaatactttcctatacatctccccgtctcccttgtttcaagactttaggaaaattccatagttgtcacatctttgtgacatctgtgtcattgcatccttgtaactgtcactttctcaacggacagttttgaaaatatcctgtggcatcactcttttggcagggagcgaggagggatgatttaccatttctagaacttctgcctctctgagcccgacccaaggtctccaacagtgatgcagagaagcatttgcaaaggtctgtcgcctttcatggaagtgctctcagactcaccagcactccccaaacctcctgcagctctcttaataaatcaagtcctcagcccagtgtctattatcaattgcagcaccttctggggtgcatcctctgatactagtaaaatactctttaaaaatgcaaaggggcaatatgatgtggcaacatttcaggaagccttaagcttaatgactactattaactatttaaatttttctttccacttcttttcctaactgcaacctgaatcctcactcttctttttccaaaacggaatgtctctgagggggaagttaggtctttttctttcccaggatgcctactgaaactaggttgtggtcactcttgcatgatggtcactcttttccaataaccattccaaatcaagtttgagtctttacttgcagattcttaaatacttttacttggaggtttaatttgttctatccgaaagcctgactcgggcatctcctctgcatgggcattttgccatctgtgtgcatcaaggattggtgtctcaccaaggatccacctgggtagacttgtggctctgcagtgcttatatccagccgagcctaaatatctggcttagcggttctagaaaatattcctattaccatgtgtgactttctgccccacggagtggctgagtttgcaggctcctgcctcctggggctgctggttctagaaagcggactcccaacccaggtagctgcccaccagctgaatctggggctgccgagaacaggcacagctcttcccgaagctttggcagttgacagtcgctgcctccccttctcaggaatcctgtgactcttctagccttgagtgctgtctgtttgaagcctcaccctagaggggctcacctgcatcttcctagaagctggacccagtccctgagttgccttaatgaccgccctcctgctccctttgagtttcctgctcgcctagacagcctctctttccacaaagggtaacctctgcctctccctcatcttggctgtgcacacccctgctccctctccctgcagtgttcttagccaagtcaaaaacaaaaacaaataaaagccttacatggcattcatcctgaagcttttctccggagactgtctttcctccaggggagaagggctactacgggcatgttggaggctcccggtagttggagctccgaaggaggagctctgccgtgggcgttcagcttaactaggctttctggaaccaaaacagagcctggctgcttcccaggcttctccctacacccttaaagaagcaaggtcctctctttccttgagcacttctggacatatttgggaaagcagcatgttcagagatggccctgccatggtttcccacacactatctcatgtccgcctttttgctgaccacccaaagatagttgttcctgttttcacatccagccaacccctagtctagcatcctgtacctggagcctgggctcaggcacctccttccatcatcacttcctccctgagagttcttggaacttgctgaggaagagggcagagctttggctaattgttcttttatcgacaaattaagacaaaaaacccaatgtcctgttgctccagagctgaccatgggtgttgggggcatcctggccctccagaggtatgcattttttgttagtctgcatggaaatgttcccacttgagaaccaggcacctaacagcaggcactcaggaattacctgtttaaggaagtggattatatatcaaagagaggcgataaatatagggaagcttacacagtcaatcagaaagagaccatcagggactgggcttgtttctcagcctcttctgtacctgtgcagggttcagcatcatggaccgtcactgagaatgtcttgagactccaggcagcagggtggtatcatacccaagtcagcaaggggatctcctggctgtggtgtacttgtgccgtgctgacacttggccattcccacatcagcctgggttcctgctttcccctggccttttcccttcctgagaaggaacatgtcagtcaatccagcctgtcataatgttcactcgccatatcggtttgtttggcttaaagttagtttttctgattccatattaaaaatggatctttttatgttagattctgggtcactaatcttagtgtctttgttagaatgtcctggaccattgtatagagctttttctgtactattattctattctgttctattattccaactattctagggccagtgctatatagctgatagctgattgggtagatattatatctaactctacattttaagaacatgtttgacactttcatacatatattctttcatgttcactttagacatttttttttctaactccaaaaacaaatcttatggggattttgataggattatgtatatgcaaaataaaggtaacatatctattggacagccaatatatgtattacttttatatatattttatatatgtaaatatacatgttacatatataaatatatataattagataagagataactacagcacacttatgatgttgaaacttcttatccaggaacatgaggtttctcatttatccaagtcttcttttattactctcaagaaaatgttgtcattttcttcaggtagaagatacaagaggttttttgctttgtttccttgtttgggtatttttgggggttgtctggtttctcatcaattgcagaacaactttctgatttcctacttagaggcattgcttcctctcctgttactgatacctgtctgacctctgccccgtcacatctcactccctctttctggatgccatccccttcaagaaaggcatttacattttctaaccttcacaaggaccactctttcttctctgacctctgctttatatcctcttcccatcattgaccaatttccttattttcaaattttaaaccatggaaaaccactgtggctttctgaccaaaggaatgcactaaggaaaagtgcctcttttttttcttttctttttttttgagatggagtctcactctgtcacccaggctggagtgcagtggcgtaaactctgctcactgcaacctctgcctcctgggttcaagtgattctcctgcctcagcctcccgagtagctgggactacaggcacgtgccaccatacccagctaatttttgtatttttagtagagacggggtttcactatgttggccaggatggcctcgatctcttgacctcgtgatctgcccacctcggcctcccaaagtgctgggattacaggcttgagccactgtgcctgaccagaaaagttccttttagcaagagtaggatggatggatggatgggttagggagagaagagatcagaagcaggaggcgagtgctgggctgctctgagaagtggggttctgggtggtcaggcctagggtggagaggtgggaatggagaagtatggatggggatgagacgctttgggaaggaagagtggaccacagttgctctgtcttaggaccatgtggaggactagtgaagttcactattgctgacttgaggctttggctcagaaggacaattcaaatggatcagaatagatgactgccaatccttagacatggatataggcacagagagctctgccttgctcttgtaagtgctgctttagattattgtcagagggaaggagagagttggacagccctacccaacccactccctcatcttgggcagtactaaccagatgacacttgagtgtttagtagcatctggtggaggtttattttgattatgaagaacagcacttaaagcacctttttgctaaaatctagagcttgcataattccatttcaggtattcctttaatgcttattctttccttcatgatatgggtggaagtgctctgcaaatgtgcagaatcctctgtggggacagctctcccatgatcttggggtgctcagtggcgcacccctccctgacttagaggggtgtgtgcaggcatgtgtgttgctgtaagttgagctctactgagaatggggccaagggcatgtcaggctcggggccaccacgtaggtctgtgcaaattgcttgctacatgtggacactggctgccagagatgaggctggaatctgagtagtgcttctcccccaagctgtttgccatggggctgaatctcagggtgatggcaaggggcttcattttgtcatctgcataaagactccagttgagctggctgggctcctagagtgatggggttttgtggatgaggggttaagggctactggttcccagggaatccctgctgccatcctgtgctcacaagacacctgctactgcacctccagacccctatctccattctaggcaggaagaagggggatgagcacaaggcatggcccaccagttctattgctttttaatcaggaaaacaaaagccagaaccaagtcatggggccagcttcagttgcagagggtccagggagggaattgatttaatggacacattgccagcctgaaaaaaatcagagtcctgttgctgagtggggaagagggcatggatttggggtaggtgcccagcagtgcccggagaagcaggcctccagcaccacagtattggcattgctagttgtaacatccttctttgttgcctgtatttaacattctgtcaaacttttctcattcctttagcattccacacacaacataaaattagatttaaaagttaaattgagaatttccagggactcctgataagtttcttaggtcaactacgtagaacagaacactttccctgaagagtggggaggcatgtatgccacgtgtccctgggagcccagtgttcaaagctgacaactctacccacaggaattgcccctcctgatcaccaggatccaaaacagctgggatgttttcagttgttgttgttgggtttttttttttttaaatgaagaagtttgagtttattcccaactgcatatttaaggatctaaaatagaaatttagcaactaagtctgggaggttccaggaggacttaagctgggcttgagcctgtttctcctcgatgcctcacggtccctggggctacagcagaacagtttctctagatggcttggctgctcccagccctagccagggcccctgctttagagaacaaggtgaggcctcagtgcaggagatcagatgatgagtggcagtcagttgctcagtgggaacctgcctgcacagtgtggttgaagctgcttggctgggtcagcaggtcctctgggatgtggccccatcaaacttccagtctcatccctgacagtttttaacaacctagacaaagccacttcttatctcctgaaggtcttctgtccccagactagatcctagacattctttagggcctagcccaagggtcagcccttccagaccctgagcccctccaccaccaggtgagttacagttgctctgctgttgagctccctcaacaacagagggtgcagcacaccccattactgtgctgaatgtgtcttcaggagatccacagtgcctcattcatctttgttactctagacttgttacatgagtcaaaatagccatcctcccaagtgtgtttgcctcaaaggaaacctgagcaagagcagggagcttgtggagccaagtcttctcccacctgcccccaggtgccacctgcacccaacttcctgagagctgaagaggaaagctgggggccttgtggtcacagctctggccagtgacagggttgactcatcaccccacagacactgtcttagtttgctaaggctgccataataaaataccacacacaggtgacctaaacagcagaaatttatttctcacagttctggaggctgggaactccagatcaaggtactggccagttaggtttctagtgagggcacttttcttggcttgtaagcagccaccttcttgctgtgtcttcaagcagcagagggagagaactagtagcactctggtcttttcttataatgacaccagtcccgtcatgaggatcccaccctcgtgacctcatctaaacctaagtatctctaaaggccctacctccaaatatcatcactttgggggttagggcttcaacttatgaattttgaggggacataaacattcagcttataacacgtgcttgccaagctcccatcttttgctaattctgggctggctgcagagataggtgaagcccaggacctgcctctgaggaccacacaggccacctgggaagccacacataaaagggctttgagaatgccaggacacttcttattccctgctctccttctaggcctctaagctggttcgtcccctattcatcctcaccagtgcatgccctttcctttcttttccttggaaggctcctcttcattcatctaccaggcagctgcacagaggcctaagtgcacaggaaaggtggaggtgctctggtataaggggcatggaatgtttgaatggcaaggtgagggctttgagacagtacagctgtagatctggaggggctgacaggccaatggtgctgtattctccttattgatcctctcttctcagcatgtaaaccagctctctctgggcacgcaccatatgtatgaaggccaaccaagacattcggacacctcaaagcccacaagaaaggaattctgaaaggttttgattttgttttcactgcttctatggaaaaaacagatttttttttcttgcaaaatatcacattttcccaattgaaggaaaatccattttatttttgtatgtgtctgactcttgaagttctgttgctgacccaagcttggcagcatctcagaactaatccctgatactttctgtgctgaacagtagccagtccttctctgagctgaactggggccatttgttttcatctctaaataagtagtgagtgcttttaataatgaaatgcagaaaggacccaagatgatgcattaatcttggattctccttttttatcactaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgaggtgagggaagctctattaagcattatttgtattttatcttatactgcatgtataatatgctgcatgtccacatttcaaaagatccatggtgcctttctgtctcaactagactctgaataaggttaataattcttacacgtgttaaactttttgaggggagggggagtctcactttgcctatgaagttcagcaatcttcactcaggttcatttaccagtctgcctctgaccacattctgcctacctcaaaatggaagaagactatgataacctccttgggaagccactagggtcttgtttcatgtcattttaaaccacgtatgtttaaaaaaccatacctttcaaaggtagggttttcagtacatgtgcacatccatgtaagaactttctctcttggcatttgttggggtacagagagacatatttcatttgataagccagagagctcaagccagctgaagctttagcatttgttgatctgaatgtcacaaagtagagagacactgggtggcatggctgtgaccgcacagctggtagctggagacagggttcacctgcagggcctgggttcatgttcttccacaggccacgttctccctccactgtgggttggtgccagtttagcaggttaaatctcttattataataatgaaaagagtgagcagagccgatgtgtcccacccaccaattcctacagaagggtattatagcttgggggcccactgggtcagagtggggatctggggacactgctttgtggcattgggtggcacctaacccatcctcctattggcagggggccccagactcctttaaagcctctctgtgattggggttcatcttcttgtttgagacacttgggcatggacagaaccaatgatgcctgactccagagagggagagcaagccttctatagaaaagttgagagtgaggaagggcctgggcctctggccagaatcacccatggccctgggaatgggagggagcagtgggcacacagtacgtagaggggtctgcacccaacccactaggcatgccttcatgctttggaaggaagggaccttcataggaaaagccattactagaggcctgaactgcattgaatagtggacccccaaattcatgcccacccaggatgtgaccttatttggaaaaagggtcttgtacatgtaatcaagttaagatgaggtcatactggattcaggtgggctctaaatccaatgactggtatccttataagaagagggaagtttgaacacagagaggagagtgctatttgaagacagagaacacacaggtatacagaatgccatgtgatgacggaggtggaaattagagtgatgtttttaaaagccaaagaataccaaggatcgtggacaaccaccagcactgggaagaagcaaagttcatcccctggggccttcagagacagtatggtcctgctgacaccttgattttggacttccagattctagaactgtgggagaatgcatttctgttgtttaagccacccagtttgtggcgttttattatggcacccctagaaaacctatataaggctcaagtagctctactctgagaaacatacaccccctgttccaggaacaggtacaataagggaaatgcacttctttcctggcagaagaagttgttccctgagctctggagccaagccaggcagcaaagccagtcagcatatccaggtgtgttctctgtcttcaaacagcattctcctctgtgttcaaacttccttcttcttataaggataccagtcattggacttagggcccactcgaatccaggaatccagcctatcgaaagagtgagggcacacggcagaccggagcaggggacatgaaggagtgagtgggcgacagctgggagatacagagagagagactgaggcagttgccagatcgcaggaaggggcaggccaggcctcagtgtgatgcatcccactctgggaccctcctagaggaacaaaggatgagcagggcagtggcctgctgttgggtggacctggatgtaccaagtgcaaagcgtgtccccgcagaccctaacccagtgacggatgagagacttacactgacatagatattttgtctgtcagtgcggctaaggggcttctgctcctgaatctgcagcatctgccccataagccagtgaagtttgcatttatttagtacggattaaatgacaaaggtcttgagtaaataccactagagggaaattaacattgccgacctcccagtagagagcaatcatgcacccacagataatcaagggttggtcttaggaccacatgagtaaacaagctgtttagataaactcccccacattcccttgttatttgctcttttgctgtcaactcaaggtagagaggattaagctgctttcagccaaatcttttactggagctatgcaacccccctggccttccaagaaggtttgcttctcttttctataatatcctcttacaatttttcccaccaccctgactgaactcccacatctctcctctaggggagataaggcagtggctcttgggccatcctatttacacaacaaggtcctttagagagcacaaaagcttcagattcatacggagagaggctacaaagatagccagagccagcctgattaaaagaatagatggacaactacccctttaaaaatatttctcctccttgtcatgagaacttgaaagtccctcaggagaaatttattcctttggttttgcctttgttctttcctgaaatgcaactctccccaggtggggaaagtttcagatacaataagttactcagattctagaatgaaccaaattattattttttcttgtctggctggtttccagttgagcacccttttgatccaggaaggaataattacagctatgacgctgacggatatgggagtagcagcacagcaccaaatctgactttcataggatttttactgtgggccagacaccaggtaggcgcctgccacagattctcctcaaagcttatgaggtacatatgctccccaacgtgaagaagaatgggagtcccagcattagtgtgtgcccaggctcccaagccagtgagccagagagccggggagcggggacacaagctctgaagcttgaatccagaatgcaggctgcggttttgtggggtggctggccctggaggggccctccaggcctgggtttgtgtgctgcagagaataagagggaatctgaaaggggagggagagacatgtatgcagcagcgcagccctcttcactgtgctgcctacatttgctacccaggagtagctgacttacagagcaatttgaagtgaggagacacagccacaggaaacactggtagcccttactgagattttattgcatcgtgagtcctcagtaaattcatagtcacaacgacacagagttacatttttactttctcttctaaagcaggtttctcaacttcaatgctactggcattttgggttagacagtgctttgttgtaggaggctgtcctgtgcattataggatgtttagcacatccctggcctctacccattagatgccagtaacacctaccctccccccacaaccaaaactgtctccatacattgtcacatgccccctaggagcaaaatcaccctggttgagagcccctgatctaaaggctgcctgtgtgaatccagagactgtgtagatctctcagcacttcccagtcacagctgtgaagactccagtcgaaacccctcttggagaatgtggcatccagggcactctcaggcatcacctactatcttgggccattgatctcagggacctgagaggcagagatgatctagatccatgtgccaaaccaatacccagagcttgttctctaggcttgttcaagagttaaatcaggactcagaagagatgcaattgggtacatacagatctttgttaatgagatttccggcttgcacccagagggcctttagccaaactgtctgcttctcggatgcaagcactgtagcctggcaccatggcttaacggggtcgtttgaaagctctgtgtacctaaatgtaattagaatgttttcatcctgtggctttgcttagcaacccagtggtatgtatccaggtttgtcatgaaaacctgaaagagtagttaacttcattaaggaagtcatttttcataagagtattaaaccagaaaatcattttgcagccatctctaagtagcattaatgatatttccccaagtaaaatggcatcaaattatcataaatggaagtatgacgatttttattttcttttcctttcttctcttaattttatagagtctgtgtctactcagagggtagcacaattgaatggtcccaaacagcttggcccaacttggctgccagtccaatcagcatcctagaaacagaagttttctttggccacagataaaaaatgacagcatctttgaaagcagtttaacctgtacagttcctgtccacaggtgcccagctgcgcaggtgctggatacacacagaggaacctgaccacagagagtcacagttgacttagcagtgccagggaaccagaatatcttgatgactgagtggcttagctgcactgttaatttgcatttatggttgaatttattcactattaatttgaatccctatgaactatggagctagtgctagaaactagaggtagcccctgggttcttctctagctccgccttggtggatccagcttagcttcaggcaaatcattttgtctgtgtttgatacaataatttctgccctaaagtgcctcaatgaataatcataagaatgaaagaagatactatcaagatgctttaaaaagtttttttttttaagttgctacaggaaagtaactacctggatagaacactattttctcatgcaaatatgcatattgtatgcaaaccagacatagccctcagggcttcaactttcaactttggtcaccaaaatccttgtggcagatgcttatacaaagctgtagccagtgttctgtttaaaactcacagggcaaaaggattactcattatagtttcatgtgcaggtagaagaaatggccaaacccaatagtattggcgtctatttttaaaaagggatttctgcatttttctccaaaatacatgactttcagatacaaaagcaaatatacttagagcaatgctggagagacgctgtctaggcaaacgctaaaaacatggaagttatcacattgaaacaggaaattttctgtgaccccttcacgggccttgtgatgggggtgcctcacttactcagcttgcagctctcaacccctctagggagtgggagcacacaggtgagtgagtgcaggagctggggcaagtgcttctgggcaccagcaggagcaaaactccgtgtgggccctgcagtggtgtctggcagggagtacccgcaacccctgacaccccacagggcatgtgtacagtgtgcactgttagctttgccatcatggatggcttaaatgttaactcagttggccctctgccttttcatgtgaggtggttgctctccaccagtgagggcagagggtcagtgtgacagcctttagcgcccgcatctatggcaccagagctcttgtttagcgtccagaaaaaatcaggtcacataaacgaattgaaagatggtgaatacagagggtttcattgccagtgaaagtggctctcagcaagaaggagagctggaaaggggatggaatgggaaagtaatcttcccccagagtctggccatccccagctgcactcctctttgaagcaatgctgtcaagccatccctctgaagtcaagctgcctctctctgacatcaaacgacaatctctgatgtcctgctgcttctcctcttctccccttctctgctctctgccagtggagcctggggtttttatgggtacaggatgggggtggggcagaccaggagtggttttggaaaaggcaacactcgagtgggaaaatagggatgtaaagttctcactttgggccacagttccaggcttgagggtggggcctttgccaggcaccccacccttttctgcctagaatttctctgcttcctatccctatcaacatattggtcttgtttgatgtttgctttcctgtgaaatcaaattatgatcgtgcaattatcaataaatctactgacttagaaaaacaaattaaaaatactacctcataatcatcacagtatcatctgctcacaaaaaacaagggccatcagctcataggaggggctcataggaggtggctttaacctgcccttccactgtcttacagctattcttattgtcagtgatgtgtaaaaaaataaaatggcaggtggcaacctcataaatcttcaacattgaacaaatagtataaattagagaaatgaaaaacaaaaagaagagtaactgctttctcaaaggaacaaagcaacaaaattcatcacaggaagatgtcttctgaaggttgtacaaagtgttgacagtttttcattttggaattttggtcatgccagaaacaatggcagtgctaaggaaattaaaatagaaattttagagaagcatttattttgaagactaattgagtttaaatcatgcatgtttttaaggaggcaacatctgcttgaagtgtcttggctatctcttaatgccatctgcatgaacaggtgggacacgtgccaggttgtgggcaagcaaggaacactgccaccacctatctctccagatgctcaaactccacctgaagcctcagtgattggagccctggtgaagggaaagttgggaagggaggtgcctcaggctcaccttcgataactttacactgactacagcctgaatgcacatctgcaatgcagttttgcatcactggcttctgataaactaaggccgctctgcctgttaacaccctcttcaagcccaggacctcatctatcccagccagatacgtcctgatgcacacttgtgtaaatatctgcatatgtagagactgtggtgtcaagagccctgtttctcattttgttatttatttttttagcttttgaactaatatagagtgcagtcgactttttggtatatggttctcttgagttttaaagcatataaattcatgcaatgaccactgcagtcaggatttaaaacagtcccatcttccaacaaaactcttgtgttgcccttttgtagttgtaccctcaacccacctctggcacctggtaaccacttatgtattccccatcactgtggttttgtcttttcaagaatgtcctgtaaatagcatgtaaccttttgagactggcttctttcactcatcatgatgcctttgagattcattcaagtcattgtacatatctatagtttgttccttttattgccgagtgctattgcattgcagggaatctactacaatttatatattcactgctcaagaatatttagcttggtccagtttttggcagttatgaataaagctactacaaatattcatgtacaagtgtttgtgtcaaagtaagtttccatttttctaggataaatatccaagaatggaattgctggatcatatggtaattctatgtttaatcttttgaggaactacagcttgtcctctattctctaacagtgtctatcacaaagcaaaagtttttaactggataaagtttggtttattatcttattcttttttggtatcatgtctaagaattttttgcctaacgtgggttataaaagttttctcctatgttttcttctaaaagtttcatagtattccattttacttttagatctgtgatccattttgagtttgtttacgtatagtgtaaggtttaacttgaggttgctttttttgcatatagagtctagttgttctaacaccatttgttgaaaataatatcctctctctattgaattgccttgcacctttttcaaaatcaatgggccacatttatgtgtcctgttctgaactgtctgctctgtcccatcgatctaggtgtctatccttgtaccaatgacacattgtcttaattactatagctttttatttattaaagtcaggttatacgatttctccaaggttactctttttcaaatttagttgttctagttcttctgctttaccgtgtaacttttagaatcagcttgtctctatgaggtaggagagcagcaggacttgttttctggtcccaaccctgatgaccaaaacaggatctggttcagatgggataaagcaaaaaaactgacaaaaaccacagatggtgacaaaagcaatccttagctgccctcattgctcataggtataagctactcccactaaagccatgacaatttataaatgccatggcaacaacccacaagttaccacccctttccagggcaagaccaaaaacttactgcccctttcctagaaagttctaaacaacccacccctcaatttgtgttgacctggcttttaatttgcatataattgaaaatagatttacatgagtataaatacagttgccaagaacccatactttgctgactctgggcacactgcctaggagttagcccagctccagaaggagcagtactgttcaataaaaaatttcagtctatcaccaccagcttgcccttgaattctttcctggttaaagccaaaaaccatcccaggctaagtcccagttttggggctcacctgtcctgcatcatatatctacaaaaaattatactggtattttgattggaattgaattaaatctatagatcaattttggaagaattaacatcttgtctgcgttgagtctttcaatccatgaatatagtatgtctctccatgtgtttattatttgtttctatcttcgattgctttcatcagcattttctagtttccagcataaagacacttaacaggatttgttagagttatacctatgcgtttcactgtaaatagcatttaaaaaaattttagtttattataaatgtatagataacgaactaataagatggatttttgtgtattgaccctatatcatacaacattgttaaactcacttctttgttttagaaattttttgtagattccttatagttttttatgcagacaattatgacatctgtgtgtatgagcaggtttttcctttccagtctgtatgccttttatttcttttatgtgcctggctaagatttccatatggtgttcaataggaatagtaggagtagacatgagaatttttactttaaaaaatgtaatcacaaaggaatttgagcgtaggagaatcataagtattctggtgcctttttgccttctctgccttccacaattgatttttaccagaaacaaatagaagtaaaaaggtatacttttttattagcttgtatttatggataccgtcatgattttttctgcaatcagacttaagtttagtattacttaaggtactatcatttctatgtaagttttgaaatacagttaaaatgattatatgtcacatgaacaaaagtcaatctgagttctttgaaaatgattcatttttataagcttttaaattaatgcaggagaagtgctacaaagcatatcttttttacatgtcttactctacttcctagggaatagggagctgttctctaatcttgtgttttgtttttcatctttctctcacctctcatctccctttcttgcctagaatgtcctatgtgtgtgagaccctgaaaatttgggtcaagttgcttcaagtatatttggtttatgacaatataacacctgtacatacctctactacctggttggaaaattataatatgaattttataacattgaagggacaggggagggtccatcactaagagaaaatatactatatcatctcctatttccagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggtaagctctctgtaagagaggccgctgatcccacatccacagtgttgagaaaggcagtttttcattgatcagtactaaggcagtgaaatatcattcttggcatagggtacggagggtgaattgacaatgaggaggtcgtgtgtacaccaagtgatcagcagctggccaatgaaggctgattctaaagtgtctgcctggtgccagcctcagacactagattgtgggcaccaggtcactgattacaaaacaaaacaattacatttttttttcagatcctatattctcattgtagaaaatatggaaaatacagaaaagcacaatatagaaaatttcctataatccttccacgtgatgataatcacctaaactgccagtgattgtggcaattagcaggtctttttatgttgcctattgcaagagtttgggaggggaacagaaggaaatgggccttaatggagaaagcttgaggaggctcctcctgagtagaaagcagaggacatgggcatcctctctggaatagggcagtgggagtttttcgcaggctgaacagaaggagccagtgtagaagaaaaggaggagatggaaagtgaactgtgtgggatcttagttgagaggaagtctgcagaagagagattctatagcccaggtgagccaggtgcagtggctcacacctgtaatcccagcactttgggaggctgaggcaggaggatggcttgaagcctggagttcaagaccaacctgggcatcatagtgagaccctgtctctacagaaattttaaaaacttagccaggtgttgtggcatgtacttgtagtcccagctactcaggaggctgtggcaggaggatcacttggggccaggagttcaaggctgcagtaggctataatcaccttactgtactctagcctgggcaacagagtgagacctccatctctaaaaaaaataaagccaagtggggaggctgtgtggtctccatcttctggcaaaggaaggagcaaggtcctgtactgagggccagatggtggtgggtttgggggactttagaagggaactacagtatttgaattcatcaggaagtcaagcagagaggaagacacctagggattgctgaggtgactgctatgactgggtcacaagaccagacagcatgctcaggtgactttttttagccaagggaggtaacatcagggagaaaacagatcactgggtcagcctggcaagacctgggctggagaaactgaagctggatttcctggctttgggatataggctgggggagagcctcagtcaagacaaaggagtgggggccacagaataacagcagtgagggtgggggagatggaggccatgaggctacagagcaggctggaggtctgagggagggtgatcatgaaagcagtggggtagagggcagtagccttctagtgagcagcccaggctgccaggtggctagccgtggagtgccttgaggggaggaggaggcctggggcagttcagggacatcgagcgcacaactttcattgccaatctgcctggaaggacaaaaagcaaagaagaagactgtggtctagaagccgaaggaagatgagaaggaagagtgtccgaggagtcagccacagccagaaaggagagtaagaggagggcattccctaaggcagaaatggggagtccagagcccttgtcaccccagcacaaggtccttttggtctccactgcagggtctggggagtagaggctctccctgccacacgtttccatacctaggagcaatgcccatcgcgggggattgccttgtgctggggagaacaccgtgtgttattcccttatacaaaaagtcagaagaacaaagtaaacccaaattgtacactctttattgtctaatttttttttaactgaaaggaagtagcagaaccactcctggacctgaaggaaggaatagaccagttggagaacaataaaaccttgggctttatcctgtctactctcttagccattgggaactttctaaatggaactaatgtaagtcatccccatccctcatcctgtagcccccccttgtcacaaaatccctgcccagcaattgctgatgaaggttgtacctcaggttccccaaagcacagtggaacaaatgacttttgtgtcttcttgctgaaaatctagaaggaatttgttcttaagatatcagggcctaggccgggcgcggtggctcacacctgtaatcccaggactttgtgaggctgacgcgggtggatcacgaggtcaggagatcgagccatcctggctaacacggtgaaaccctgtctctactaaaaatacaaaaaattagccaggcatggcagcacgcacctgtagttccagctactcggaatgctgaggcaggagaatcgcttgaacccgggaagcagaggttgcagtgagctgagatctcaccactgcactccagcctgggtgacagagcaagactctgtctcaaaaaaaaaaaaaaaaaaaaaaaaaaaagatatcagggccgatttatttcaatctgtgtcttgctataaataagaaaacagaaaaacacacacatgattctttatgaagtgtaactactctcaaacttgacattggaaaacttccttctgccccattttttttctgagcttatcactcaaatactcatgcttataagcattttgatgcttaaagaaaaacaactgtttaaaaatcttttttttaagttctggggtacatttgcaagatatacaggtttgttacattggtaaacatgtgccctggtagtttgctgcccctatcaacccatcacctaggtattaagcccagcatgcattagctattaagaaacgcaactttttaaaattggctcagctttgtccaggaagtagacaacaacaggcaaagggaggaagaagtagataggcagatgtcagagcccagccccacagcaccctgatttaggggtgagccctgggacatggctcatggctgtggtgggaaagggctagaggctccctcattctcagggtggctggcccatgtgtgatcagccatggatcatggagcatgtggccccaggagcttcagccacagagaaactgaatgttgggtgactgcagccaagaattgatcctaaccatcctgtgctattctctaagagcctgcttgaaacatgtcttttattgatgtttgcaaaacaggccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggtatgtctgtggacgctgaggagtgggcctggtctcgctgcagccacgggatctttatcggtcatcctcgaggaacacgagccctattaagtaaaatgcccaagtgctgcctgcattctctgctctggagtttatgaatatgatttgttttgtggcatttctaatgaacttttaagatctttttcctatctctggttctcagtcagattctttcctactaaggtatgcaaggcaagcctgccatcccattcctaaaccctgcgtccactgttaggcagtgttactcaccagggtggattctccagaacgctgaaacagcacagcttgtcttaggtggcaaccatgtcaaaaagatgcaatttggctcttcctgagatgtccataggaccttgcagtgaggtgtggagccagaaaacagggccctcccggctcctgctccccacagataggcagtccctatgatcttgcccagagggaacatttttatagagctgtaaacagtatatggccttggccctcagctgcaagctcttaaagcgagtgcagagttaatatcttcatgaacttatgcttcattagaaaagagacagtcacagtatgtggacacctggctgcctctagtgcagggggtcactgaggctgaccaactcctagagggatcccaaacacaccagaactgggagatgtgaaggtcttaggagcacaggaaactcgctaggggagagggcaggggtggaaaatacccttaaatagggcacagcaaccaggctagtgtgaaggaaccttctagaaacactcctggctggagcatgagagctggaagtactggggtgtgttggaatccagcatgagaggaagagagagagtggtgggcaaaggtggggaaggatgtgggttggctgctgaggcctgcttcaaggggccctccctctctgtctgccttctgccacagccctggcttgtggggacctggtggccgagagcctcctccacctacctccagagccacaggctggcctctgccaggtgcaccgagcaggggaccctgaactggcctatcagaatttttttctaagcctcattgtatcatgagaaagcgaagcctttcctatctggactcaggattcctttggtttcagacaaatcattttccccaaagtgccatgaaaccctgcatacctgaatcccagggctttgcctaaactcgccttctctttctgatgcaatagcatcaggaagcccagtacatacggtgtcttgcatgcctccctgcctcacaccagacacgacactgcgtgtctttatcctgttggtgccacagatcctcacagaatccacctttgcgaactctttccccttcattgtccttctaagggtgggcctggaggtctgaagtcactccagcaagtcccctgtgggcttcagaaggccctgctcgttgcctctgtcagtggcccctaagtagcaacggcttacctccgcgcccctgctcacctccacgcatctcccgctcagcccctcccgaccccgtaccctctgtgcacctcccgctcaccccccgccacaccctccatgcacctgccactcatccccccacctgcaccctccgctcacttcctgctgacccccgtgtacctcccgctcatccccgccacaccctccacgcacctcgtgctcaaccccgcgcacctcctgctgctctgacttttgcttgctggacacagcctttcccatcttagctactttccatccacctcagtcccctcctttcagcacacccacttacctatttcttcctccgctcctgtccttcacaatttctttccccatccctttgttaaatgtggccctctgatgtatttttttcatgactaaaaatctctctgatttatgtaatttttagtctggaaattctataaaatcatcaccttagaaaacctcatctcagtctccttcaggcaatccagcctgtctgcacgtccctgaatacacagccagcactctgttacatctgtcccttgcatgtgtgatgtgcatctgctggcaaccctcacccacacacaggcacacacacgagcctggtggggtctgtgtgtccttcagagtttgggaatcacctgtgggtacagttagcctccttgagaacaggaagttgtcttattcagcatttgtgtttatgttcaatgcctggcttagagactggtgtatgctagtttctccatgagtgttggtggaatgagtgagtgggcaggtgaataaaacaacttgtcactcacattataaaggagatcatcacgaagagaagctggctgcccattagttggtccccagcatagcagagccatcttcataggactagggtgcatttctcaactttaagagaaatattatcgctgaagaataagagtgctctgaaaaaaatttatgagacatcttcttagttcatcttgtactagggttccttgatatcatgttttaatttacagttcccaaagatttatttctaaatatggccaaaaaaggtaacacatgtattaagttcatttggagaacagttttatcactaaataatgtgatgtcaagataatgacagatacacatgtgaataatttttaggctgtaaatatgtttgcatttcaaaatgtgaatttcgttttgatgtttgtttctccccagaggcagttttgtctctcagttcaggctggtgtccggcggtttcagtgtttgcagtgttctcgctctgattttcaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacaggtaagtggattgaggaacttatagaaatatcagtacaatggcatattgaaaaatttgtactggaaattaagagccgatggttaaatttacagattttttgtacattcttggtacatagcaagtacactgatgatacagatgtttaacagtttcatggataattaatttttcttacacaataatataatgccatcaaacctcaaagttggaaggaatctcagaaataatttgatccaaaaatcctacctatcaggaactgcgtctgtaagatttctaacaaattgaaccctgcatctctgggtctgctggaagaatttcacctatagagaggacactccctttcaaggcagctctctttgttagaaaagttcctcctttacctgatctgcagctggccttcggaggaccttccagtaacagatcctccaacagctgcttagctatgccacagcctacctgagggaggtccaagctccatcacagcactgtcctctggaccagccctcctcagagtcacaggatccaagaggaccctggagacacagcagtgatgtgtcagaccttgttgtgcccacaaggagaatggggtctggaacagcccatggctgtccagggccgtgccaccagaaagcagtggtagcccgaagactagaacctggatcttctatcttcccaggccagggcctttcctaccatgtgctaccactctcttctcctttgctttgtcacagaacacggttgagggaccctcacccattcttccttcctccctccctccctgcctttcctttctttcctcatctccttctttcaccttccttaagcctatacagaactttttaaaacctgatacttttatctgcacatgaaccctctcccagcttgtgtcagtttctgctttgatattcatactccctgggtctccattcagaccactgagaaaatggcaagtagtttttaaagttggacgggacaaaaataagaagcagaatcttccctccaggttgacaactatccgtcagtcagttcttttggaatttaattgttcaactataaatctccctgactatctatctagaccttctggctgtccttccttcctcaagggaacttttaggatattttgtcagatttcttactgaaatcaaagaggcagggaatgtgagctggtttggccctccatgctttgtatgatgcaagcaattccccatttaaaatacacgcacgcgcacacacacacacacacaacacacacacacacacacacacacacacacacacacggagagagaaccaactattatttggaacgtcatgaaactggagtaattttatgaatgtcttataaagctgttgagcttggttatgttaaccattttatcccagacagattaaaaactcagtttggtggtgtgtctatttcttaagctataaagtatttgctctgattatcccattctccttggtaagctggtcacccagatgatggctgctcccgcctcacctgtccacatcctactggggatgaccaggaggagccagaagttcactgtggttttggtgtgggtagtaaaaggggcgtggctaaagggaggtggtacccggaagtggccagtccaaagtatctaaaccgtagaaccctgtgttcaaatgaagtctttagctggagcgctgtatgtagaactgattaaagcaggactctcttgttgaaattgagatggaggactgagagccccaaggactgtgcctcatttttccttccccctcccaccaacagtcctcaggatcatagctgaggatggctgtgatttttttttttttaaacttaacacattgggaaactgaggcacagaaaggaccctattcagggccttacagctggtaaccagagggatcatcttagtcatgcaaatgagcctgcctaaatacttatattttgatgtcagatcaaaaagtttcaaaaggtgtctctttgggtaaaacctactttttgaaactgtttcctggctaagaaaattttgttttggatgttcaaacctgcatttgttttaacttttattttaggttcagggatacatgtgaaggtttgttaacataggtaaactcatgtcatgggggtttgttgtacagattatttcatcacccaggtactaagcccagtatccgatagttatcttttctgctcctctccctccttccaccctccaccttcatgtccagtgtctgttgtttccttctttgtgttcataagttctcatcatttagctcccatttataaatgagaacatgtgatatttggttttctgttcccgtgttggtttgctaaggataatggcctccagctccatccatgttcccacaaaagacatgatcgtgttctttcttatggatgtatagtgtttcgtggtgtatatgtaccacatttttttatccaatctgttattgatgggcattgaggttgatttcatgtctttgctgttgtgattagtgctacaatgaacattcgtgtgcatgtgtctttctggtagaatgatttatattcctcttggtatatatatacccagtaatgggattgctgggtcgaatggaagttctgcttttagctctttgaagaatcaccatactgctttccacaatggttgaattaatttacactccctccaaccgagtataagtgttcctttttttccacaacttcaccaacatctgttattttttgactttttaattataaccattttcactgatgtgagatggtatctcattgtggtttagatttgcatttctctgatgatcagtgatgttgagccttttttttttccatattcttgttggtcacatgtatgtcttcttttaaaaagtgtctgttcggggccgggcatggtggctcacgcctgtaatcccagcattttggggggccaaggtgggtggatcacgaggtcaggagatcaagatcatcctggctaacacggtgaaaccctgtctctactaaaaatacaaaaaattagctgagcatggtggtgggcacctgtagtcccagctactcaggaggctaagacaggagaatggcatgacctgggaggtggagcttgcagtgagccgagacagtgccactacactccagcctgggagacagaggaagactccatctcaaaaaaagaagtgtctgttcatgtcctttgcccacttttagtggggttgttcatttttctcttgtaaattaaagttccttaaagatgctcgacattagacctttgtcagatgcatagtgtgcaaaaattttcgcccactctataggttatctgtttactctgttgatagtttcttttgctgtgcagaacttcttaaatttaattagatcccatttgtcaatttttgctttcattgtgattgcttttggtaaatttcgctgtgattgctttgtcagcctgttcctatgtccaggatggtattgcctaggttgtctcccagggtttttatagttttgggttttacatttaagtctttaatccatctagagatgacttttgtatatggtgtaaggaaagtgtccaatcttcaacatttgactagccagttatcccagcaccatttattgaatagagagtcttttccccattgcttgttttgtcagctttgtcaaagatcagatggtcataggtgtgtgaccttatttctgggctttctattctgttccattggtctatgtgcctgtttctgtactagtactatgctgtcgcaattactgtagccctatattgtaaagttgggtagtgtgatgcctccagctttgttctttttgcttaggattgccttggtaatccaggctctttttttgttccatatgaattttaaaacaatttttttctagttctgtgaagaatgtctttggtagtttgataggaatagcattgaatctgtaaactgctttgggcagtatggccattttaatgacactaatccttccaattcatgagcatgggatattttccatttgtttgtgtcatctctgatttctttgagcagtgttttgtaattctcattgtagatatctttcacctccctggttagctgtattcctaggtattttattcttttcgtggcaactgtgaatgagattgcctttctgatttggctctcagcttgactgttgttggtgtgtaggaaagctagtgatttttgtacattgattttgtatcctggaactttgctgaagttatcagctgaaggagcttttgggctgagatgatggagttttctggatatagaatcatgtcatttgcaaacaaagatagtttgactttctctcatcctatttgaatgcgctttatttctccttcctgattgccctgaccagaacttccaacattatgttgcatagaagtggtgagagagggcatccgtgtctcctgctggttttcaaggggaatgcttctagcttttgcccattcagtatgatattggctgtggatttgtcatagatggcccttattattatattttgaggtatgttccttcaatacctagtttatcgagtgttttaacatgaagggtgttgaattttattgaaagccttttctgtgtctattgagataataatgtgggttttgtctttaattcttaaacgtgcatattaacctttccttttatccttttgtactctctggatgtacagacccacccactcactcctgtagattcattaggctacagttgcactgtgaaaggcacagagagggactggggagaggaagagaagaaagctgttattagtcgattctcatgctgctaataaagacatatccgagactgggtaatttataaaggaaagaaggttaattgactcacagttctgcaccactggggaggcctcaggaaacttacaatcacagtggaaggggaaccaaacacgtccttcttcacataacggcagcaaggagaagtgccaagcaaagcgggaaagcccttataaaaccatcagatctcgtgagatcttactctcacaagaacaggatgggggataccgccccctatgattcaattgtttccacctggtccctaaacaatgcatgggaattatgggaactacaatttaagatgagatttgggtggagacacagccaaaccatatcaaaagccttcctgggaggcctagcaaactacagcaatggactgccattcaagggggagagacaggcagaagacaagtaaacaccaagactggtgtgccattgcccaaagtccacccctcccattctgggctagacagtggcaggcttgagtaagagtcagatgatggaacaaatcaaagatgtttgacttgtgctttggcttactggttaggggggccagcctgcccataaccatacaatcttcatatcatgtattctaaaagttacaaactcaactgaaaaaaattccttaaaagttttatggcctcaaagtcatatcctttttgttcttctgaaggaataccatagtttctctcttttcaaatgtatatctggatctttttcagacctttacttgtttgttgttactctccttgtttgtaaaatacatgcttaaataacatttccaatttatatgttaagtttggattccctgtgcatccaaaaacaatgctctagaaagtgtaggataaagaatcttgggttgtacttatgtataaaataggacccagaatgttaatctattagaatgaggtgaagtggttagctagctgcaggctgatggattctcccctcaaatcttcctgcatacagatcttgaatagttgttatattatactgtactgtcctatcctaatatcatatcatatatctaatatataatgtcaagtggtaataacagccaggaagaaaaaataagagtataaatggttaggtagtgacctgacacagggtggtcatggaaggcttctcggaggaggtggtattttgggcagagacctgtggaatgagtgagagccatccatgcagctgtcagtagggaaaacattctacacatggggaacagctggtactggataccttgtcaggcctgtggtcctaccctgtggagtggcctcctcacccctccccacaggccctgcaggctctcagttccttggcctctgtgtccctccagggctcctgcacactacacatggtgtctggggctctgaggtgggctttttcagggaataaccaggattccagtgtaactagagtcacaagagatgaagtcagagaggtgatagggctagtcgtccagggccttatttggaaatgctatatttagtttatccatgcattatatccatccaatgctatacttagtttatctttccatggacatttgggttgtttccactttcagctattgtgaataatgcttctatgaacttttgtgtagaaggttttgtgtgtacacatattttcatttctttttatgcaaatgagaaaaattgctaagtcatgtaataaactctgtttatctttttgaagaactgccagatcattttctatggctgctaaaccattttatcttcctaccagcactgtggaaagggtccaatttctccacatcctcaccaacatttgttctagcctgtctcttttattacagccatcctggtgggtgtatgtggtgtctccttgtggttctgatgtgtattccttagtgatgttgagcagcttttttcatgtatctcttggccgtgtgcatatctttttaggagaaatgtctattcaaatcctttgtccattttttatttgtctttttagtgttgcgttgtaagattcctttatatattctgacacaagtcccttattagacacatgacttgcaaatattttctcctatcttttagattgtctttttagtcttgataatatcctttgaaacacaaaagtttttaagtttaatgaagtccagtttatctactttggtcacttctgctttgggtatcatatctaagcacattaatccaaagtcatgaagatttctactttattttcttctaagagtcatgtagttttggatagcattttttaggcccttttactttaaatacaagttgtatgtttacttcattattcgtctcaaaaagagtaagccagtgtcccttattttaaaaaatccatattcaagctgtgcaaattagagtgatcaaaattttttgtctataaatagtggtatcatttgcgtaatgttgtttgttccacagaaagctttccctctgtctcccactgtgttctttctcatttcctaataactaaaatttgggtacttatctgctcatgtaatttcttttacaacattttaaaacaaataatgtttaataatttttgtttacaaattaagtagttaaaataaatttattttctgcttctttggtgtttcctaattaaattaatattatatataatatcacaagaaatgtttaaaaatatttactcagaaaacagcatctacttagaagctatgaattaacatgttattcataatatgttcatgtctattttaagtgttcattccaaagaatttctaagcaacatttctttattcctattgaattgtcatataatctagaaatggtgcaatacttttcgaaaataccactttaacatttttcttacaaaagttttacatatatccattttagaaaaatgttaaaacacagatacgcaaagtgaaaaagtaatctgttgaggtcctgccacctagatataatctccatcagtgggaaagtgagttgaacttctgtttgcattttcacttgagaagactcttgaaattcaaagccccaggaatgaaggacagtgtcttcttactgagagtgtggcttgttggtttctttattattattattattattattattattattattattatttattttaagttctcacattggtttcttactgagagattttagacaagtaatttttatttcttaaaacggaagtcattgctattactgttttttccttgcagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgatgtaagtttcacacaatccctctccttatgtcattcgttttcaaagtaagatcagtcaggaatcctccccacagttaaaagctgtgcttttttttttttttttttttttttttttgactataaaaaattatctcttttaaaaagtgctcttaaagtactcctccaccatttctgtgaaaatctgctaaataacaaggagctaggagatgtaaagttcagaacgtgtggctagaagaggaacatggaacccattttggtgtgttgcatgttgctgatgacattaaatgtttgattctatttttgtcctctgtgatgtgggtaaagttggatgaagacaagtaaaatataaaagataatgccgcttatcatagaaagacaaatgtactgattggggcattgattcagaattttaatcatcataacggtgctgtgtaaccaatcagttgacacatggaccacccattgtgggcatctgaataaactgatgtgattgctccaagatacaatctaatgggctcttgccagtcccttgaatcacaggacatcagggtggaaagagttcccagaggacagtgaatccagtaggagtttccccatagcaccctggggagcccctgcacacttacatgtctcccctgctcccgggctctttccccatctctcctgtctcagccccaagcctacctaggtcttggggggcagtggatattcagatgacagatgctcagtaaagtggagggtaaagggatgcatgacgatgccagagaccaacggaggtacatagtgcaggttcctttttcttaatgtgcctttacgaaacataaaaaccaggctagcatctcacttacctcatccattactgtaaggtcagttccaggcaaaaggctgaaattttctgggaatcctcctttagtcactatttattctttcttgaacagactcaacgataataaagtcatcttttttgatattgacaggtcatatttggaacttgttgaaggactctagagtgtgattttttttcatggtttggattgttgcccatggatttctcccatctgtgcgtgcatttgagtagcacatggacttctggcaatagagggaatggaatgaggaaaggattaagccacagggcgtgccatcatctgggcagttacacatttcaactgaaccctagttaggcagatttttgctgggggaggaagaaaaccaattaggaagacctcactgaagccgccctatgtgcacagacatgtgtgtatgtagtcagccaagcagagggcacttggttactgctctctagaagtccacattcctgagggtctgacttacatggaaggccagacacattaacttagcaattttgttataattttaagaaccacgggataatcatttctcttaccatccacctttgtgtaagctccttgttttcttggaattttctggacctttaggaagtgctcaggtcacttttgtgcagaaggagccctttctacagctctaccctgcacccaagcagttctgaattccagtgccatcagccaagagtcttctgtatcctttcctgaaatctcagttcagtaggatccacagcctcttggaagacagcaacccaggaagcatgttggatccacttgggcaaactgtggcccacattttattcatagtattatttttgaaagtttaaaaaaagagattgcttattttgtggctatgagacacatacaagccgaatatgcttatagttatgtggacacatcaaaatttcttgctaaattcttgagattttttacagatcccactaatttttaaattctttctcttaaaacatttggctttcccaatcataaacagaggtgaatgtttctagagtttgattcaaaaatatttaaattcccattaaaatctggacaggataggcttcgtcaggattcattctcagcctagtccatgtttttaatggccaaagtggcatcattcatgtagaaggattgccctctgctggaacattaggatattgtcccttaaggaaaactacagccttgggtttttccaactcaattattaagggctcattgtgcatccagcagtgcctgggacaccaaggaagatgtgagtataaagaaaagcttatatcccaaggacatcataacctggttaaaaatggcatatacacaacttaaaccactgaaaacaaagccagacagtagacttagaatcacggaccccctgaacgttggagctagaagagattttagagaaaactgtttgtagtaagtcaccttgaatgtacatgctgaataaaatgaggatgcaagtggtaacatttagagatgagaggtctgagggtaaaatctgcagcccccacgcaccagctcctgagtgcctatccctcttcttctccccgtttctgggtattcagaaggcttccttttcatcatccaggggtcctcccaggccaggatcactgagcaactaattcctcatcctgtgtacaaagttggtcctagagcaaatggtgacatagacaaggcaacacgaggcacctacagcctttctgccgcattcacactcgtgaggtgggctgtgagaacccaggctggtcaatcccaggcctcccacgttggagggcagtggtaatcctgggtgagacccttaacccttctcaatgccagcttcctcttctatagaaagggaatgatgattacttttagggatgttgagcgggccaatattttatatatgtagcaccttgaacatgtgtgaatttctggaaaaatgccagccatcccaggttatataaataaactgtaagaattttttaaaagagagtaatggaacaggactgttgtctcttgtcacaatgccatttggatgaggcagcgtggaatgttacggactggaagtggtttgtcattttaacttccaaaagcatagttcattctcaaaacacttcaatctgatttgctggcctggccctgtaacctcacagacactcctaaattgaaagtgtgtttaatttatgatcaagagattgacatgacttttcactctcaatttatgttagaagagagatattttatttaaagtaacttaaagcagtttagtgctaaagtaattaaaagtatggagagtcagttcaggtggctcccatgagaaacaggtgagatgttaaaaataaattaatttcatgctcctgaggagagagtaatgtgaacacgctgctggagcagttgtctcacttgtcctggctggcctgcatatggaaggaccagcggtagcccagaaccagcagcctgggcagggagggatcctgcgctcgggatgggatgggagggccggcagctgacaggcagagccaagcaaatggaagccagtccacttagaggggccttgatgactgtcaggccgtgatgggttcataaggatgtggccagccaagccatatggttcacagagcaggacactctcagcacgatgcacagctgcgagtgacgttggtggtggtcagggaatcgagttagctgactgttacctcagggacagccccagaagattggcccggagccgtgtgagtccctctggtcatgggtgatcttggagttcacacaaggagtgtccagatgaggacaagagggtggggcctggcagctcccaactcaagaggatgtatcctggttgtggtgaccagtttatttacttggaattttatgtgacattgcgatgatctttttgctgacttctgtgccttctaagaatcccttctgtcttttccgtcctgtcctgtcctgtcctctcgggtagactgatgaggaggaggaagttgaggtatgaccatttatgaacatgaagaatgccacattttaccacctcatgtatgctctggtctaacctaacataatcagcatgaagtgtcagcaccattcagtgctttaaacaatgcatggacatttttctggttggttttcgtgtgatcactaaccacctgacaggggctctcatcatgccacgtttgccagggactgaagggttaaatgcattttccgagctgtccctgaggcccagctaatcagtaaccatgtcacaagtggcaggtttagcaggtctctccctgctgctggaaaagtggacagagaattttcctttggcaacttaaatatgagaactagattctggaataaccacatgaagagtcctgaaatcaaagaggaagtggggcagtggccaagggccaggctagagtctctgtccccagccagtaggcagcctctgatgtgtgaccatttcctctgctggtgttaatggctcccatgggccaacgtccatgcagtggcagatggcaggggctcttccctagaccctggatgcaggtgcgagaaccagagaccaagggggctaattggccctggaaaataaggagagagccgtgtagatgctacaagccacagattgtccccaaccctgttgccatgcctgagacactgggtgacaaaggaagccagcagtctgtggaggtgttctttgcaaatgttaatctgactttttgttcttcatccaggtgttcggcattgtgtacgtatggtattccagcatacctcttttaaaatatatatgtcctgaccttttgttcagttagagaaaatcagcatgaatttatgtgtcttgttctgttttgggccctgataccaattcttttggggtccctggcaagccacatattcttgaagggcctcagtttccttttccataaaagcaaggtgggactaggtctagaagaattcttcccaactcttaacatgctaggattctgtgattgaatcccacttttgtaattctaccatcgtaagtgatacttaagaaaaatttaactgctttctgacactaagtaaaaaaataaagctcaatatgcttggttaacaaggcatatttcatttcaattcttatatcagggctttggtgtaagaaacacatttggttttagaccttcccagagccaatgccagttgctcctgacagccaccctttgaggggatctgagtgagtgacagagacggctacaatggatgaatgggtggtggtccttctggggccgggggcttttctgtctcatattagatcttcttgtaggcacagatgttttgtcattagttaacttcagtgactgccgtaatgaatgtgtctgcaaacaaaacaagacagaggagaggagcttttcctcaaccacgggttttagaagcttgagttgtctttttggggagtctccctcacctgctaacttccccttggttttgcagtctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggtaactcctggctgcgcggggctcgtcttgtcttctcaggttggccgctctgggggggtccggtctccatcgcaggctgcggtccacggctgtgactggccctcggctccagtgccaacctaaccacacacattccctcactagcgtcttcctgacccaccttcaatagcttcatctccaaaacaaacattcccacgagagtacctcactttacacagagggaatccttaccggggatgacctcctgagggagagctggggtgggcagactgcaacctgcaagccaaatccagccttccccctgcttttagaaataaagttttgttgggacacagccatatttactcatttgtgtagtgtctgtggctactttggcagagttgagccactgtggcagacactgtaggacctacagagcctaaaacatctactacacaggacaaggttgccaaccctgccctacagcactacccctttgtccctttttcacatccttaggcagagacaaaaactaaaacttcaaaatggcggccagattcgagtttccagatttgtttttatcattagaagggattaagatgcatttgacatctgtgaatgtttcctcgtgtttccctggtctggcctgataacccattgaccctcctgggtttcttcactgcctgcagggtgaagcccacagtattcacactgttcttggaggccccctgtaggcaggtcctgtcctatctcccaagcttggcattccctcaccctgcatggtcaccgcggcgcttctccgcacgctgctcgtcctagagtccccgctcttctcatgctgctccctcagttcaggatgcccgctcctctgcctgtcccgttcccattcacctcatcctctgggcactgtccctatcaccaggccactctttctcttccatgcactccagagaccccagttagatctactaaagatggtcaactttaaggagaatcaactgttggagacaggctttcttctctcggtgtttgcttagcacacactatgcgtgcagctagaagaaaccatataatcttgtccaagctgggatgctttggagtgtgaaagggggtgctagtagtaattatgctgggagagcaagtaaaacagcatgccaggtaagctggtttgtgggttgccatacacatcacagaaatgcagtagtgagtgaacagatgaatattgcgcccaccagacattttcgtaggctctaatgaacatgcaggcagaaaggcagctagaatctggagggctgcagtctggagaaacctgaggaggctcttcagtgacttctaataggctttgctcactaactagtgctttttggaatcttgctgttgtcaacattcttaaatatacaaaaataacggtagtaatgataaattcaacataatggaaaaaataaatgcagctttgagttttcttgagaagaaggtgagtcattaccacaccacgcatgtggctgattgtagtttcctatgaaccaaagagccacaaactgctgtccaaggaggacctcaaagggacctgcaggctgtgctccagaaccctagggcttttgtgggattcccaagcagattggcacttcagtcttttttactaaattactgactggttttctcacttcatgtgactacagtgttactaactctagttctcttttcttctgtcttaatgttggactttggtgtttaccttttaatatagggcatcagccgggcacggtggctcacgcctgtaatcccagcactttgggaggccgaggtcggtggatcacttgaggtcaggagttcaagaccagtctggccaaccgggtgaaaccctgtctctactaaaattacaaaattagctgggtgtggtgtcacatgcctgtaatcctagctactggggaggctgaggcaggagaattgcttgaaccttggaggtggaggttgcagtgagccaagatggcgccattgcactcaagcctgggcgaagaagcaagactctgtctcaaaatatatatatatatgtattatatattttatatatattataaatatataatcatatatattatatacataatatataatatgttaaattttatataatatgtgtattatacacgttatatatgtgtattatatacattatatataatatgtgtattatatacgttatatatgcgtattatatacgttatatatgcgtattatatacgttatatatgcgtattatacactttatatataatatgcgtattatacacgttatatataatatgcgtattatacacgttatatataatatgcgtattatacacgttatatataatatgtgtattatacacgttatatatgtgtattatacacgttatatatatgtgtattatatacgctatatatgtgtattatatacgttatatatgtgtactatacgttatatacaatatgcgtattatacacgttatatacaatatgcgtattatacacgttatatacaatatgcgtattatacacgttatatacaatatgcgtattatacacgttatatacaatatgcgtattatacacgttatatacaatatgcgtattatacacgttatatacaatatgcgtattatacacgttatatataatatgcgtattatacacgttatatataatatgcgtattatacacgttatatataatattgtattatacacgttatatataatatgtgtattatacacgttatatataatatgtgtattatacacgttatatataatatgtgtattatacacgttatatataatatgtgtattatacacgttatatataatatgtgtattatacacgttatatataatatatgtgtattatacacgttatatataatatatatgtattatatatttctgtgtgtatatatatatgtatggattctactttgatgcacagctgaaaatatgcttgaagaagggcttcctccctccctgccccagtgttacaccaactgaggcacagatgacagggtggaaaaatcatatcttttactacagccttgatccccagacaccctaagtatttgcatatgttattattacatcaaagaattaaagataattagtctctctgagatcgggtctttccaaacctctttccaaaactgtaatttccatagatagttttggatgtggaattgggagaagaaaataatattatgctttggcaatgaaaaggtagccttttagtgaccaagagcagacagacacagctgaggagaaccaaaaccctgattttatgtgggatacattctgattgtctggtttgctatatggaaggaaaggtaccctcttcttgaccagtgctgtctgtaaaagacctccattccaggaagtgattggagagagagtgtgtgtaaacaagaaagaagaggagagaagaaggtggggaaggccagaaagtgaagaaaacagtctcattaaatggtgaacaatagagactgtcagtgtagagccagcataaaacaaggatgagaaatcgttttgcagtgttgggggacatggcaaggggtatcacttttaccttgtggcacccaaaaaggcctaagacatcccatgtatgagcttgtctttgcccagcagctcttgcaggctttgtatgctaggctaaacatggccaacagggatgtgaaggtgaacattaatgcctgcaccatggtgaccccagccatcagaccagagtcttgagcccctgtgtcttggtggatgcaggaggagtgcagttgaagccttcttagggggtggatctcagtaatagaacataaataggttgtaccaattttaaaggaaaagaaacatctattcctgaccagaaaggatagcgagaaaagatgttggtgggtttgtacaacatggggtcatctttgctggcgtatgaaagggattagaatgggaggctgttcagtttctctgcacattaatgccaatctcaagggagacttctgctttcatgcagcatgtgttatggagtggcaagccacccacctgctacaacaactagaagtaaaaataataaagccttctttgaaaaaacattagagaactgtaaaaggaaagaggactagacaaactagaattggaggtgagctgacattgcctctctgtgagcatttgccaaatctgggcacaagctgaggattgggcttatggtagtggagtgactctaatgggaaagagaagccagcagaatttgtagtagctgtatgaactggtacaagagattgaaattgagaggaggctaaaatgcagatgattttctccatgagacatttgctaaatggagcactgcgggatgggggttggagggaggaaggtcagcgggtgatgctgtgctagaaatgttgaaggagatgtcctgcagtctttaaactgaggagacaaagataggctagagtaagcaccttgaacagatacttactgatcttggcctcaagaaaaagagaggtgggaagtggactgattgttaattaaagctgctgtctggcctaaacccagctcaatacctcactgtatctgttaatagcagagaaaagactctctggaggaaaataatgctgacttcagtctctacgttcttctatacacaaagtccagtgtaataaaaattacaagccacaggaataacatgaaaatatgactgaaaatcaagaagaaaaatagataatagcagcagacccataagtgattcagatgttgaaatctacagtcaaggacttgaaatgaccattataaatgttaaaataaaaactaaaaggaaacatagacaagtgggtaaaaaggtagataatttcaatagcaaattagactctataaataagaatcaaatggatattccagaactacaaaacaaaatatctgaaataaactcattggatgggcttagcagagactgatcacagcaaaagaggattagtgaattcaaaggcaggttaatagaaaatgtataaacagaagcatagtgagaaaaaatggaaagaatagaataaaatataagatctgagggacacagttgaatggtctaacatgtgtaattggagtactggaaaaagatggaccagaagcaatatttgaagagattgaagagatttgaagagatggctgagaatttaccaaaacagataaatatcaaccaacatatttaagaaacttaggaaatccaagaagagtaagtacaaagagaaccataccatagacaaagtgctaaaataaataaataaataaataaagataaaatctttaaaacagagaagaaagatacattgcctcctatggtgcaatgataataatgatggctcaattttcaaaaggaactgtagaagccagaaaaaaaaggaatgatatctttaaactgccagaacaaaaaacttcaaccacagaagtctatcttcagagaaatcgtctttcagaaatgaaagcaaactttttacattaaaacagtagaatatccattttgacttaagtgttttccttgtagactctttctttaggttagatttctataaggggaaaaacaaatttcagtgctttctttcaaatctcagttttcatgttttagaaaaataaaagtaaagtggtattgtgctattatggtctagattgctttatcctctccaccacatctcaaatgtcttgctaacacttactactacatggtcccttgggtatgtaaaatgtgtgtgcagtattaccctgatggctacagtgtgggtgcaagggttccaggaagaggaatgtatacatgactaggaagaatggaaataaatggtaatcaggcagtgaggatataaccaagaggagcggacataaagtagaaccaggaatgaagtcgtgagagaatgaagtcatcataaaactgagttgacaatcttggacctagggcaagatgtttcctttaagcatctcctgacacattacattgacagaagatccctgggattgtgtaagatggaaaagtataggtaattctcagagggaagattagatgatgccttcatttctggcccagtgctctgcaaatgtattatgagcaaagacaatttattgagctttgcatgtttttagaaggtatttcggcattttaagataagacaaaattataaatcaatagataaaagggaaaacaggaaattgcggggtaaaacacaattgcatgattgattgctctactctgaggaggaccattgttcagaggatctgcagaggcccagtctaaaagctgtggcattataaggacttttatttccaattaaaataccgtgaccattctgagaatgcagagactttcagcagcaatttcaacagtttattttttaaaagagtctattttttaaaggatttataatgctgaaaaaaactggcctaatagcaagtagatcaagttcctttgggtataagcacaaaaagtacaatctactgtttttgcatgtgctcatgctgtaggtatgctatcatttaaaaaataaaagctaagcaaaaccaaaaaaaaaaactgtatcagtaataacggaaatcagagtctcactttgttgcccaggctggagcatagtggcgtgatctcagctcactgcaacctctgtctcccgggttcaagagattctcctgcctcagcctcctgagtagctgggactatagatgcacaccaccatgcttgactaatttttgtatttttagtagagatggggtttcactgtgttggccaggctgttctcgaactcctgacctcaagcgatctgcccgcctcagcctcccaaagtgctgggattacagacgtgagccactgcacccagccaacaaaaatcttaccattggaaaacatcattgttctatagccacaggttttatgtacatgcaggtgacagggcacctggtgtcctggctctccttttgcaaagtgtgaaatatttatgtatttaattcagtcatgaattttactatcagaaattatgactactttatagcacagtgtgtatttgcagcaatatgtcaactacacacacacacacacatatatatgaaaatcacagtccattgaactgtgatccactgttcccaaccatttccattgatatctattttttcttggttcattcattaccagccaggtggttgtaagcaccaaaacttaaaaaaaaaattagtgtgggagaactcaaacattttaactatttattaacatttttttcctccaagttgggaaaggctggcagttcccttgtgttgtactttagtcaggctggggctacttgtgtgccataggcaatgattctgataattctcacctacaggtttttgaagttgttgtgcatctactataaaatgaagtgtagatggtagaaattaacaattttgagcatattgtacatctttcctcttgtagcaacgtatattcactatcgtatagaagagatttcacaagaaagctgatcaattacaaagatgtagttctggatatattacattagcattaatttctaactgtttaacactgcagttgacctttgaacaacttggatttgatggagcacatctacctacatgcagattttttccaacaatacagatcaaaaataaagtatttgcaggatgcgaagcccatgtatatagagggctgtaaacccaagttctgcagagttgattgtggaacttgattatgcacagatttggatatacttgggagtactggaacaaatccctctgtatactgagggatgactgtacttgggacccatgttttggtgatgctttcttctgacttgttttaatatgtagttatttataaactacagaaaatgttgagggagcagatttatgtaccagagaaaaatttaagttaccaacccctttgctggttaaagagggcaatcctgttacaatttttaaaggctagataattcaaagataaactgtgtattataaaatctatttctttctacttagcgagaagttagggtcagctgacagactaggcacatacaaccactgatagagagctgacccagtaagaccctcagtgagtctctacattactagatgtgcatcaccggatattgatggctgtgtagcagggtgtggcttgggtcatctgccctcaggtgatcacaggacctggcaggtaaagacaacacacctgggttggagagttaaataataatgagagacaagatacacagctgtgttacagggtgatatgaaataagtgccccgcgtatgggtttgctcagagcctgcagggtagcagtcacgagttatggtggtgctccctgcagtggggacaggttagccctctggatctatcactagctctggggctttaactctggccttccctgtgatctgttgctgaaagaactcaactgcttggaggaatactgctgcatatatcttttgtgttttccttctgagtatgttgtgcactctggctgtttaatttttaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatcttgtgagtgcattaaaggaggggcgagccttcacccctacagggatctgccctcccattctacgtgaactgggaaaggtggagacacagctccagtgaattgtcagtggctcccagagtgcctacttgcactcatccacagaaagtttcagggttggctgttgacgttggccattgtggaggaggggagctgcagccacacctgttcagtgtatctgccattggtggctaggcctctctcaattcatactttcttcccaggaaggtatgaaaagtccttaagtgtctgtggtgtaccaggggtgagcacgatgggctagtggagcccatcgtcaagtccagcctaagatgctctgctggaggctgtgtttctgccctgcacccagcaccagggggcgcttgtggggctggagactggcctctcctgggttcatcgctgcccacaagcatgttgaaggcaaaaactagggtagcaagggatttgatggtcattgggatgcttgaaatatttaacgtggcctaggttgaccattttttccttttcccaccaaatagaggattcaactaaatcaaagtgactgattttcctttttggtctgaacctactgcctgctcctgcccacccaactcatgggtgtggggttgcctctgtctgcccctctcagggacagtgctccatagggaaacaggttcctgtagatcctttgacatctccctgcatgagctgtggccttgagtgtttcagaagagcactcagccagccgctgggtcactctagaggctgctttagtctccactggctttgcctctgagaataagggttagtgacaaggaaagaagccagtggcttcctcctgttttctcccaaaagtgaaaggagcatgagtccagctaggcagggagttgagtaagtactcaaattcagagagccccaaacttgttccacccttgagattcacacaggaggtgaccagggtgtggcctgtgtatgttggacccagtggttctgcttgacccatttacacacgtttccaggatacagaacactaacccacattcctgtggtcccctgctcctttcctatgatctgctttcgtttctgatgagaatttttccccagaaaggaaaataacacttgaggttggggtgggggtgcagatagggatgggatgaggagcagggaatgggattctcattcagtaagatgggtggactgagaatctgtttctgacaagctcctagatgaggttaatgcttctggcccttggtacacactgtgagtaacaaggctcttgagctgtggttctcaaccctggatacacattagaatgttctgcagagatgtttaaattcctgatatctgggctgcacccacacacactacttcagaacctcaggggtgaggccttgaggtgtgggtccctgccccttggattagtggcattaggtgtgggctctctctttattgtatgccttcctctgctctccactacgtttatttcattttttaaatggaaaactatcgttcagggagactggcttgtacatcttcaagaatatgtttgtagattccaacatcaatatctaaggcctttacatttctttcttctgatattttcctatattctcactgctactatgaattctttgctgtctcctggtgcacttgtgaaagaacttggctaggggctcgcaactcaaagttgaacctcagacaatacgtgtgtctcctggaggcttgttggaattgcagatttatgggccccctttctagggcaactgattcaaatctgcatttaatgagatccccaggtgattcatgttcataataagatggacagcaccggggcatgagaccaggagtggaaactcttctccgaaggggcgaggctaatccacactcacactccaggctgcatctcagttgctctaggccaaggcaacgcttccatttttgcctatctgcaggctgtgaaataacatttcctgtggttttaatttgcatttcccttcactctgaggaggctgagcctattgccatttgcatctctccttttgtgtatggtttgtctatatcattggctcatttttttgtgataggaaatctgcttaaatagcttttgaaatgaaacttccaaaagattttttgaggtcttaagtagtttatcttcagtagttgccctttattggcttcctgttagttcattcaaggaggccaatagctacttcaaggtcaccacatggcaggaacctgcgcaccagttaactcctggtctttctggtgtgggcaacctcatcgcagggctcaccatggggaggagctgggaagagccatggagaggtgggccaagggagaaggttggaccaaggctgtgaagacagagacgtcccatttgtcaggtgcatggcaccctgacagagggttggaaggtttgggtcagggacctcagacaggagacagcatgggacattggactggctggtccttggaggcccagagcatgttcttctcctccaagtcttcatggccccatcctctggtctacagagatccaaattcttagactcataatgtcactgggcacaataacgcggtcataattaattttcctcttcaatctggccagagagatgttttgcctgtttttgttgttgacataaaataatttcctatggtatcgttttcatttcaattttatgcaaaacagtcatatattctttttatttagccaaacacatttttcctgtgacacagttactataacaagtacagcacagcatgtatgtgtttatctgtaatgggcttaatttattagtaatggcactatcaacagaaatttaagaagggagaagttagactttgatttctgttataaagggatgataaactccagcttttcacagaggttaaaggaacaacaaaaagcaatttgcaaaatcaatgtgaagtttagtggtttgggcctcatgctgaaacagtgctgtatttgatttgtttaatgatggcaatgaggcaagtggataatgaataaccaacatatttgggccataactcatttggctaaagacaataatagttctgctcttgcaggaaacaaaacagaatccatcccataaccttgaaatttatggcctgcaaggcaagccactcgaggatcagagataattaaatgtctgctttcatgtttgatgctggtgactgagcccacacatgccgaacgtcccactgaagcctgaactttgcagtcagctgggatagccaagggcctcgtaatagattcacaggttcccatggctcaggtcggctgctctcccagctggtgccaatcaggggcacattgagtaaaatgtctcaaatcgtccaggtgatctctagcctgtgaaatggctgatccagcttacttcgggtgcccaccctgccccagattctatccaaggatctccagtagcacctactaatttctagagctgattaaagatggactggcccctcctgtaaagacagcggagggtacctatgcatgagcacaagacacaggacaagaggataaacagaacaagtccaagagagaactgaggtctcttccctaaacccaggtggacagtcactgccttttagagggcatccctctctccagagcagggccaggctggaggccaggacactgatatgctaagtcagaaagtcgggactcaggtggaagcctcggggttagagaggcagatgcaagaagcaagatgcattacatggctctctggtggtttcacttttagacaaatcaccctcccaaacagggggaactgacacattaaagaggaggcttgtctgtaagtcccccccacagtgtccgcctgagtgccaggttcaaaaggatgaaggagcagtaaaaagacgaatccaagaacctgtctttcctacctctgagagcctttttgaggggaggcatagggttcccatggtggtactcagggaggtgccatgcacctgaccgaaggatgtttccgtctttcatcatttttgctgccaagttcaaatggaatccatttccatgctcaggaatgcacacatgcccacagcagggatggggcctgggtctcacgagtgacttggcccttaccgtgtatcagttatcttttgtacgatgaaggcagtagtgccagcttcctgggacggttgtggggttaagcgaggcatctatgacaggttcccgccacctttcttcccttccaggctgtgtctcactgctgcccaagggacaagttgctgatgggaattcgttgctgcctgaaggtgcttagggtctgctgtgcacatcccgacccaactgtctgctcttttcacccacctcactccccaccacactgtccacttcactctggcctgctacaattagtagcccagacagatcttcaccactcttttttacccccagaatgcttgcaactggcacataaaggctgcattgtcagcatagcacttggctagcattgttgagataacctaggcagagggctgacactctcgacttaatctgggaaggggaaaggcagttttgtcctgcccagaacttaaaatattgtggaaaactcaagtctgtagattcctgagctgcctttcctttctatccttagtttaggtagattgtcccagaaaacaattggcagaacttatttttcctttcgggccaaactctccctttgcccacctccaacatgactcataggaggaggcagttggtgttcgcattttaactgactgccttctgttcctttcctacctaggaaccaaaaagagtcttcaggagtactggatgctaatgtagccacaggtatagtaggagggcatgggctgggctctgcaaggccaaggaagccacagccagaccagtgatggcagaaagcgcctaatgccatgagtatttctgagtgctgtctcagcctcagtgaacttcatcttgggttagatggaactaggagacttcaaccttgtcaccacagactgtcactgtcctgaaaaccccgccttttcctgcatctcagatgacagtgatttaagtgaggggccccaaacctggacatctgattacccagggaaggttcaaatgcagtgcctgagcctctccccaagactcttgctcagtgtgtctggggtgagtccaagaaattgaatttcagtcaactagatttgggaatgtctgctttttgttgttgttctgggttttatcgcttcaacgttttattctgaaaaaatataagacttacagaaaagttgcaaaaatagtaggacaatttagcaaaaccaggaaattcaaactggtacagtactattaaccgaactgtaggctttattcagatttcaccagttttgccacgaaggtcctatttttgctctacgatcctacccaggattccagattgcatttagccctcatgtctgcttagtctcctctaatctgtgaggacactttgtgaccttggtatttttgaaaattaccggccagttattttgtagaacatccttccatttgggaaggctgtgcatataatggacaggattttatgtggaaaaaaaggaagtcctagggagcacatctggccctgccgttttacgtccactcagaacaaggagggcgtgaatggacggtgttgaacagtggccaagcccgggacctcccagccacaagacatggacatttaaggcatcttgaagttctgatgttagtcaactagactcctagacacattgctcccagtacacctggtagaaaatctttgggatctttgggattaaaaaaccaaaaaacgattttcaaattacacttgataattatgtgcaaaaaaaccccgaaataacatctctcagtgctgcaaaggtgaaagcgcacagatggatttctgtcacctgaaagtaaagttgggtcgatttcctgttgatgtgaaagatggtcaggaactgtcctgccaagcatcggcagggcacagctgtttccagtgtggactgtgatccaaagtcggctcaaacccttctctaccactaagtgtgagccctgggccagtgaccaggttctctggtccgggtttgctcacttattgaagatataacaagagttcccatctcacagtgtttccataaagattaagtgaaacaacccatgtaaacactcagtaaatggtggctgccattgccattgttctcggatgcgactcatcttagtagagtcacctgtgagccctttgtgggaatttttaatgttttcatttctagggaggaagaaaaagaacttgggtgtttttcctgagtccccagacagtcctgtgctgcatgctggcagcagaggcaccccacatcagattcttccaccatcactttgacaccgtgagaactgtcaccagggcctggggtgcagtgtggctgctggtgccttcagagtgacccatgccatctatggcagagttgcaaggcagacagggataaacatttccagtctgttctctgttatgagctttgaggggaggccgtcccgtgggaaaggctggagagcagctttgattcagctggagcatttgagtgggaagtggaaatgaggagtcgggagaggcccaggtgtcatccgcagccagccgaccttgccacagtgctggagaagcctctctactgggtggcagagttgtttctgctgtggaagtttgctgtgtaccatttcataccctgccagcacctgtttgctggcccccttgttttgttctcttatgtccccagccttttttttttttttgctttctggaaactttctgagagccagctccctggctggaccccatctgctgccctgagtgtttctccccacactgtgtccccatcaggcccctgcctttctccccagaggctcccatcgcagaggctcagggtgtacatgtacatgatgtttgatgaatggcaaagaaactgaccagcagacagatggttgaccaaacacccaaaggggctcttgtcgcgtgtgacttgaattgggtgtaagactgattttagctgattactttcatttcacgtggtctttcaagtggtgaggtgaattaactttggctaacaaagggaaggtttcagattctcaggtatttttcattacaccaaggggataacatatatctaagagaatttttttcaaattgccatggaggtccacagaaagtagaatttcataaatggggaagacttttccatgaatactcgcttttcagggatacatctggcaagctaagggaatgaagcctatgttggcttttccctcacagcagaggacacatgagcccagaccagagggtgaagcagcatcccaaggggtctggaatatccaaaccatgagtagacccacgagggagagggcacaggctctgtgctgtcaggtagcaagacccataaaggtacctttagttctgttctctgagcctgtcccagataggctggctcaatgtccgaagctattaaaagattgttacatgagctgtaaggtgaccgggcccttattcgagtattaatatttatatcaactgaactgagcagttacaggactaaagcaaatgtgcaaacagaattgttaagcatctttaaataccttcatgggtaaaatatctgtggggtcttctgtagtcattcagccacaatatatacctaaatggacaaagattcatagactgatgtccacaccaccttctgtggctggtgaaattttaagatgcccagctagtgcagcatgaactacttcttcttctttttcttttttttttttttttttttttgagatggggcctcgctctgtcacccaggctggagtgcagtggcaccatctcggctcaccgcaacctccgcctcccaggttcaagcaattctctgcatcagcttcccgagtagctgggactacagatgtgtgccaccatgtctggctaatttttgtatttttagtagagatggagtttcaccatgttggtctcaagctgctgacctcaagtgatccacctgcctcagcctcccaaagtgctgggattacaggtgtgagccactgtgcccggccagcatggactttttaaggaagtattttgtatcttggttaagaagttgcagcaagaggtctttcttgtcaagagagatattttatcttatttactgttgttaaaattatctttctttaacaaacactctaaggagtctttaaagaacataaaaggttattacaaactagtatttttattgctgccccatagaacaaattctgttgctcagttgaatgtaatctgtctccagctgagacttaggagccaaacattttgtcttgttgagccaaacattcagtctggaggccaagggatcaggggtgggggaaagaggagctagtgcaagaacagctacagatagattgcttcagggcccaaaggtaggcttggaaatacagtagttgcagtaacacgatttgagagaacccctcaccacatatcccatgtctctctaaaaacccatacttgatgtctgtgttttgattctttgagttaaatgctgagcacacaatgggttctcaataaatcatttgttggttgaccaattgatggatattatgttgacccctgttccaagtgctgattcctggaagagaaggagccctttattttcataataggtattagtccccattgattctgccatggacataggtctttcagatcttttgtccacaggctgagtgagcttatatttaggggatgatgggaaggcatagaccatggggtgtggcctgcagatgcatgaggtgggccctggcctctggggagtagatgaggggagttggcaaaggaactggggagacattaaggtgagcttactttctctgaactttgatcaacagcctgccctggtcatctcaggaactctggctgatttagggatttagggtgaaggcagatccataacgtttctcttctgaaaatgaataccccaaactctgtgcgaactttaaagaaatacacagtgggtcaaatacaatttgtaaattaaggaaaatgtaattagccaccctttcaaatgaagacttgtcttgggtgaggcagctacctcctcattcacccttatccagcctttattttgatgttgaaattgaaatactaaacaatgggaataccatcatgccaagctaaacacaagccaattctaagtcagttaaatatgagcatccctccagttgccaactgcaaccccccagtgagagtggtcattggccattcttgagtcttgtgtgttccatagaaaacagccaccaattccagccagaataagtttggcagtttgctccttagcctccattcctcgaggagccactggttattttaattattgtctctagaggccttttagtgagttgaggctaagacccacagtactcatggagagatttgtcctcactgctgccccttgccctggcttcatgcacttgctctgtgggtcttgagcatgtccccagctattgttggtcgtctgttggatttgtgaggttgttgggtcttgtggaacccctcgctgtgcactggttgcctcacctcatttgtattagtggagcttgcattttcccctgctctggaatcaccttcccagctctgatacactcctcatactgggtagatgctgaggtctctcctgccctctgcacttctgcagttcacccccttctcagaagcctcgtgagggtgagcctctcctcctttctctcctctttataagtgcccgcatcactcctctcggccctccaaatcagcacctgtggcattgttaggccagcctgtgtagccccaaacttttgtcctggcagacagactgcagggcacttcagcaagagcaggaaggtacagagtgtgaaccctctggcttctctggaagtccctggggagaaggggggactggagtcttgactgccctgtgccttgctgctcatacttccttttcttctcatccctttgggtgtgacctgcaccaccactgcagtgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 38475 - DNA, 4619 bp, Homo sapiens
gctgcgaccggcgctccccggggcaggtggctgcatagtcttggcggaggtgagtctcgtggtggaggtgagggcaggctccggggtattgctgccgggggaggatttgctggggacccaaggcaccctcgcgtgagagccctgagagcgaatcgcttcgtctgacctcggggttgtctggggcgagggcacgaatcaccccaacctttccgaagcctggtggaatggcttgtgaactgatctcaaaagcagcccaagtcatccgtcgctgggccggggagggggacaccgcggcggccccgccgagtgctacctgggcactgagcctgtggggagaggcgacccagcggggtggagagagataagggaccagtaacgtccagcgtttgtccgtggtattgagcgttctgtgggtcaaattctcaaagcactcctgcgaaataggcctgcccattttgcagaaggggaacgtgaggcttggcgaagttaaagttaccgctttgtaagcgctgtaaagatgagaggttgggtagtggggaacgtgtaagcatctctgaaatggtgattcaagccgggcgcggtggctcacgcctcttaatcccagcactttgggaggcttgaggcgggcggatcacctgaggtcaggagttcgagaccagtctggccaacatggtgaaactctgtctttactaaaaatacaaaaattagctcggcgtggtggtgcgggcctgtagtcccggctactcgggaggctgagggagaagaatcgcttgaacccgggaggcggaggttgcagtgagccgagatcgcgccacttcactccagactgggcgaaagaactaaacttcatctaaagaaaaatacatatggccgggcgcggtggctcacgcctgtaatcctagcactctgggaggccgaggcgggcggatcacgaggtcaggagatcaagaccatcctggctaacacggtgaaactccatctctactaaaaatacaaaaaaattagccgggcgttgtggcgggcgcctgtagtcccagctgctcgggaggctgaggcaggagaatggcgtgaacccaggaggcggcgtttgcagtgagccaagatcgcaccaccgcactccagcctgggcgacagagagagactacatctaaaaaaaaacaaaacaaaactgtttctgggtggaggggggaacgaaaaagaaaaaaactgtttctggactaacctggacagttcttgtgacaaaattcatgtggcatcataaccaccagaatatgagactttggaatttgcttttcaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaaggtgagaaacattcttgtttccgggtggctttggtaaatcaccaccatgtcctgggtcctaagcaaaaaaacatttatctctcagtaaagatgtcttgtctctcatctgctttgagccaggcattttgctggtctgtaggtataacacggtttacacattccaagaaaacagttaatgtcaatccactctaactgctgtagtcattctgtatgcaaagtactggccggatgaggtggctcacacctgtaatcccagcactttgggaggccgatgcggttggatcacctgagatcaggagttcgagaccagtctggccaacgtggtgaaaccccgtctctactaaaaatacaaaaattagctgggcatagtggtgcgcacctgtaatcctagctactctggaggctgaggcaggagaatctcttgaagccgggaggcggaggttgcaatgagccacaattgtaccattgcactccatcctggacaagagcaaaactctgcctaccatgcacaattcacaatagggtttgtgctcctataggaatctaatgccgctgctgatctgacaggaggtggagcgcaggcggtaatactcatgctggctcaacgccactcacctcctgctgtgcggccctgttcctaacaggccactgaatggtatcagtctgctgccctgggggttggggatccctgcttgaacccaaagacaggcttggaaacacgggtagggatgaagactggaggtaagggaatgggcaaagaggctgctgcaaaagtctaggatggaaataaggacctgaactaaagttgatgtagtggggatggagtggaaaaaatatttcaggaaggacagagtcattgatttgtttgctgtgcccaggggacggataggtgccaaggatggtttcacatccaaagttcagcacacaggtgggtaccaatgctggtcattatcaaggattagaaacacaggagcaagctgaagagtgactgcatgatccttgacctttgggagaccttagtttgaatactgactcttgtttaccagctacacacatggcttaacctccctgaacttttctcatatgtacctgctgcaacagggttgttataaagaataggtgattctaggctgggcgcggtggctcatgcctgtaatcccagcactttgggaggccgaggcaggtggatcacctgacgtcaggagttcaggaccagcctggccaacatggtgaaaccccatctctactaaaaaaacatacaaaaaattagccgggcatggtggcaggcacctgtaattccagctacttgggaggctgaggcaggagaatctcatgaatctgggaggcggaggttgcagtgagctgagatcgtgccattgcactccagcctgggcaacagagcgagaatccatctcactggattgtctcactatatcactcaggctctaatttttgtactagaagcctccttagtatcttatcttttcctaagtcctggcttgttttccatacgttactttttcatattacatattacattaccaggtcacagatgggaactactgatttgcttctctccctctctcaacagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaaatttttctaagtttcatcacaaactgtgtccagtttctctgtggtgtttatgaaatagctaaaagcaaatgaagtaaagggcatactatggtttttcacaaaggtttatggtcgtgtttcaaattttcatcatttcagtgaacatacttccacgttacattaagtgtgcctagcagtctgttgcattttgtaagctcacagttttttgttttgagatggaatctcactctgtcacccaggctggagtgcagtggtgcaatcttggctcactgcaagctccgcctcccgggttcacgccgttctcctgcctcagcctcccgagtagctgggactacaggcgcctgccaccatgcccagctaatttttttttttttttttttggtatttttagtagagacggggtttcaccgtgttagccaggatggtcttgatctcctgacctcgtgatctgcctgccttggcctctcagagtgctgggattacaggcgtgagccactgtgcttagcaagctcactgttttagaaggttttatttttgtcttttgagacagggttttgctttgttgtgggggctggagtgcagtggtatgatcttggctcactgcagccttgacctccctggctctagcatctttccaccccagccttctgagtagctgggaacacaggagcgtaccactacacttggctgattttttgtaaattttgtagagacagggtctccctgtgttgcccaggttggtctcggactcctgggagcaatctgcccatcttggcctaacagtgctgggattacaggcctgagccactgtgcccagccggtttcctttatttcattcaaaggaattttgaatttatcttagaacctttattttgaaggaagaaagtcttttttttttttgagctggagtttcactcttgttgcccaggctggagtgcaatggcatgatctcagcccaccacgacctccgcctcccaggttcaagtgattctgcttcagcctcctgagtagctaggattacaggcatgtgccaccacgcccagctaattttgtatttttagtagggatggggtttctccatgtttgtcaggctagtcttgaactccggacctcaggtgatccgcccgcctgggcctctcaaagtgcttggattacaggcatgagccactgcatgtaatgaccagccactggtcagaattctttcaatcaagctgtgttaataagaatattgatgtgtggaaaataaaattttacaattctg

SEQ ID NO: 38476 - DNA, 8707 bp, Homo sapiens
ttagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggtatgtggctgagcccttgtgaaaaagtgcgaatcccagaaaacagtgcagctgcattgtgtgcaaccatatgagcttttacgctgaggtctgatgggggttgtagttcatgcaactgctttaccttagaacccttttatggactggggtcatcctgagggaggagaaggttaggggtttggactgctggatctgacagactaggaggttggaagccaggactcttgcgtctggttgagggttggggcttggactccctgggtccttggagagaaaaagtctggaggtctggactcttgcatcctgggaggagggggtcagggcttgaaccctgtgggtgctgcgaagggtgggttgcggacttggacttctgggtctgagggaggagggctgggagctggattctacggtctgagggaggaggggctgggggcctggattctaggatctcagggaggaggggttggggtctgggctcctggttcagtgggagaaggggctgggggtccaggatccagggcccctgagcctttccctgcctctcaggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtaggtgagtgcggatcccccggttttggggtcccctggcctaaactaccgccccccgcaatctctgcctttccacatgcccagcctttcttggcttgctgatatattcagtcatttagcttatatattcagtcatttagcatgcattatgtgtctggccctgtgccgggcccctggaagggccatctcccgtggagcttccctgacaacgcagatgggttctctgatgtctcccgggggcctctcaatgcgtggcaccgctcacaggtgaaagcccaagctcttcacatctcccatacccctgccaggattcactcctctcgactcattcattccgcctcttgagtgtctctggacccttctcctctcctccatccctatggctgccattgcaaactccagctgtctgggctgaatgactgcaatagcctccttgctgagaataaggatgggctgggcatggtggctcacgcttgtaatcctagcactgggaggctgaggcaggcggatcacctgaggttaggagttcgagaccagcctggccaacatggtgaaaccccatctctactaaaatacaaaaaaattagccaggtgtggtggtgcgcacctgtagtcgcagctactagggaggctgaggcatgagaattgcttgaacccggaaggcggaggttgcagtgagccaagatcatgctgctgtactccagcctgggtgacagagtgagactccgtctcaaaatcaatcaatcaatcaatgaggattaaacagcaggcagggctcagatcttggcaggccaggaacaccaggacaagaagtctggatatttttttttccttgagagtgaaggagccactgaagggtttcaaatgggggaggaacagcatcaggtctggatgcctgaaactctgaagacagttgtattagtctgcttggactcccagaacttatcacaaatagggtccctcaagcacagaaattcctgtctgacagttctggaggctagacatccaaggcaaggtgtcgacagggttgtgagaatcttccaggcctctcccctggcttctggaggtttctggcagtcattggcacgtacaaacatcaccctgatctccgccttcatcttcacattgctgctccctgtgtgtgtgtctgtgtcccaatttaccctttttataaggactccagtcatactggattagggcccacccactggcttcatttgaacttgattacttttgtaacgacactgtctccatataaggtgatcctgaggtactgggggttaaagcctcaacaccctcttttgggggaaataattcaactttttttttttttttttttttttttttgaggtggagtctcgctcttgtctcccaggctggagtgcaatggcaccatctcagctcactgtaacctccacctcctgggttcaagtgattctcctgactcagcctccctagtagctgggattacaggcgcccgccaccacacccagctaatttttctatttttagtagagacagggtttcaccatgttggtcaggctggtctcaaactcctgacctcaggtgatctgcccacctcagcctcccaaggtgctgggattacaggcttgagccaccacgcctggccttcaactctttttctctttcttgagacaggttctcactttgtcaccaaagctggagtgcagtggcgcaatctcagctcattgcagcctcagtctcccaggttcaagcagtcctcctgcctcagcccccaaaatagctgggactacaggcacacaccaccacacctggctaatttttgtactttttgtagagatggggttttgccatgttgcccaggctggtcttgaactcctgacctcaagtgatccactcgccttgacctcccaaaatgctaggattacaggcatgagccaccacatctggcctcaattcttaatgacagtattggggagttctgtaaggaggaaggctagaggccaggggcatattccaaaccctgtttaacagacagacaccaaggcccaaacggactcaactggagcctctgccattaatccacccccaggaatagattactactattttacaagtatagaaaatcaaggctcagagaggttaagtaatgcacccaagctcagagctcagcagtggcagatctgagatttttttttttttttgagacagggtctttctctgttgcccaggctggagtgcagtggcatgactgtggctcactgcagccccaacatcctggactctagcaatctcagcctccgaaggagctgggactacagccaccaagcccagctaatttttttggttagtttttgagtgttggggtctcactctgttgcccaggctggtgtcgaactcctggcctctcaaagtgctgggattataggcatgagccactgtgccaagccagagccaaaacttgaactctttttttttagatggattttcgctcttgttgtccaggctggagtgcaatgctgcaatctcagctcactgcaacctccgcctcctgggttcaagcgattctcctgcctcagcctcccgagtagctgggattacaggcatgcgccactacacctggctaattttgtatttttagtagagacagggtttcaccacgttaggctggtctcaaactcctgacctcaggtgatccgctcgccttggcctctgaaagtgctgggattacaagcgtgagccaccgtgcctggcacttttttttttttttttcttttgagacagagtcttactctgtcacccaggctggagggcagtggtgtgatctcggctcactgcaacctccagctcctgggttcaagcgattctcctgcctcagcctcctgagaaactgggattacaggcatgcgccaccatacccagctaatttttgtatttttctttttttttttttttttttagtagagatgaggtctcatcatgttggccgggctggtctggaactcccgacctcaaactcttgagtagctgagattacaggcatgtgccacaacatccggccaatttttgtatctttagtagagacggggtttcaccatgttggccaggctggtcttgaactcctgacctcaagtgatctgcccgccccggcctcccaaagtgctgggattacaggcgtgagccactgtgccccgcccggaactcaggtctttctgacccaggagcagcacctgcttcagccactgtctttgggtccctgtttggctgagtcacatctctccctccatgtctaggctggagtcctcagaagctgcgtgcagggctgtcccctcagcctggcatactttcctcctgtcacccctttgtctcctccttattcaagtctgggcccacgggccttctctgcaggtcgtaactaaagtcgcacctcctgccctaacctccagcatgtctgactctttggtattcaccaagcacttctcactttgcaaagtcattgattctgcaaatgttcatggaggatgtactacgtgccaggctctggttaaggcacgggatgtagaaacaagttgctgtcgtttttcagctcatgctctggctggagaggcggtcagtcagcagaataagcaaagaggcggagaggctgcgtcctgcctcctcagatgagcactaggaggaaataaagccaggagtgaatggccgggtggggttctggcatgggaaggggggtcgggtgtgttgcaatttttttttttgaaacagaacctcgctctgttgcccaggctggagtgcagtggggtgatctcaactcacttcacccctccacctcccaggttcgtgcgactatcctgcaggcacctgccaccacgcccagctaattttttgtatttttagtagagatggggtttcatcatgttggccaggctggtctcgaactcctgacctcaggggacctactcgcctcggcctcccaaagtgctgggattacaggcgtgagccaccgcacctggcctggtgtgtttcgacttaatgggaggttcaggctctctgagcaggtaacagttgacctaagacttggagtggggagtaagttgtgcggatgactggggagagggtccaggtagaggaacagcacgcggaaggcccccactggagggcactcaggactgtggcatggtgagaggggagccggagggatgggaaggtggaaggacctcaggccacgggatggtctttggccagtctccagagtttagtgcgtgccccattaaacatccgttaaacaaatgaacgggagccgtgggatccagctgatgggcgtttcccaccccataggtgaacgagcgggtcctgaacaggctccatcaggtgcagaggataactcggaggctgcagcaggaacggaggtaaccccttctccgtcccctctgggcctgtgagcctcagctcccaaatgctcccagcccctctgtctctcccacttccacatccacccaaccctcacaagccacaaggagaagccggagatgagggccgggggctgaggcaaacaaggaggaagagtgggattcggtgttggaggagagggctgagcactgggactgagggagggccgggtggagagggctgagcactgggactgagggagggccgggtggaaggggctgtgcgctgggactgagggagggccgggtggagagggctgagcactgggactgagggagggccgggtggagggcctcctccccctgaagggagggaacagcaggatggaaggcacacgagcacagacctgactgcaagtattttcttttttttttgctgtgtgactctaagcaagcagtgtcccttctctgagctgtttcctatcaactaagggcagcaccaatatcatgaggctgcggcagggttgtcggagcttgcaggtggtgagctgagctcagagcttcccactgtgtgtctccacagaacctgcccaggtggctgctgcccctgccactcgcagtgtccctgtaccagcaaaactggagcaagttttgtaggaatggctccacgttgctgagtcaaccacagttctcatctcagtccttggctcaggctcggcacagtggcccagggctatgtgctcttccctggagcccattcttgccatcctgggcacccagcaacctggggtctcctgcctttccggctgttccttcttggctgcctttgctagttcatcctccctccccaaagctgaaacctgcggctcccagggttcctctgtccgtacctgtgctgtccagcacggtagccgctggccacaggtgagattttcacttaagttgaaataggccgggcgcagtggctcatcatgcctgtaatcccagcactttgggaggccgaggcaggcggatcacgaggtcaggagatcgggaccatcctggctaacacggtgaaactccgtctctactaaaaatacaaaaaaattagccgggtgtagtggcaggcgcctgtagtcccagctactcgggaggctgaggcaggagaatcgctggtaccagggaggtggaggttgtggtgagccaaattcacgccactgcactccagcctgggtgacagagtgagattccgtcgcaaaacaacaacaacaaacctgcccaggtgctggtgcagaggaggcattccatcaattgaaccttaaggaactctggaggcaggggctggggaaaaaagagaagggggtgtttataagaggtgaggtcattaggaggagcgttctgtactcccctctcttcagttatcaataaaaattataactcacatatgaatgtttactaagtgctgacatcacattaagtacagaaatcgtctggtgtcactacttcagtgtcaccgctgcaacatccagccgagggtgtcatgtcgtttgcagagcaggaaactcagcctcagaatggttgccttgtcttgctcgaggtctcaaggctggtcaagggcatggctcccaggcctccagtgccagagctcaggaccgtctggctccaggacagctttggcgttgagtggagtgggagctgagctctatcctgtggcccttttccccagccgctaggagataagttattccgttggtggcttctccccctgagcaggttcctcatgagagtgctggactcctacggggatgactaccgggccagccagttcaccattgtgctggaggtgagtgttgggcctccaggagggtcaggaactgggagctcaggacccacccatcacctacctccccctcctgcctgccaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcaggtgaggaaggcgggaactcaaggggagggactggggctccagagccggcgccagtgcaggtaaggaggggggactcaaggggaggggccagggctggggctgagttaggttcagggctcttgggttttggttctgcaccccgaggggcccagggctggggaaagttggagaagggaggtgaaccaggacatgttggaggcctaggatcaggcagggaagtagttggaaaaagtggggtaaaggcttgggtaaaaaggaggcaaagttggaaagggaaagaggaagacctggagaaggaaaaatagctagagaaggctgggagtagaggagaaggaaggatcagagaagacggagtggaagggaaggcccagtgtggggaggaaagctggaagaacatctggacccaggaacactgggattgcctctgaggtgtaaggaggaaggtgactggcctgggcagacaagaactgtgaggctggccaggtgcagtggctcatgcctgtaatcccggcactttgggaggcctaggtgggaggatcacttgaggccaggagtctgagacctgcctgagcaacatactgagaccccatctctaccaaaaagaaaaaacatgttaggcttggttggcaagtgcctgtagtcccagctacttgggaagctgaggtgggaggatcacttgagcctgggaggcagaggctgcagtgaactatgatggcaccactgcactccagcctgggcaacagagtgagaccctgtctctttaaaaagcaaaacaaaatgaaaacaaaaatggtgaagctgatgggattttctagattcccaggcctgttaacaccttgttccttatctcctgcagattaaggttgaggaagactttggctttgaagcagatgaggccctggattccagttgggtttctcggggtccagacaaactgctgccctacccgaccctggccagcccagcctctgactgacgcatgcccaataaactgaccccacac

SEQ ID NO: 38477 - DNA, 17762 bp, Homo sapiens
ggcggggccacgccttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactgggtaaagactgcggagctggagcagtgctcctctaaccctctccccttccgtctcggtacctcagctgtcctctcgccctccgttgggcttctccccagcggggccgggacccctctagtctccaccactcccctgggctctgtcagggctcccctgtccgtctttctgtcactacctcccagccagattgggacatcccactcacccgctccccagagctgtgtccaggaccctgctgaccccctcacccaccaggtctcccgcctcccccatttccctctcttcactgggcaggggttccttctgtcactttaggtatgtaccaggcctctgctgtcagcctccttccgcgagacattccctcctgtcacagcccctccccagggttctcccacctccctacctcctcttctcagctggccccggatctcctccagttccctttgggtcaggacccgagcttccttgccatccccattctgacactccctcccagtgacagtctagtcccaccgtacattgtgtggtacattgtgtggccttctgctctcatctcattcttgggctgcactcttacagtccagttctccaacgggaagctacagagtccaggcaacatgcgctttaccttgtatgagaacaaagattccaccaaccccaggaagaggaatcaacggatcctggtaagtgaagcagttgccagctgtctccactctgcagggctcagaaggcccctgggagtgggtggatgtgggagggagtgaggggagaaaaaggggagtagtagcaaatggagctttgaagaactctgatgcccagcagcctgggatgtggggacaggctccatctttcattcatttgttctttcaacaagcatttatggaacctgcccctctgcatccctgtgctgcaagcttctaggaaaacagccaaatcaggcctagccccactcagagttcatactctagagcagggtttctcaacctcaggactattgactttttgggccaataattctttgctgtgggggcagcatccctagtctctactcattagatgccagtagcaccagagtggatttccctggattgagaacctctgctctagagagatgagaactggctgtgagggacacttttacacaaagctctgaggccacgtggggaagagtacagggcagagtgagctcagtgggaggagaggtctctgccagaatgccttccttggtgaggtcatgttggagctgagccttgaaggctggaatgagggtttggcagtcaacgtttggtgtttcgagtgaaaaggatagtgaggacaaatgcagagaagcaggaaagcttgcttatgattggggagtgaatcagccatggtcctgagagtatacaaagaacaggccaaagagagattgcttacagaatcactttgttgcatacctttaagtgccagaagcccagggcctctctctcaagtcttgtggcagaattcccccaagagcttttcataccatttagaagctagcaccatctgaggcttctcttccagaagtcgtcttgcttcccctgcagggacaccccatattcccttagagatagtggggctggatcatctgccagagatgaactagttctaatccattgtgagtctggattcaaaagcctcagcaaatgtagaaaagagaaatgatgcttaatacctttcaacattggttgtaaatggagtttcccctctctgcattttaggcagctgaaacagataggctctcctatgtgggaaacaattttgggactggagccctcaaatgcaacactttgtgcaggtaatggcaggggaagggacagtgggaagggtgatggggttgggagtggtggcagcactggcactgctgtttcctgtctgttttaagggtagcaggagccatctagagaggtttactaggtgatccctgtgttcctattagacccagagcccttccctgcacgtgtagacgttgctggaaaggaaagataacttgaatttcctaaaaacctcattcatttgtaatcttgtttatttatagctgtcttattccaaaaggcaggtctctccattaatttggaatgtgtgactagtaggtcaaagcttgcgtgaagtttacctgggaactaacgacaggtaaagaacttggtagtgttgaaggctctggactgggaaagaggagcctgggattcccatccagctgtgctgctgattgactgagtggctgggtaactctgcgcatcactgacccccagcctccccctctgtacagtgaagattgtccagcctgaactgtatcactctcgggggctggcatgatgcagacagggccctgtgatggtacccaacaatgaactacaaactaggccctttctgagccccggtggaccatactccaatagaggagaggtcagatgggtgtataggtgctgagaactattaaccctgcactctcccctctcagagatgccctagttccaattggtctcctccccgtttacttgattttgcctccataaaactgttgtgccataaattgtagtgtaattctaggttcgtacaccccaaaagagttttccattacactaccgcagtgagcccaaatgtgatcaactatcagaatcacctagtagcttttttttttttcccagaaccacctcatatcctcccatcccatcctatcctttcctattccctctctatgcagagaattgctgtggggtaggggtaggggagattattgttacccatgagtagatgatgcattcctcaggtgtgtgggcagagagaaggttgagaacttttgaacaggaaacagggccaggtgcagtggctcacgcctgtaatcccagcactttgggaggctgatagggtcagatcacctgaggtcaggagttcgagaccagcctggacaacatggtgaaacccatctttattaaaaatgcaaaaattagccggggatggtggcgtgcgcctgtaatcccagctactcagcaggctgagacaggagaattgcttgaacccgggaggtggaggttgcagtgagccgagatcatgccactccactccagcctgggtgacagcaagactctgtctcaaaaaaaaaaaaaagaaagctgtacaaataatgcttttgaataatccattgttatttgtattatttcttctttattcaggcactttgtgggaattttgaacaagacctctggccaaatggaagtatatgatgctgaattgttcaacatgcagccactattttcaggtaggtcccagtcatgaaagctgacagaaataatgcatagtttgggtttgctggatgagttggcttgagttttagatttataaaacacattttatagttattttaatttatttattctgttttttctgctttgtctgtgttgagaaaatggttttttatatacacactgttttttgttttttgttttttttgagatgcagtcccactctgtcacccaggctagagtgcagtggtgtgatattggctcgctgcaacttccacctcccgggttcaagtgattctcctacctcagcctcccgagtagctgggattacaggtgcacatcaccacacccggctaatttttgtatttttaatagagacagcgttttaccatgttggccaggctggtctcaaactcttgacctcaggtgatccacctgcctcggcctcccaaagtgctaggattacaggcgctagccactgcgcccggcctagagttttttattcagcacacacttattgataacctaatgtaccaggcaccaagctggggctgtggatgtggcagtaagcaagacagacacagatcctgtccccatagtgtttagagacttgaggtcagaggttcataaaagcaatctgagcaatgatcagagcagaatattagaggacatgtctgatataaaatcttttccataaaagaacttccttcattctttttatttttattttttatttttgtaaattactttatttcttccttgatcatttcaagggactatcttcaaaccagtacaaatatttcatacgtaatacctggccattttctaaacaatcgaggagtttgttgcacaataagctacctcacgtctttcagcaagaaatacattaaatttgaagagtaaagacattacataatgaactaggacataattaaaatttgccttaaatatttctttgggggagagaacaccacacttctactcaatgaagagaaacatttttacagtccagaggtctttcattttttaaacacctgtcacgccatgaattcatagggaataggttccagcagctcaggctgcttcccattggttctcaccaagtgtgcttctctgggtggagcaggctggcgcttcagttgaacccaggtacctttctcttttgcttctgtctttttctaatcatctttcttcacccgtttcatgaagctttctcggctcttagagtgcttaatgtgctcaatacgcacactaattctcttggcaagaatcttgcccttgtttgtttacaacaatgccagcagcatgctaaactgtagacgcttccagtttagccatggtaacacttgaggggcattcctttttgaacagtacccattcccttgatgtctacgatatcacctttcttatagattcacatatatgtggccaaaggaacaactccatgttttctaaaaggtctagagaacatatattgggtgcctctcctctttccctttgtgtttgtcattttgatgaattactgcaagatggcagttctggccgaaagggttctttcttaattcttaactgttatagttggggtaaagaggttttagaatttctggtagacaaaggaaattgcttattaagttgtatagtaactttcacgttgaggacaagtctctacactaatttgaggaagatctattttttttccctaatccagtggaagaatttacattgtttctctgctttgtcatcttagaatgctcagggctagagtgagatcttccaaaataataaataaaagggtcacactcaaggggcttctgttccttaaatctcagaacttgaatccttagtgatgcccttaaatactgggaaccatggcaggatagggcgatagacaagaaagaaacattgggagcattgtgaatctgcctgatacctcagaggcattagttccagttttattctctcaaagcagtgcttccatcccttttgagaatctgctaaggacctggacctacttctgagaaacatatatgatacacaaatacatatatatgggattttttttaatatgggattttatacataatttttttttttttttgagacccagtctcgctttgtcacccaggctggagtgtagtggtgcaatctgggctcacagaagactctgcctcccgggttctagcgattttcctgcctcagcctcttgagtagctggggttataggtgtgcgctaccacactcggctaatttttgtatttttagtagagatggggtttcaccatgttggccaggctggtctcaaactcgtggcctcaagtgattcacccaccttggtctctcaaagtgctagtattacaggtgtgagccaccgtgcctagccaaattttacacgtaattttaaaggtctcttgagtccggacacccatctgtgaatttcctaggtgtccccctgctttgcaaacatatataactatatttaaatcatcttccaactgttcttgtaaaatccagggaggcaaggaaaattgtaatttaacgtgttgattaaacatatttttgttgttatatgtaagaagtttgtaaatatgagtttattctaggtagcacacacacagagataacatttaagtccttactatatgctagtcactgttctaagcactttccatgcatataccaaccttctggagtaagtactgttgttctttttttaccagtgatgaaactggcacagaggttagatgaccttatcaggggtgatggctgagataacaggcaaggccactccagagcttgtactgttgtgtactaagttatactgcccttatttgagtactttgtagatgattggagagcatcggtaagtaccacatacctcatgtttatgcctgcttttaggtctttcaccaagaaagcaaaattattttctggaaagagccaaggacttgttttctaatcctgtctctgccactacctggtgaactgacctggggcaagtaatttcatctgtgggccttctgttttttaatttctaaaatgaagaggttgggctggatgaccgcttgatttggctaatttattttccaagttctttaactgtatactaaagctgcatattaaatattcacagtatacactcatgttaggctcagggaagtcctatagtaaagaaatctattattcttagatagacaaatgaatattaaacactattactatttgtaggcctcccaattgacttttctttctctctgtttttgtgtgttttgatagatgtatcagttgagagtgaactggcgctagagagtcagaccaaaacttacagagaaaaggtgagtgtgatagaattaagatgtgggaccttaagcaagttccttctacacctcgggtttctccatcagtgaaatgagcttgttgaactcaagggtctccctggctgctccccgctcattcagtctgtttctctggacaattagtttgtacctgcagaagcctccttggtcccacagagaacagtctggctcccatctggggcagctgaacacagctctgtgccaatgtttggagtcggttctctgggctgatacaagtgtagcataatgcttgtttttaggatttagtccaagttttagaatatattggttgtagcctgaaaacattcacgttaaaacaaagtaaacttggggattttcaatgtagaaggtccctacaaaggtcatctcaccccaagatgacaaactgattgaatctttggtgctgtgtggagcactgtattgagaagggttgtgaggctactttttgcttcagggggaaggagtcagtgatctattagccctgtctgttacgggtgtaagatgggagaattaccattctactattcctgtctgttacgggcataggatgggagaatggtaagccatgtgctacagatttgccagccctaatcctagtcaagtctttatatcttactgatggagatgctgttgattgatcaatctgttaatatcatttggtgcttacagcagtcctgtgaggtaaataggtgcgattcagccttattcacaggtgaggtagtgatcactctgggatgctgagagtatccccatagtgacacagctaggaggggcagcacctacctgtcctgtccccagtaaccaggtttatctcataaacagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactggtaagaagttggaacttgggctaagagtctgcccataatgacagctttctcttctcttgagatcttttacccacccacacatggaatgctgggagctagggctggattcctttcagcctcttgctgaaggccttctcacggacaggttctggaagtagtaagaaacatccgacatggctttgtcttctagtgatccacagtcaagtacagggacaggcatggaatggatacatgcctgccgtgcttatggtgctggggttatggcctgcagggcacagaggagggagaaggcctcaggtctctccttgtgcgttgcagggaagctttggtcaaaaaggctgatgtgttgatggaaatgagcctccagaggtggcatttcactttgggatcagtggctctgtttccggtattcagcagctggagtatttaattgtattattttaaaatgtatttattgttcaaatacattataagaacataagagcaagtttgtgtaagagtagcttttctttttaccgattttggagatgaggtcttgctatgttgcccaggctgatcttgaacccttggcttcaagcagtcctcccgcctcagcctcccaggtagctaggattataggcgcacaccactgtgccctgggcagagcagtttttctattaagaatgaaattctagtaatttttggaaaatctttccataccctatgattatatagatttcaacactttcacaaatttatttattgattgattggagatggggtcttgctctatcacccagactagagtgcagtggtgcagacatggctcactgcagccataacctcctgggctcaagtgatcctcctacttcagcctcccaagtggctgggatcacagatgtgtgccaccatgctcagctaatttttttagttttttggagagacagggtcttgccatgttgcctgggctggtctcaaacttctgggctcaagccatcctcccgccttggccttccaaaatgttgaggttacaggtgtgagccaccacacctggctgcggagttattcttgtggggcagttacagtgttatattctgaaagttttgttccacctacaatgtgtggcaagtttttctagaagttaagccattaaaggctattttggacgtccctcacttttagtttctctcattttatattgtaaatgtttatgtattagcacagctgtcaatcccaactctattgtaagttacctgaggggaatcttgtcacctccaccttctccagtgcctagcttgtgtttgttcatgagtgaacatggcagtcctgaagcagtcagcctgatggggaggcgaggtcactttggcagaagcatttagacttggggtttctggaccattggtggtctgaagtgcacagactgaaaagaatgttggggaactggaaacaaacagggtgatacatggattgtttctttattgaaaagctctggtcagcgatgctatccacaatgacttgcaagatgactccctctaccttcctccctgctatgatgatgcagccaagcctgaagacgtgtataaatttgaagatcgtatccttcttgcagtagaaaagctgccttatttcacaagttgagatgtttgcacgtgtgtgcagtcaggttctctgagggtgtctgtgttctgtgacattcacaagagctccatccaaacctttgcagttgctcagtgctcttgccaggaggttaacttggcttcctcactagctgagggaccggcccctgggattcaaatccattcctcagcaaaatgccaaatgcccacagcttagacctgtggggctcactctccatggagagtcaaaataagagttgaaccagccaaatgcccaaagtctagggcagaccacttttgttgaaggaagggttggagcttagaatttcaccacccaaggggtccggtcagaaggaaaatgcctgcagtggctttgtgatgagaaaaagcagaaaagcctgggcagggaatgggctctgggctgggagtcggagaactgagtcaccaagctctgcccctatgtgatctgccctgtgtgatctttggctctctgagcctgtttccctgtctgtgaaatgccactgctatgagatgacctagctagttggatgtttctattttggttggattatattcttgacctgtaactagttctttcccctgcggagtatgaagctcttcagagcccatctgaagctttcaggaacgtcacgtcagaagaaatactgaagatgattgaggagaacaggtaccctgacttaagcagatggggattctggggagtgctgttgggacccaacagtagtcagacactgtgcaggtcctctgggcgtcagtcagtgaggaagtgtgtctggagcattggacatgaatgagccagtgttttcttgaatgtttgggctttcaggagctgtgggtcacattcgagggagagggctggtctctgagtccgtgggacctgcgacagggcagagggtggtgaggccttctactctggggctgggaactagagctggcctgtgtcacccagtgtcatgctggtgctgattgtcactggcagggcccaaatgctggcctgggaatgggtgctggccaaagtgatggtttctctgtgatgatatggtaggcaaacttttctaacattaaatttatgtatttaaaatattgtatattttaaataattcagagattatttccttctccctcccctttcccattaaaacagcttcttttatgatagtgagttttttttgcttttgagttttttcttttaataattttattttgataaagagttgtcaatctgaggtttgttcctccagtttttgttttaaaattttactggtcattgaaatccagtgccttggaattattattattatttctttttttttttttttttttgcttcaaagatttatttccaaaaaagagctcattactagttcatagttgtcttaatgtgattgtgactcaggggcaggtgcaggaacgaactctgagcggggagtctgaaaactgagtccccgaactctgcccttatcttcccttcttgaagcctcagtttttctatctgtaaaatgaggcatctatgagatgatcttgaagagcctttttatctctgtgagtccagggtcttgctagcagtagagcagtgcctgaaaataatagttagcattgactgagccttaacatttttgccaagcactgttctaagagctttactggcatcatctcttaatccagaaaaaatgctcaggaggagagtacctgtactatcattggccccaatttatagatggagaaaccagggcaccagataccaagaaacttgccccgctgggcacggtggctcacacctgtaatcccagcactttgggagactgagtcgggcagatcacctgaggtcgggagttcaagaccagcgtgaccaacatggagaaacctcatctctactaaaaatacaaagttagctgggcgtggtggtgcatgcctgtaatcccagctactcaggagactgaggcaggagaatcgcttgaacccaggaagcggaggttgcggtgagccaagattgcgccattgcactccagcctgggccacagagtgagactcagtctcaaacaaacaaacaaacaaacaaaaaaagaaacttgcctaaaccattaaatggcagagaaaggattgaaacccaggcaggctgactacagagtctatgctcctgactataaaaacagaggtcagaggttagcaaactacagcccacatgccaagtctggcctgctgcctgtgagtaagtaaagtataaataaagttttattggagcacagccctgttcatttacgtaagtaatatctgtgcctgctttcgcactacgatggcagagtcaagtagttgcaacagaggttgtatggcctccaaagcctaaaatatttactgtctagccctttattcatccctgcactgaaccatgttctcctattataaggagtgttgagtgtactggcccttcatcagctgcttttgttcgtttgtttttttttgtttctgagacagggtcttgctctgtcacctaggctggagtacagtggcgcagacagctcactggagcctcgacctcctgggctcaagtgatcctcccgcctcagccttccgagtagctgggaccacacacatgtgccaccatgccggctacgtttttgtagagatggggtcttgccttgttgcccagggtttcatcagctgttgagtgcgtcggggtgagaggcgcctgctgttctcgttgtaagagggaagtagttcctgacagagcccatcttaccctgacacaggcctccttttcttttccttgttttagccattgcacctttgtcatagaagcgttgaagtctttgccatcagatgtggagagccgagaccgccaggcccgatgcatatggtttctggataccctcatcaaatttcgagctcatagggtagttaagcggaaaagtaagtctatgataaacattttattctaattgtttccagtatattatttgtctgtaattcttagatgagttctgatgagagaagaaaatggatatgtctgtccaagtctttactgtcaactgtgagattcattctggtactgctgacatgtcgaggggacttgccaggcccctttttctctctggatctcccattttctcatctgaaaattggggccacgttggattatatgatagttcagggtccttccagagctaacatttgctacttctattctgcatgaggcaaagtagaatatccaggtcaaataaaaggaaaactttaagggactgttagaacaaacatcagccacgtgtgtgcgtgtgtgtgtgtatatatagagagagcttatgagttacacagatgtatcttgaaggcttgtggcaggtttgtgttgtgtcagcttatttctaacaggagagagtcaatctgatggtaacccagtgtcacctgtagctaggatcctttgcgggtcacaccctcatacctacccagagttggaaacccagaagatgtctgtggttttaggcacaaggtgtatttagttgttgttactgtgattgggcatccagtagtctatactcctgtttttcagtatagtcatgtgtcgcttaatgatggggatatgttctgagaaatgtatccttaggcaattttgtcattgtacaaacatcatagagtatatttacataaacctagatggtatagcctactacacacctaggctatatgctataagctgctgttcctaggctgcaaacctatacagcatgttactatactgaatattataggcaattgtaacacaatggtatttgtatatctaaatatatctaaacagaaaaggaatagtaaaactatgatattataatcttacgggactggctgggcatggtgggtcatgcctatatctcagcactttgagaggccaaggtgagaggatcacttcagggcaggagtttgagaccagcctgggcaacataccaagacactgtctctacacaaaaataaaaacattagctggggtggtgcacgcctgtattcccagctatttgggaggctgaagcaggaagagtgtttgagcctaggagttcaaggttacaatgagctatgattgcaccactgcctcggtgacagcaagaccctgtgtgaaaaaaatcttatgggaccactgtcacatatgtggcctgtcattgaccaaaacactgtaatgtgggacatgactgtatttgcttagtcatgctttttttgttgtttttttgttttgtttttgttttgttttttttgagacagtatctcgctctgtcacccagactggagtgcagtcccatgatcttggctcactacaacctccatctcctgggttcaagcaattctgcctcagcctcccgagtagctgggattacaggcgggcaccaccacgcccagctaatttttgtgtttttagtagagacggggtttttccatgttggccaggctggtctcgaacacctgacctcaggtgatccaccctccttggcctcccacaatgctggctgggattacaggcgtgagctactgcacccagcttgtatttgcttagttcttttttttttttctttttttgagacagagtctcgctctgtcgcccaggctggagtgcagtggctcgatctcggctccctgcaacctccacctactgggttcaagggattctcctgcctcagcctcctgagtagctgggattataggcgcccgccaccacacccggctaatttttgtatttttagtagagacggggtttcaccatgttggtcaggctggtctcgaactcctcacctcatgatctgcctgccttggtctcctaaagtgctggggttacaagtgtgagccactatgcccagccagttgttttttgttttgttttgttttgttttgttttgttttgttttgtttttttgagatggagtctcactctattgcccaggctagggtgcagtggcgcaatcttggcccactgcaacctctgcctcctgggttcaagcaattgtcctgcctcagcctcccaagtagctgggattagaggtttgcgccaccatacctggctaatttttgtgtttttagtagagatggggtttcaccatgttggtcaggctggtcttgaactcctgacctcaggtgttctgcctgcctcggcctcccaaagtgttgggattacaggcgtgagccaccgcgcctggccacttagttcttattttcacattccaattccacctttccccctctctccctgagctttcagcacaatttttgttttctaaggtcatgttaactctgggtccttaggcctcaggctgtgttttcttgtcattgccccatcaccagcatctctcgtgcagggcaaactgcaggctgcagcacaccaagcatgttttcattttgatgtggctgttctgctttgtgtgggccctgcttctcttaccacctggttctggtcattgcagtggcccagctgttggccttttctcttagctcatggttgaggtgtggcctgagggttttgagagaaaatgatcaaactcaactttgtgttgtaggtgctctgggacctggagttccccacatcatcaacaccaaactgctgaagcactttacttgcttgacctacaacaatggcaggtcagggggtggttgctgggatttttcttgtgcaggagaaagtaggtgggggttgggagtgaggagcaggggcttggactcaattccatgtccacggagatgcagtgctgaaaagactgctgccatttggaaggctcctggggccccagtaagtttagcaaatgctaaatatgacatactctgcccttcttagaaaagtattaccttttgggaaccttagaagctctgggaagtcctacaataaagacttgttttacttcacatacttttgaatagcccttcccgatgtctcacagagctggtgttctgcggaaaggcagcattgcagaaaagggcagcccaactcggtgactctggggaaagacccgcaggccctgcccctgggcttccttcctgccatttgcatggcgtgtgttttctgctcttgagtgtgcttggaagaatcagcacagctgatttcgggatgattgttttcccagcagccctgctgggcaggcggggacagactcacagggccctcaccagctcaaagcgctagcagtgcccaggtagagtgtaggcccagctttctctatctgcctcagagggaaacatggactggcacactgctccactgtgtgtgaggcccaggaaccttggaagggcaaagtcacccacattccttttcctttcctgaagttgggaagacattccgtgcatatgagaataggattggatgttcttattttgcttttggagaaattgtctgagagtttaattttgtttctcctttattgccactgattttctagattacggaacttaatttcggattctatgaaggcgaagattactgcatatgtgatcatacttgccttgcacatacatgacttccaaattgacctgacagtgttacagagggacttgaagctcagtgagaaaaggtgagcacaacagaataaagagctccctgcagggtgtctcgatgtcttatttctggtaccactggaaagcatgaggcaccaccaagggaactgaggatgtttaaatgtgggaacaacttggaactaaaggactattttcaatgaatgaatcattgactgaatgagcaactagacattactgagtgccttctctgtgctagataaattatgtcattatctcactgatttccctagaaaacaattgaagaatcaggctcagaaaagtacgtaacattctcaaggttacacaaccaagaggggagtagttggccttgagacctgagcctttccataacattctgttctgaataaccaggcagcctccattctctgaattgctgtcacaggggagagggattctgtatggttctgaggagtgcagctcagggtggaagttgtaggacaacccaatttgagcttagtaagaagagcttcctcacaatcagatggaagggtttgccaggggaaccgctggttccaaggccaggtggaactgctgtttggcagggattttatgtttgcacttctctgacccaactgggagagctggtggtggaggtgaccttttaggctccatctagccttgtagaggagattcagacagtaggggcagagctgcccaggaacctgaactgtgaggtcagctgatctttgtcagtgatttaggggcatctgacatccagtggcccagagggtgtctaggagagcctgtgaacacacctctgtctggactctctagcagtccgtggagggactgttctgagggctgtccacaaactgtgttcccacaggcagtgaggctgaaaaaaagagaacaggtacttggaacctgtcagattctagcaagtgctcaatcctggttgctaaaagtttggttatgggaggtaaagaaagttgctcacggggctgtagataccctggtttttcatcacccatatggatcttttgaagggcattaaaatgaaattggctgtctgatggttcccagcgggtgaggggaccttgcctgcctctctgccaggggctttgtgcctgctggcaacctttgggattctgtctttatggcctggagcatgaatgtgctgctaccttttgccaaacctccctgaacagtcatgttgaggggtctctccagttcttctgtttatgtcttccttaggatgatggagatagccaaagccatgaggctgaagatctccaaaagaagggtgtctgtggccgccggcagtgaagaagatcacaagctgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttc

SEQ ID NO: 38478 - DNA, 7612 bp, Homo sapiens
ggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacaggtgccgctgccccttagctggcttctgcccacgcccggcggggcccttctccggctacccggccactcggggttgcctgtttcctcttcccattattccggccgctcctctccctcatttcttcagctccttttccggtctgcccccgcgctctattctccgcctccgcgtcctccgcccctccttccaacggctccgcccctccgagctcgggttttccaccgggctcggcagtttttcctcaggcccccctgtggaccgcacgtcggcgccggcgtctgagccagccgagctcgcctcagagcccggctccttcccctcagcacttggccggagcccgcgcggttcctctcctcagcgcgcgtcgtcccctcagggctcccggttctcgcagttgatcaagtgaggcagaacgggtagtgcctgggttccccccgagtttgcgactccttttccaaagtcttttcctgctgtggctttcgcgggactctgcgagctgggtcgcttagattcatgagtgcttgggaggttcctcgtcgggccccggaccagaaaatagttttgaaaactaagtgaaatcggccacagataggctttttggcggccgtgctccgatgttaacgtcaaactttagtagtggtggtggttcctgctctgttttacatagccagtttaaaaggccctcacattctgatttcctctttcagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtaaaggtgcctaagaatctcagggttgggtcttttaattttaattttttttaagttctggggtattctgggggtacatgtgcaggatgtgcgggcttgttacaaaggtaaacgtgtgccatgcatcacctaggtattaagcccagcatccattagctttttatcctgatgctctccctccaataaggaactgacacttgaaccttttcgaggtaaaataaaatcgctagctgaactcactgtagccctttttgaatacacaacttatttgaatatgacaattgagaactttactggagagaacttagtattttggggtgagagaagaatgggaaattaaccactgtagtccacctttacaataaaaaaccctaaacacagaggagcaaaataatttacccggggaagtgtaataaattgtcaacttgacattagtacttgggcttagatctaaaggagtgttctgcctgctgattggttggattggtcatggagaaattggaattgtaagattgtttacatttctgttgaatgtgagtgaaatgaatccagtcaaaaataataacagctacatactgtgtaaattgtttcctcttcagaggaccgccctgatggtctagttaattagacttctagtgcattcagaagaactgcttttggggagcaatgcagttttgactgttgtgaagaaaggtgtttcgttttttcctttcttttttttttttaaagtctagtttgaggagagaaaagtctttagaaatagacattaccaacagattcgtgattaaaaatgtatctcctaggaggtaacagagcctttggcactgctctgaatgctttgtgtatattaactttacttttttaaacaatcctgtgaactaagtactgttagtatctccattttacacatgaggaaactgagacacaagagtggttaagtaatttgtccagccgggaagtggtggacagataacaatctggtgctggagtttatgttctttttttcttttcttttcctttcctttctttctatttttttttttttttttttctgggacggagtttcactctgtcacccaggctggaatgcagtgatgctatctcggctcactgcaacctccacctcccgggttcaagcgattctcctgtctcagcctccccagtagctgagattacaggtgcacactaccacgccccggctaattttttttttctttgtattttagtagagacggggtttcaccgtgttgcccaggctggtctcaaactcctgagctcaggcaatccacctgcctcggcctctcaaagtgctaggattacaggcatgatccactgcacccctccggagttaatgttgttaactaaccaccctagcataagatacccaaaaaggacttatctactcacttatcaatctccttgctctcatttaaaatagttagatgattttacatttcaaaattgaattgatcctaatattctatatttgcatattcatggagatctatccttgactatttctgggatagcacctcacatgtaaacccataagaagtggtcagggtttttcattattgatgcctgtctgtctctattgtaggcttgcttttctacttggggttgaatagaaatgaagtatagtttcacatacagtatgtcaaacctggatcttatttggattcaaggccatgcccaaagcatactccagatggcccatcgtacaatggtttcacttagagtttttcaactttatggtggtgtgaaagcaatacgcatacacattcagtagaaaccgctcttcgagtacccatataaccattctgttttacacttggagtatttaataaatggcatgagatagtcaacactttatcataaaataggttttgtgttagatgattttgcccaaccacaggctaatgtaagtgtgttctgagcatgtttaaggtaggctaggctaagctgtgatgtgtggtgggttaggtgtattaaatgcattttctatttagaatattttcaactgcttttttttttcctttttttttgaggtgagttctcactctgtcacccaagacagggtgcagtggtgcaatcatagctcacttcaagctccaactcttgggctcaagcagtccttccgcctcaggctccccagtagctgggaccacaaccaccatgccttattgtttttgtttttattttgattttttagtagagacaaggtctctctatgttgcagagagtggtcttgaactcctgggctcaagcgatcctcccacctcagcctcccaaagcgttgggattgtaggcataagccactgcacctagcctgttttcaacttatgatggggttataccccgtcacaaggctataccccatcgtaagttgagggtcattggtactagagagcaagtagcatagcactgaatcataggccataatgtcatcatcagtgataaagtaatgtatttttcaaataaagtttctagcactttttattagagagcaactgataactatactcttgtcattttgaatgtataattgaaagacctagtttgtagttctgtcaacttaagttttttaacttttgatttctagctataaagcttcgtggggaccttaacttatttcaaattgtgttgaacaaatttgatttatatttgtaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggtatgctagagactgattattattatctcttgccttaattcgtcccttgcacttcctcttatccacctacctaacccatctgtctcttctgcctcttaccttctcccagttaccaaaccttttgattttctcagctgtaaaatcctcccatttgtttgtctcccattttgcaatctctgtgttgtatttctatgtgtatctgtggctgtttctttgcatatgtgaatatctgagagagtgtgtgtatgtgtgtttatttaggcgtgcatgtctccaagacactaattttggagttctaaattttgagttcattatttagattttcattattcaaggaagacaatttgctcattttagttaaaagttttgcctatagtaaatccactaaaatccctaaattatatttactctttcatttattcagttacacccaatatataaaaggcactgttttaggtgctgtggatacagtagtaaacatgagataaagtccctgttcttatggtgcttacattctagtggtggaaaattgataataagttcacaaataaatgatcaaggtatttcatgtggtgaaatgtactatgaagaaagtaagacagggtgatgtggtagctggggtgaagactgattagaattgtcagagaaggcttggcagagtacctaacattttgatctgagacccgaaatacaaggaagagccagtcatgtgaagatttggaggcagaaggaacagcaagtgcaaaagcctaagtaaggaatgaacttggagcttggtgtgtttgaggaacagagggaagattagtgttgcaggagcatagtgagcaagggaatataatagaagatgaagttgggtgggggtagcttatgtaagagttctgattttattcatgtttattgagaagccattgaagtattttaagcagagaaattatggtaaggagtattattttctacaagtatattagaattcaacaggaactgatcatcgtaatagaaggatgaagaaaattacttgtttgttttctattagttcttccttgagacactagaagcttgccaaagggccaggtcagtaattcccacttgtttgactttaaaacctatcctagtttgatgttgcaagaagtaaatgcctcatagaattactatatatgtgtatatatatatttatttacattatagtaaaatgaaattaattttaaaataaaaaacctgagaagaaactggctggagcataatttttcttttagttttactgcttctgtctcttaggcactcagtaaatacttattcattcattaaatatttattgagtaccttctatgtgccaggcattgttctaggcacttggtatacatcagtgaacaaaacaaagactcctgttcttaactgagaggaggcagattcattgattatttcaggagtgaaattgttggtgtccttatcactataatgttggagaagagggaatgtcagggtggctgtgtaacatagaagccagtcttgaactatttagtgagtcaggagagaagctagattaaagaggaataaacttatcttcctaactgctttatgcaagtcaattttttccagatacttttaattagtattttcattctaaatgttaaatcagctttgattttgtgttagtacattaaaaggaaaacactgatttcataaacatatcctgactttttactcatgctgaaaaggaaggaaactgtacaagtctccaatttattttatttttatttttttacagttttaaatgtctttttttctatattaatttcaagaaagtcacataaaagcagtaagcagtgagaaagaatcagtaattgattggttatattttcttttctttttttgagacggagtttcgctcttgttgcccaggctggagtgcaatggtgcgatctcggctcacctcaacctccacctcccaggttcaagcaattctcccgaatagctgggattacaggcatgcaccaccatgcctggcctaattttgtatatttagtagagacggggtttctccatgttggtcaggctgatctcaaactcctgaccttaggtgatccgcctgccttggcctcccaaagtgctgggattacaggcatgagccaccacacccagccaataattggttatattttcattttaggtaaatcatttattttccccagacctaggctggggggtagtatgtttgttctaatttaagcgattggtttaaataaatttccgatgtaatggttctatgtttaaaaccttatttccagcatacatggtggtgtggtatattgtttaattgtatatgaagttatgatagtaaattactggcaaagattatttcacagtcttcatgcatggtctagtagtttccccagcttattatcttgtctggcagctattacttttggtttcaatttttaaattctgttttcatgaatgaattgtgcttcagtttaaatatgcccagtcctgagaagtattacaaagccatgtgaagacatttttcatgaaatatcatttctgaaatatatcagttgacataggagataaggtatctgctgaatttatattgacattttatagtactctttgtattgctttaataatcctagtatgtatacttattaaaatatataaaaattcacatgtgcagtttttagaagtaccactatattcttggaagttagattcagtcatcagtgggcagcagatgaagtatggaattttctcccatgttacctaatatttttcttcttttgttttagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggct

SEQ ID NO: 38479 - DNA, 2558 bp, Homo sapiens
agtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaaccttacccaagg

SEQ ID NO: 38480 - DNA, 24254 bp, Homo sapiens
tcgcctcccggggcgcggtaatcaccgcccagagggaaggaggtcggcagtgtgaggagctgctatggtgctgagtttcctggtagagccggccgagctgaggcggtcgcggccatgaaggtgaggggccggtggagccggacagaccctcctcgccaatcctatcctgccagggcacctgaagcgcctcctttctttccgccttagcggttacctagtcgtcatctcggagagctgcgctgaggggggtcgcttgcccggcttcaggtgccccaaccgagccagggcaggctgccggaccctctcgagctcctccagtgccacccccgtcagcgacccgagcggtggggagaagccgggcgtccctagcgttcgcgccgggtgggcccctctctgcgccgggccctgtgcgcctcctcgggggcctgaggcagagccgccagggctcgcctgagcctcggtcccttggcgcgcggcgtgccctttcccgccccgagtccttgaactaacccaagtgttggggacatcgtgggaccgaggagaacaggaggggtgcagggggtggtgaggctagggccaggctaacgggttaaagaactctcagggtggggatgccacccggaaggggtgcttcgtaggctgcacgtcggggccgcgaactagagaaggctggatgtgcctccatcgccactaggtaaacgcagcaaggaatttggcagcttgagttctccaaggtgggagtgagagcgtgggagcattactgatgagaagttgaagaaaaggggaaaggggagcggggtttccggcctacttctgagagatgattctcaacccgatcactgagagttctgaagagctttgtgaacagcagtcagttcagggtattgattcatttgccgaactcaaaccaagtgggatgagtcataaggtgatgataactttcagacctagatggtttcgttaatctcagtgcagaggtgtgctgggggtgggtaatctagcaggtgagctgctagattaacgctgtctccataaagcgtcaaagatttactatagaagattgaaaaagagtgtcagctggtcacagaaattcagcacatgttttgttgaacgttttctgtgcgttagccaagagggagacatggtgaagagaagtaattcaaaatacagtctcatcccttaggaaggcagtttaccattcaaaagaagagttatttgtaagtaaccatattacaaggcagaaggctataggtatcaaaaaaaaaaaaaaaaaaaaggcagggacaaaacacaggagccagaaaggatacttctggctacagaaagcaaggaatatttttggaataggtaactttggaactgtgccttgaagtatgaggatattgtaaaagcttatttttaactttccagtttagttataaaatattattacagcttgaaatatctattaaagtatctagaagtagctttatttcctgaaaaccaccctctgctgtgttaagatccaaaaacaaagcagggatctttatatataatgcctcgaagaatcagtatctttattaatattaaatttgtggcccattaaggaactagctatcgaaggaaagaattagagacaggtccagtgttgaaatttttaaacaagttctttgaaaacagacgtgtgttttgaattgaagtggaaggtactactttctaagatgaaattttagaaacaaagtttggtggcaattgaaattatagaaaagatacgtattttcagaagcaaaatatggacctgaatagacatcagcctgtgccagatgacagttataaatgatgcttttgtttttgtgaaactggatttacaccattgaggatttgggctgttaaatgtttattatttaacttaatgttgatttatattgaaattgtttaattgtgggtatgctcatctgtagatttctgggcagagactgattcctgatgtcatggaatgctaacatgtgaatgttcatgtaaggaaatacttctttctgtggaattaaaattacattaaaagctaagcaagtatacctggccgggtgcaatagctcacgcctataatcccagcactttgggaggccaaggcagatggatcacttgaggtcaggagttcgagaacagcttggccaacatagcaaaaccctgtctcgattaaaaattattttaaaaagaaaaaaaggaaaaaaaaagttaagcagttaaaaataaacaagaaaagctaagcaattatatggataagtacatgttcactcaaacctggagcagctggttttagtatatgtacggaatgggtatttactttctccctttggcgttttggtttggtttggtttggtttggtttagaaactgatgttttgaaataggtcttacctctcagactcaagtaactttttaaccttgcagtaacatccaatcaacttcctataagggattaaaaaaaaaaatccaaattggtgccctgtgttaatttgatttaatcctctttcccatttttccttatttatattgatctcaccattaattgtgctaatctgggttcttccaagctcaaaatgagatatcaaggagaaagtaatctactgaatgtaattccttttcctttttttttctctgaaaggtgggggagtggtactaaggatcaagtatactgttaaaagaaaacaaaaacccaagcatgaggaaggtaacatttgtatctatagcacatgttattgtaataatcgatcagtttggccaatgtcttgtctaaaagtattacattttagagttcatcatctgtttttgcaacctgcttaatgtccaaatggtatgagagaaataatttaggatgtagaattccttcctttgtggtatatggtcggatatttggtcactaagaaagagttaggtccctgcatattgtatttcagttgaagcagcagttttgataagaaatcctttcacattctaaggagcatatgtttctcaaatggctctaaataggataaagaggccgggcgcggtggctcacgcctgtagtcccagcactttgggaggccgaggcaggcagatcacaaggtcaggaggttgagaccatcctggctaacacagtgaaaccctgtctctactaaaaatacaaaaaattagctggatgtggtggcgggcgcctgtagtcccagctactctggaggctgaggcaggagaatggcgtgaacccgggaggcagagtttgcagtgagccaagattgcgccactgcactccagcctgggcaacagagcaagactctgtctccaaaaaaaaaaaccaaaacaaaaaaaaaaaaggataaagattttgcttttttatcaactgttttttctgctttgcttttagttatgtaggaaagtttaacctaaccaagattaaactgtaaaaccgattattttatatcaccgttgctaagatttaatacatctttttcctgtcgtttaacacaggacattgagttttagcaaactgaaggttgtccagagtttgaaacaaaccctggacatatagtgggtgagttctctgaggaagctttcattgatggaagaacagtatcgctccttggtccttgtagattcatgtagcatctgagacaattatttttgaatttaaaacttctaggttcatccttaaaataactgtgtaaataatatatttaacttagagttatggcaagcaaggtagacgcttatgagaagagtctatgggtttattattacattgctatttacctagtttaataaaaagtgaatgactgtgtagtaacatattagagttttggcaagcaagatagactcttacgagaagagtctatggcattattattaccttgctatttacctagtttaataaaaagtgaatgacttagatcatttagttttctgtttcttttttttttttttgagatggaatctcactctgtcgccaggctggagtgcagtggcacgatctcagctcactgcaacctctgcctctcgggttcaaacagttctcctgcctcagcttcccaagtagctgccatgcccggctaattttttttttttttcttcgtatttagtagagacggagtttcacaatgttgcccaggctggtcccaaactcctgagctcaggcagtccacttgccttggcctcccaaactgctaggattacaggcttgagccatggcacctggcctagttgtctgttttcatactcataaactttcttttcccactctccccctatacttctcttgtgtctggctgtcatttaatctttttttttttttttttttttttttgagatggagtctctctttgttgcccaggctggagtgcggtggcaccatctcagcttactgcagtctccgcctcaagtgattctcctgcctcagcctcctgtgtagctgggactacagttgtgcaccaccacacccagctaattttttttggtatttttagtagagaccgggtttcaccatcttggctaggctggtcttgaactcctgacctcaagtgattctggcctcctaaagtgctgggattagaggtgtgagctactgcgcccagcctgtcatttaatcttcatggaaactaccatagcttttctgattcttcgttctagtctggctggttgataatatatttaatggaatcattaaaagtttagggttgaaaatttgtggtaaatttgtgaattctttaaattgagcattttgaagtattttctccccacagggattctgaaaacatattagattatacacacacagaagcaaagacagctgaaccttgaggccatttgaaaatcctggcactgtgccagaaagagagctgggctgctgctcttgcaaagaaacagaacacctttcctcttgcttttgttgactgtaatgatgtttcatgggcttatattgtttgactctgactgaggaacctgagagagtccttataaccttattggctggaaactgtcattcctactcttacgcagattatttaggtttgtattctttcccctcccatttgcttcctctcctttgctcctacagaggggagggggcttctaattcatttttggggagggaacagtatgggagaaacactgtcagtctctgctatgggaggaaaaagagggacttgaatattgaggagtttcagtgaaggaactgacatgcttggctcagtactttctgggaccttctcacatttgtcttcctgtagtgaagatggagttctggtctccactcaactagctggtaagctgctcttggtcagctgtatattatccagacttggctacagagctaaggttctgttctccagttgatgctatcagtaaaaacaaacattttaatttccatttgtcttcttgctttttttttctttttgagacagggtcttgctctgtcacctaggctggagtgcagtggtgcaatctctgcttaccgcaacctccgtctcccaggttcaagcagttctcctgcctcacccttctgagtagctaggattacaggcatccaccaccatacctggctaatttttgtatttttagtagagacggggtttcaccatgttgaccaggctggtctggaactcctgacctcagatgatcctcctgcctcggcctcccaaagtgctgggatcacaggcgtgagccaccgtgtccggcctctgtcttatttcttttttttttttcttgagacggagtcttgctctgttgcccaggctggagtgcagtggtgcaatctcggctcactgcaagctctgcctcccaggttcacgccattctcctgcctcagcctcctgagtagctgggactacaagtgcctgctaccacgtccagctaattttttgtatttttagtagagacggggtttcaccatgttagccaggatggtctcgatctcctgaccttgtgatctgcctgcctcggcctcccaaagtgctgggattacatgagccaccgtgcccggcctgtcttatttcttaattagctccaaattggatgtggaaaaaaggtactgttactggctccctaaaatcttggtgcactgtctttgaagaaaagaggagaactggcattggataccagaatgacatgaggatatctaggtgtctgaggcagtccaggcaggttttagaatttgatttcttattatggaatgtgtaagttgttgttgttgttgttgtttgagacagactcttgctgtgtcgcccaggctggagtgcagtggcgtgatctcagctcactgcagcctccgcctcccatttcaagtgattcttgtgcctcaacctccccagtggctgggactacaggcacttgccaccacgcctgactaattttttgtatttcagtagagatggcgtttcaccacgttgcccacgctggtctcgaactcctgagctcaagcaatccgcccacttcagcctcccaaagtgctaggattacaggcgtgagccaccgcgccgggctggtgttaagtttttaaatacgatacctggtttttaactgatataagccaggcagaccatggtcctatggtggctctactgagagcagctttggcttaagagagtgggtaggaaagggattagactatcaagaacaagtcatttatttttagtaatcactgatgactagaaaataaactccaaacacaggtgaattctctgagcttggagttttgtgctaggcataggcagacagttgcctcattctcttattctctatgttgttttaaactacattcatggtcaagagaggaaatttagctatcttcacgattatcgttcttttttaaaaatataatttcaacttttagatttgggggtacacgtacagacttgttacatgggtatattgagtgacgctaaagtttggggtacagttggtcccgccagcaggtagtgaacacagtacccaacagttagtttttcaccccttgttcctttcctccctccttccccctccccccagattattgttctttctaaactgttagaaaaagggttatacttcttacataccacttggatgcatgtggtataacccatggagttttgctgccaactaaggtccccaagtaggtcatgaaagcccagatcatggcttgcattttgaaagttccagacttttcagagatctggctttgggctttattcacggaggagtaactgtagggtttttttcccccaatgaacaaataatggatggtgacccttccataaagaaggcaccactttggaattgaggccagtgaattgactgcaaattcagaagccaaaagggtatgcctagtatactgtcagaagccagaggtgggggtatgcctagtatacaacaactcagtgaattgactgcaaatgcagaagccaaaggcatatgcctagtatacaacaactcagtgaactgactgcaaattcggaagcccaagggctacgcctagtatgctgtctttccaggaattgagttttctcaaaatctaggaggaaatggagtggtttgtagaagatgcttcaatcttactatcagtatggaagcaatgaatgaataaaagaaaaataaaggaatacaggctaatttaactggaggaagatcttaaagtatagggaagacagaaatggaacaggaaagaacatgaacttaggtctctaaagcttttaaaaggagggtgcagaagagggatccttgttggttatgaccctaccggatatggtaactgggttccaaggaaatataacagaggcagagtgtgaagagctcagaaaatagattggcatatgttccccccatcccttgtccccctctccactgtaagagctcagattcaataaacccttggggaaattgtcttttaaatagttctccaattgcttttataggttctgtcaagtcataacagaaaatgtgggccaagcgtggtagctcatgcctgtaatcccagtgatttgggaggctgaagcagaaggatcccttgagccctggagtttgagatcagcctgggcagcatatcaagaccccgtctctaaaaaaataaaaataaatggccaggtgtggtggctcacgcctgtaatcccaacactttgggaggctgaggcaggcagatcacctgaggtcaggagttcgagaccagcctggccaacatggtgaaaccccgtctctactaaaaatacaaaaaattaccagggtgtgatggcaggcacttgtaatcccagctacttgggaggctgaggcacaagaatcacttgaactcaagaggcagaggttgcagtgagccaagatcataccaccgcactccagcctgggtaacaagagtgaaactctgtctaaaaaataaaaataaaaataaaaataaataaaaactagaaaatgtgtacagatttaagaggggaaagatcagtataggacacttcaagcactgttaggtgagtgtcaaggtgacagttgtaggtagagatgcctttgccctgaggaggcatgcagaataaatttctgaaatttatgagaaagtacaggaagatgaaacatactaaaggagagccaggtagatggagtccaggcttggaaggatttatcttctggatggattcttcatcctggaggtgaagaaggacaaaaacactttgaacaatggctgcttttgatagacccagaaatcactgactttctcctcatattgggagatttcacacaagaaaacgtgcagaggagttaaggtgggaaataaaagttggggcccaaaggcaaagagcaaataaaatcaaggagagcaccaaagtccagcaaaagttacaggccaatctgtggtaaaaaggaaagggattcattgaagaatcagattgttaaaaactcaggtgaccctttctttttttttttgagatggagtcttgctcggtcacccaggctggagtgcagtggtacagtggcgtgatatctgctcactgcaacctccacctcccaggttcaaacgattctcctgcctcagcctctcgagtagcttggaccacaggcgtgcaccaccatgcccggctaatttttgtatttttagtagagacggggttttaccatgttggccaggctggtctcaaactcctgtcctcaggtgacctgctggcctcggcctcccaaactgctgggattataggcatggaccacaacacttggccaaaacttagctgaccctttcttaaaggattgggtaaaaccaaagtgggatgcaaaatactacatatcccacaacagaaaaacatgtagacaggtcttggggagtatgttgccgaggcattagttccagaactctagggccacaggcttccaaagtaaccacagccctttccactcaggaatttgtggagggtgatgtcccagctgaaacagtgtaggcaggaagaagacatcttccctttgactgagcaggtcttaagcttttaacctggcctgtatatcagaattacccagggagttttcaaaaaaattctggtgcccaggctgcaccacagaccagtgaaatcagaacctctgggcctgggaccccaggaatcagtatttttaaagacttgcctggtgagtccaacatgcagccaaggctgaaaaccattctcttaagggcagtttcacaaccctaggcaattccttagcaagaagtactgacagcagctacgaaggtacaggactaaaacacctgtttcactgaagggcagcgggggtgggtgttacctggcacttcagtgctaaaatgaatgtaaagaaattatgttcatggccaggcgtggtggctcatacctgtaatcccagcactttgggaagccgaggcgggcggatcatctgaggtcaggagttcgagaccagcctgaccaacatggagaaaccctgcctctactaaaaatacaaaattagccgggcatggtggcagatgcctgtaatcccagctactaggaggctgaggcagcagaatcggttgaacctgggaggtagaggttgcggtgagccaagatcgtgccatcgcactccaacctgggcaacaagagcgaaactccgtctcaaaaaaaaagaaaaggaattatgttcatttcagcactgggatgccaggaaatatggggcttaaaggggagatggaaattaaaattttcaaatatgctgcatggggctggcgtggtggctcatgcctgtaatcccagctctttgggaggctgaggcaggcggattacgaggtcaggagttcgagaccagcctggacaacatggtgaaaccccgtctctactaaaaatacaaaaattagccgggtgtggtggtgggtgcctgtaatcccggctacttgggaggctgaagcaggagaattgcttgaacccgggaggcagaggttgcagtgagccgagattgcgccactgcattccatcctgggcaacagagcaagattctgtctcaaaaccaccaaaaaaaaaaaaatgctggatgggaaaaaaaaaaatacttcaaatatactagtgacaggggcttcccctgcttcaaatttctgaactttccagaaggctggagtgttgcaaatgctcctctcagagatgataactataagtggatttgcccttcaatatgatgctaaggttattctctcactgggagatcatgttctcattggaagattttgcccaaatttaagttcagagattctaatgaggctgcaacctaaatttttcaggattgcttctttaccttctattcctgtagtatttggctgacagtagttaatatgtgtctgagttgtactgaatattgggttatagcaacatttttgcctgggacactttggaggttggcttgggcttttttgttgtttgtttttgagacagggtctcactccgtcacccaggctggagtgcggtggcgtaagcatagctcaccatagtctcaacctcccaggctcaagagatccttttgcctcagcctccgagtagctgggagcacaggcacatgccaccacacctggctaattttattttttgtagagatagagtctccctatgttgcccaggctggtcttgacctggcctcaaacaatcctcccaccttggccacctaaagtgctgggattacaggtgtgagccaccattcctggcctgtttttaattttttattttataatgagggctaaattaagtgtttttcttcattttctttctggggaacaaagaggaaattcccttccttgtatagaaacgtgaggaatgggacaaaattgtccccctccaaaattggtatctacacagagaatccatctgttttcccaaaataagtccttctattccctttaccagagctgtgtagttgaaaaaaaaattttcagcctagaattttaatgctcatactcattaacatggtttgaaaaattgtattcttccctaattcattgtaaaactatccctgatacaaaggtcataatctctgacagtgctgcttttaaaaaggggtgtcatttgagatttttggttttctttaccaagaaaacatattttgaactttctaaatagcatgtaaaattttataatgttacattgtctgtgaagagataataggaattttttacacagttacttgtcagtcataccatggtggaaagaggagcaggagaaaaagaagtttttgtccatgaggaactttcactgtagtccaggaggcaacatcagacatgaattagaagggggataaaagctaagagagctgttggtttagtagctacattagtaggaagctaaacttgtaaaactgcacttctgttaaccctggaatgaagagaagtttatcctgggagtactttctgcagttgaggtatttttttccccaaaaaatgtaacgtgcaaactaaattttttagaacaaagtttttccagttttaagagtgcatactctaaagaactgtggatgaatcctttacttaaaagaacattaactttattattattaattttttttgagatggagtctcgctctgtcacccaggctggagtgcagtggcgcaatcttggctcactgcaaactccgcctcctgggttcaagcgattctcctgcctcagcctcccgactagctgggactacaggcacgtgccaccatgcccaactaatctttttttttttttttttttttttttttgagatggagtcccgctctgttgcccaggctggagtacagtggcgcaatctcggctcactgcaagctctgcctcccgggttcacgccattctcccaccttagcctcccgagtagctgggactacaggtgcccgccaccacgccaggctaattttgtttttgtttttttagtagagatggggtttcaccgtgtcagccaggatggtcttgatctcctgacctcatgatctgcctgccttgtcctcccaaactgctaggattacaggggtgagccaccacgcctggcctaatttttgtgtttttagtagagatggggttttgccatgttggtcagtccagtctcgaactcctgacttcatgtgatccacccgccttggcctcccaaagtgatgagattacagatgtgagccattgtgcctggctgaacactaactttaaattaactcttagtgaatctagatgttcatgcttttttttttttttttttgagatggagtctcgctgtgtcacccaggctggagtgcagtggcgtgatctcggctcactgcaacctctgcctcctgggttcaagtaattctcctgccttagcctcccaagtagctgggattacaggtgcctgggccagctatttttgtatttttagtagagacggggtttcaccatgttggccaggctggtctcgaactcttgacctcatgatctgctcccccacctctgcctcccaaagtgctgggattacaggcatgagccattgtgcccaggctattttttttttccttcctcttttcgaggcagagtctcactctgtcacccaagctggagtgcaatggtgcgatctaggctcactgcaacctccgcctccccggttcaagcgattctcctgcctcggccttccaagtagctgggattacaggcatctgccaatacgcccagctaattttttgtatttttagtagagacggcgtttcgccatgttgtccaggctgttcttgaactcctgacctcaggagatccaccttccttggcctcccaaagtgctgggattacaggcataagccactgagcctggccagattttcatgcttttaagcacaccatggctgtagagtttgaggtatataatcatttaaaggtatggactgttataattttacctgtccttttttttttttttgagacggagttttgctcttttgcccaagctggagtgcggtggcacaatcttggttcactgcaccctccgcctcctgggttcaagcgattctcctgcctcagcctcccgagtagctgggattacagaagcctgccaccatgcccagcttttttttttttttttttttgagatggagtctcgctttgttgcccaggctggagtgcagtggtgctatctgggctcactgcaagctccgcctcccgggttcacgccattctcctgcctcagcctcccgagtagctgggactacaggccccaccagcatgcccagctaattttttgtatttttagtagagacaggtttcaccgtgttggccaggctagtcttgaactcctgatctcgtgatccacccgcctcagcctcccaaagtgctggcattacaggtgtgagccaccgcgcccggcttcacctgacttttaaaggcatcactatttcttgagaattatagggtgtgaagacttataatattgaaatccttggctttgatacttcagactgtttgaaccttgtgttgtggtttcttctttaccttctcctttctttataatacaacattacttctgggtaatagcagaaacagccattatccttctgttgcattccaaagtgccttttgcattttaaggttgagggctttttatttgctttttgttttaagagcttgctggacaaacagtccagcattttacatgctattataaaatgtttgacagaatcagataataaaataaatggaactgtattattatatgctgccattttaactaatacctcagctatctcgacttccattacctatcacattatctagattctagaatatgcttaagaattaggacaaaggcaaaagcctattcgttctaaacactatagcttttattttaagcatgggaaaatgcctttggccctcgctgaaaatttattcttttatgtatacttgggacaagcatggttatcaggtttctgagactgcagtaaaaaggagacaggttactctgggcaggtatagtgatagccctggtggctcaaagagagggaagagacaaggaaaaaaccatagaaagcaatacattagttctgggccatttagtggagtagcaaatagcccttacgccttggaaggtcatgatggttatcaactcattaaaaattatgtttagtatcttcagtttgaaaaggtaaaataaaaaaatactttcctgttgttgttgttgttttttcgagatggactctcgctctgtcgcccagcctggagtgcagtggcttgatctcggatcacaacaatctccgcctcccgaattcaagcaattctcgtgcctttggccctcgctgaaagctgggaggctgggcacggtggctcatgcctgtaatcccagcacttcgggaggccgaggtgggtggatcacctgaggtcaggagttcgagaccagccatggtcaacatggtgaaaccctgtgtctaccaaaactacaaaaaattagctgggcatggtggcggatgcctgtaatcccagctgctggggaggctgaggcaggagaatcgcttgagcccgggaggcggacgttgcagtgagccgagatcacgccattacactccagcctgggcaacaagagtgaagttccatctcaagaaaaaaaagaatttggaaagtagagaaaatttcagagaaaataaattacacataatacattaaaatctattctggtttgtctacaacttcaggtacaaaaaaatctagagagagtttcagttggtgttttgatgttttccaagtcatttaaaaaattatttacatatgctatagtatattatacccaattacaaatgcgaaaacagaggtttaaggaaatgaagtaatttaaatttatgggcctggcatagtggctcacacttgtaatctgagcacttcaggaggccaaggtaggcagatcacttgaggccacgcatctgagaccagcctggacaacatggtgaaacccaatctctactaaaaataaattagccaagtgtgtggcgtgtgcctgtaatcctagttactcgggaggctgaggcaggagaatcgcttgaacccaggaggtggaggttgcagtgagccgagattgcgccactgtactccagcctggttgacaatgagaccctgtttttaaataaataaatttattttaaataaataaataaattgatgttatttctgttaaataatagctgagaaaatctgccttagactgtagaactgtggtgcaatggccaccagcctaatgttgccaggtaaaatacagggtgcctgaaaatttgaatttcagatgaaaaacaaagaatttttagtatatgcatatcccaaatataccacaggacagacttttgtccagtctttttttttttttttttttttacatgcctgtgtacatgtatctgttttgggtgggtagggaggttttttgttctgtaaaatttggatcatgttctctttttgttaaacaagagatcatgggtattggcaatgccagatattctttggaaatagcagaaaattctttccaaatggcttgaaatttcagtgcccagaggaatatagtaatctcaaagttattgagggcaaacttacctctccagaatagcattccctgaggatcccagagagcccagattccacttagctttaaactgtgggatttgtgttcctttttaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaaggtgagttggatgaaatgttacataacaacacacatgggtcagcattcttgattgtaggttattttgaatagctattgaattttcatttctgtttataaaaatatcaaaagcttagttccattagccattttccatctagaaaaatacttaattggagggattatattactgctcaagttttatagacattgtttctcatgttcaggcatcctttctcctgaactttgacctgtttgtatcattttattttctattatgtttatttccaaaagcaagaaatttgttagtctgtagttttgttcacaaatgatttactgtaactatgattcagattcaagtttcaaaaaagtatcccgtaccttaactttcaaatgaataaatgaatgcaataaattaactactctttagagattcaacatcaaatacttagctaacagttattttcactaagatggaaagtcattcagagacccatcatattggtaggcctccttgctctctttgatctttagtttagtcttctgaaatacttaaggaaaaaaaatgttagcttgcaggaacaatgcagcgagcagaaacgaccacatcttagtgccctctttaagcttctctagtggcaaggctttgattgtgattaggctgtgtagtttacagattactgtattagtgggtcctgtattttcttggattcaccttgagagatcagttgcctttctctttccctgtcagtctgttatgctttttgtctcctgctctttaaatggaggaaattgttcatgtaggaaaagaccaggaagtgtgattctgctttctgctctgtgtggttcaagctctgttttgttaattacatgtttataccaaggggtggaaaggttttaattcattaacacaagagtgtgtttttcttaaagtcctatattagaacttctgtgaatccagactgccttggcaatgaatattttgattttcatggcttttgaaacatgaaaatacctctggaaatagtctggtgccactggggacttcactaagaactaaaattaaattttagtagaaggcagaaagaaaactcatgctttcataatggtttatatcttgctgtcatcaaatgcttttctttcttcagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacgagggggtaactaattacacccagggcccggcacgcttattcttggccgtatatggtggggcctttagtgcttgatgacttctgataaacttcaagtcatgtgctggagtgaagcttccacacccagctgaactctgcacttaaaggctgtcctgatgtatagtgtctgctgaggtgctaggtggctccaaagtctgctgtctgaagggtcccaaaatagctcatcagtctcttggccttagttaatttctctgtcttacacagttagacactaactgttgaagaaatggctgtgaaaaagtagcacatacacatttgtagtgttatgtgttagtgcacgtgtttcagtgaccacagaaaacaatcagtagtgtaagttagcctaatgcccatttgtcttgctacagtgaaattgttctaatttagttaatgaaagagccatctgaattagtgaaaaaatgtagttatttactaattgtaattaataatattgtcccagtgaggtccttggacatcctgattgaataacatgtaaaggcttgtaattaatatttacttgtacgtgagtgattctaaactgctgaaagaaatgttttgaacaaattttttcacgcttaattttcttctctgaagaagggggttattaaaagtagaggaaagctggatgcggtggtgtgagcctgcagtctgatacttggcaggctgaggcaagaggattgctttagttcaggagtacgaggctgcaggtgtaccatgattgcaactgtgaatagccactgtacccccagcctgggcaacatagcaagacttttttttttgtttggaggcagagtctcactctgttgcccaggctagagtgaagtggcgagatcttagttcactgcaacctctgccccgctgggttcaagcaattctcctgcctcagccttccgagtagctaggattacaccccagttaatttttgtatttttagtaaagatggggtttcaccatgttggtcaggctggtctcgaatacctgacctcaggttatctacctgccttggcctaagtgctaagattacaggcatgagccaaccgcgcctggccaagagtgtcttttaattagtaaatgaataaatgcagagggaaatttggtctaattgccttctagatatagtcctgtgtcctctaataatgttttggtcagtgatagaccacatacacggcagtggttctgtaagattataataccatatttttattgtaccttttttgtgtttagatatgtttagatacacaaatacttattactgtgttatagctgcctacagtattcagtacactaacgtgatgtacggcttcgtagccggccatgccctatagcctaggtgtgtagcaggctgtgccatctaggtttgtggaagtacactgtgatgttcgcacaatgacaaaatcgcctaaggacacattactcagaacgtctcctagtcgtcaagcaacacatactgtagtcgtaaattagataagtccaagccaggagttttattattctcccaaatgagaattggcatatttatgctgcaaacataaggcacagctgacttacataccccttttgggtatacaccaccatttgggtgatgtggattgttggatgctacagtatggtgcctggcaatcagggtggaatatttgaaattgggaaccgacctagcttattggagagctattgtcaaatatagtcaaaagaaaatatgtgaaggaaggtacataacccaaactgaagagatttgtgttttctaaagtgttctgattgagaaattttaaaaactagaattagcctcagccatcagtgaagtctagaaagccttcgttggaattagattgtctaagtacgctgtggtaggactgagatctttcaaatcagatgcccctgatgcttgggctgacccatcagagctttagcttttttctgtctgcatcttacaggctccagttaaactagccatttgcaggtactttgataatgacacagtgctgtcccatatccttaatggctttggcattccattatgggaccttcctgagagagttaatactctggttagattttataactttacacacacacaggaatttgtgttttgagctaactttatggaaggtaggttcttcatgcaattttgtagggcccaactttttggaagggtcagcagcattctgaatccaaagatgtgcattatgctggctttctggtcatcatggggagcatcaatgacaaggttttctctagtgataaatacagattgattcctgacctaatcagatacgttgtataagtgtaggtacaaagtgaaatcacttcagcaaacacagaagatgatgatgacgacgatgatgaggatgatgatgatgaagaagaaaacgcagaggatcgggtgaggccacctataaaatttggtttccctgacatgtcagcctgacaggaagggacagtgccctgtggacattcgctagattagtacaggatgtttcttctggtttgaatgtaggacagtatactgaaacacttctaggactgctgagatggctgggagaatattcagggccagtgatgagtttagagtggggagggtctggacttatgggaccagggctaatggatgctctgtggtttcagaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctgtaggtttatcttttcattttttccctgtagtatttttccttaggcttttaaaaactgggttgtttttgtcacaattaagtcaaatttatttttgagaaagctgtgtaccattttactgagtatcagttagttacatgagcctgtttatagatctggaaaggagtaacttcattatgtgatgttcattatggctgcgagaccaccactgccaagtgagttagaaaattattcaatttggtttttcttactataattaactatttgttacaaccctaattaaattcctcgtctctgtaaaaatgcttattttctcactaatgcctttggccggccagtaccttggttctctcaacttttaaatctaacagtagggggaaaattccctatagcccagatgttacatagttcttagcatcaactatctgtagatttctgtgtaagtcacaaaaagctgaggttaagaacttctgaactaggctgggcttggtggctcacaactgtaattctaggactttgggaggctgaggcaggaggatcacttgagcccaggagtttgagaccagcctgggcaacatagagagatcccatctctaaaaaaaaaaaaaaaaaaaaaaaaaaaccaaaaaaacctggtgtggtggcaccagcctgtggtcccagctacttgggaggctgaggggggaggattgcttgagcctgcagggagccgtggtcatgccactgcactccagcctaggtgacagagcaagactgtctcaaaacaaaacaaaacagaacaaaaacttctcaactatacattgatgaaatttggcacagaaattcttcctcagctggtaacacgatcaagccacggaacatttatggacaagaaaaaataattcagttgtatttatttttttctttttaattgtaaaaaaaatatatatgtacttaatatttttaaattgagacagggtctcactatgttgcccagactagtgctgaattaggcgtgggccaccatgcctgaccctcagtggtgttcagactaacaaatcttatgttcctatctagcttaaacagccctcccatcattaacttttatcatcttgagttttgtcctttaaaagctggttataatacagcatttgttgatgaacaggtttatgcccagaatatgcacaaaatattttggcaatcctacttcaaagatgatgtcacagtggtagatgcaggaatcttcatcctcagagctttcagaggtcgtaggctgctggctgggaaatggttttctggcagtgaggggagaagtcagttgacttcataaatgtaaatagcaactatgtacagtgcacaacgataatgccattcccacccttaagtactttgcggcgtaggatataacatggttgttattatgacagcatggtttccagtgtctttctccattaactcactgcataatctaaccctagttcaatctctggcttgggtggaacacacattttgttttgagcacagctggcatctttcctagcttgactggctccaagtcactaccaagattgttcccatatccctgacaagatactggctcctctgctttcctaagttctaaagagtgggaaggaaccctccacacagaaggagagaccaaggcccactctgatttcatcttgagttgcctagtgccttctccattggcatatctgccatctcatcccatagatcctttctccccaggtccacaccagtagtcgtgggccatgaactaagaccccagatcacaagaatctctccccatgaatggcagtaaaacatttctcttaaatctagagactactgacctttcaagcttgaattcctgttctgttccaactattcatgattccctttgatctcctctgacctgtagaaagggaagcacccaaatccatagccctatggccaaatctcaggctggggttaacttttttttaacttattcatcgtctttcttattcacagactggattttctcagatgtaaaggtgggccaagagccaggacggcccatctctttcaagttagacttcagcagggccaggaacacagatggcttgagatgattctaaggctagggagggaaggatgcacaattattcctaactttcctaagggggaactaaggctccttttcctactgagatgaggctccagagactgtggtgttcccagggctacaaagctggggcaactgagttaaattccaatagcatcctgactccaaagcccatctacagaagaccagctgagggtttctttttctagttacagaagtaatatatccctatcacagatgtcttgaattagacaaagatataaaatagaaatacatagctaacatttgttgggtacgtcaagcattttattctttacaaaaccctgaggtatagcttttatcattgccatttctagtggagagaaccaaagtgcagagaagttgggattatttcttgtacaacactggggtggcattgggcctgcaggggtcattcagcaggtggctgctcagcttcggactgggagggtggctggctgactggccatgcctgaagccgaggccttagctctctgttgcctttcagatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagctttt

SEQ ID NO: 38481 - DNA, 3266 bp, Homo sapiens
ctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttag

SEQ ID NO: 38482 - DNA, 2306 bp, Homo sapiens
gcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcaggtacggtccggggggctgtccccgcacttaggacggggtgcgctgcggctaggaccccccaggcgcccctcggagcgcgcagagcgctgggccggtttccccatccgcgaggcggcctcgggagggagcgggggctgcgccgggcggggacccgcccccgtctcagcgccccgtcccgtcctgtccccagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgagtggcggtctggttgggacagggtgggagtcccgaagtcttaccctgcctgggcttggcgggaatgtgccttgtcggccccactgcagaaggaaaaagtgagctacaagggttggatgggcttgtcaggccacacagcctgggactgctggggagggatggcctccccgccctcccttcccgattcatctctggaaagagctggcaggggcagagtggagggaaggggaggccgggcccagcaatcctgggcctctggtccctgaacggttgggggaagagatggtggggacagaatcgaagcctccggccaaagctgtccggggctccctggcccagcggtgacctctctcccctcccccagcccaaccaacaaaagtccagtgtgcagcccggtcaccatggagacgccgctcgcctccctgcagggcaccaggcccagctcttgcttggctctcctggagcttggcgcctgaccctgaaagggatgggctctcgctattctgccccctggccctgggccagggaccccagaccacccttcctctgcccccacttcctatcaccctagctgggctgctgctcttcagacctcagatccgggaaactagaggggtcccagatgctggggtgcatatgtcagatgggagtgcaggagggcggcccaggacagctgatcgctaggcatggcccccaggcccacgtctgtgtgcattcctgccttggaggtacgcgcctgcaagtgtgtttcctgagtacaggtgtcgccgagggcgtgcacatctgctgtgtagctctctgggacccccaggtgccatcaggccctgagcgtgggctctgctcatttgcctgctgcctcctgccgcttgtgcggacaagggacggggcctggggtgatgccgggagagggcagggcctctcctcaccaccccctctgcatgccaggtgcctgcaggccctgcagcgacgctgagctgctcctggccgcatgcaccagcgacttcggtgagtgtccccgccatggggggagcctggagcctgccttcccctgaatgcctaccgcagccacatgcctccccacagtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgc
